United States Patent 12,508,308 (INFLUENZA mRNA VACCINES) - sequence listing, part 32

SEQ ID NO: 122182 - RNA, 1701 nt, Artificial Sequence
  derived and/or modified sequence opt3 from hemagglutinin__InfluenzaA__AAY44795
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcacccaucagauucucgauggugagaauuguacucugaucgacgcucuacugggcgauccacacugcgacggguuucagaacaaagaaugggauuuguucgucgagagguccacagccuauucuaauuguuacccguaugacgugcccgauuacgcaucgcuccggucacugguugccagcaguggaacccuggaauuuaacaaugaguccuucaacuggacgggcguggcucagaaugguacuucuagcgcaugcaagcgccgauccauaaaaucauuuuucagucgucucaacugguuacaucaacugaaguauaaguacccugcccuuaaugucaccaugccaaacaaugagaaauuugacaaguuguauaucuggggagugcaccaccccagcacagauucugaccagauuucccuguacgcucaggccucagggagaguaacuguuagcaccaaaaggagucagcaaacagugaucccuaacauuggcucucggccauggguccgcggcguguccagcagaaucucgauauacuggaccauugugaagcccggggauauccuacucauuaacucuacgggaaaucugaucgcgccuagggguuauuucaaaauccgguccggcaagucaaguauuaugcgcagcaacgcaccaauagggaaguguaauuccgaaugcaucacuccgaacggaucuauucccaaugacaaaccuuuucagaacgucaaucgaaucacauacggcgccuguccaagauauguuaagcagaacacccuuaaacuggcuacugguaugaggaaugugcccgagaagcagacacgggggauauucggagccauugcaggcuuuaucgaaaacggcugggaggggaugguagacggaugguacgguuuccgucaucaaaauagcgagggcaccgggcaggcugccgauuugaaaucaacgcaggcggccaucaaccaaauuaauggaaagcucaaccgccugaucgagaaaaccaaugaaaaguuucaccagauugaaaaggaguucagugaaguggagggcagaauacaggacuuagagaaauaugucgaagauacaaagaucgaccugugguccuacaacgcagagcuccuuguggcucuggaaaaccagcauacuauugauuugaccgacagcgagaugaauaaacuauucgaaaggacacggaagcaacugcgagagaacgccgaggauauggguaaugggugcuuuaaaaucuaucacaagugugacaacgcuugcaucggcucuauucgcaauggaacuuacgaucacgacguuuacagagaugaagcccucaacaauagguuccagauaaagggcguggagcugaaaucaggguauaaggacuggauccuuuggauuaguuuugcaaucagcugcuuccuguugugugucgugcuccugggauuuauuaugugggccugccagaaagguaacauccgguguaauauaugcaucuga

SEQ ID NO: 122183 - RNA, 1701 nt, Artificial Sequence
  derived and/or modified sequence opt3 from hemagglutinin__InfluenzaA__AAY44796
augaagaccaucauugcccugagcuacacacucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacagucuucaaguaccgguggcaucugcgacagcccacaccagauucuagauggggagaauuguacucucaucgacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacacuggaguuuaacaaugaauccuucgacuggaccgggguuacgcagaacggaacuucuagcgcuugcaagcggcgcuccaauaagucauuuuucagucgacugaacuggcucacccauuuaaaauauaaguacccagcacugaaugugacaaugcccaacaaugagaaauuugauaaacuuuauauauggggcguccaccauccuggcacugacagcgaucagaucucuuuguacgcccaggcuuccgggcguauuaccgugucaacaaagagaagccaacagaccguaaucccaaacauuggaaguaggccccggguucgcgacgugucuuccagaaucagcauauacuggacgauugucaagccuggugacauccugcuaauuaacucgacuggcaaucucaucgccccaaggggguauuucaagauccggucuggaaaauccucaauuaugcgcagugaugcgccgauaggcaaguguaacagcgagugcaucacacccaaugguuccauuccuaacgacaaaccauuucagaaugugaaccgaaucaccuacggggcaugucccagauauauaaagcagaauacucugaaacuugccacaggaaugaggaacgugccugaaaagcaaacccggggcauuuucggcgcuaucgccggguuuaucgagaauggaugggaagguauggucgauggcugguacggguuccgucaccagaacucugagggaacgggccaggcagcugaccugaaaagcacccaagccgcgauuaaucagaucaacgguaaguugaaucgccucauugggaagacaaacgagaaauuucaccagauagaaaaggaguucucagaaguugagggcagaauccaggaucuggaaaaauauguggaggacacuaagauugauuuauggaguuacaaugccgagcugcucguagcacuugaaaaccaacauaccaucgaccugacagauuccgagaugaacaaauuguucgaaaggacuaagaagcagcuacgggagaaugcugaagacaugggaaacggcugcuuuaaaaucuaucacaagugugauaaugccugcauugggagcauacgaaacggaaccuacgaccaugacguguaccgcgaugaggcucugaauaacagauuccagaucaaaggugucgagcucaagucuggcuauaaagacuggauucuguggaucucauuugccauuaguugcuuccuucuguguguggcauugcucggguuuaucaugugggccugccagaagggaaauauaagguguaacaucugcauuuga

SEQ ID NO: 122184 - RNA, 1701 nt, Artificial Sequence; identical to SEQ ID NO: 122063
  derived and/or modified sequence opt3 from hemagglutinin__InfluenzaA__AAY44896

SEQ ID NO: 122185 - RNA, 1701 nt, Artificial Sequence
  derived and/or modified sequence opt3 from hemagglutinin__InfluenzaA__AAY44906
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaagcuguauaucuggggcguccaccauccuggcacagacagcgaucagauuucuuuguacgcccaggcuuccgggcguaucacugugucaaccaaaagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccugaaacuugccacuggaaugaggaacgucccugaacggcaaacacguggcauuuucggcgcuaucgccggguuuaucgagaauggaugggaagguaugguugauggcugguacggguuccgccaccagaacucugagggaaccggccaggcagcugaccuuaagagcacgcaagccgcgauuaaucagaucaacgguaaauugaauagacucauugggaagaccaacgagaaguuucaccagauagaaaaagaguucucagaaguggagggcaggauccaggaucuggaaaaguauguagaggacacaaaaauugauuuauggaguuacaaugccgagcugcucguggcacuugaaaaccaacauacuaucgaccugaccgauuccgagaugaacaaguuguucgaacggacuaaaaagcagcuacgagagaaugcugaagacaugggaaacggcugcuuuaagaucuaucacaaaugugauaaugccugcauugggagcauacgcaacggaacauacgaccaugacgucuacagagaugaggcucugaauaacagguuccagaucaaggguguggagcucaaaucuggcuauaaggacuggauucuguggaucucauuugccauuaguugcuuccuucuguguguugcauugcucggguuuaucaugugggccugccagaaaggaaauauacgguguaacaucugcauuuga

SEQ ID NO: 122186 - RNA, 1701 nt, Artificial Sequence
  derived and/or modified sequence opt3 from hemagglutinin__InfluenzaA__AAY46371
augaagaccaucauugcccugagcuacauacucugccuuguguucgcucagaaacugcccggcaacgacaauuccacagcaacuuuguguuuagggcaccaugccgucccuaacggaacgcugguuaagaccaucacaucugaucaaauugaggugacuaaugcgaccgaacugguacagucaaguagcacagguagaaucugcgacuccccacacaggauucucgauggcgagaacuguacccugaucgacgcuuugcugggggauccgcauugcgacggauuucagaauaaagaaugggauuuguucguggagcggucuaaggccuauucgaacuguuaccccuaugacgucccugauuacgcaucacuccgcagccugguggccaguuccggcacucuggaauuuaauaacgagucuuucaauuggacagguguugcucagaacgggaccagcuuugcaugcaaacgacguuccauaaagucauucuuuaguagacucaauugguuacaccaacugaaguauaaauacccagcccuuaacgugacgaugcccaauaacgacaaguucgauaaauuguauaucuggggaguccaucacccuggcacugacagcgaucagaccucucuguacgcucaggccuccggcagggugacaguaucaacuaagcggagccagcaaaccguuauuccaaauaucgggagucgccccugggugagaggagucucuuccaggauuagcaucuacuggacaauagugaaaccuggugacauucuacucaucaacucgaccggcaaccugauugcgccacggggguauuuuaagauccgcucuggaaaguccucaaucaugcgaagugacgcaccgauuggcaaauguaauagcgagugcauaacgcccaacgguuccaucccuaaugggaagccauuccagaacgugaauagaauuacuuacggagccugucccagguaugucaaacagaacacacuuaagcuggcuaccggcaugcggaauguuccugaaaaacagacucguggcaucuuuggggccauagcaggauucauugagaacgguugggaaggcaugguggaugggugguacggauuucgccaccaaaauucugagggcacaggucaggcugccgaccuuaagagcacccaggcggccaucaaccaaaucaaugggaaacucaacagacugauugagaagacgaaugaaaaguuccaucagaucgagaaagaguucaccgaaguagaaggcaggauucaggauuuagagaaguauguggaggacacaaaaauagaucuguggucauacaacgcagaacuccuugucgcucuggagaaucagcacacuaucgacuugaccgauagugaaaugaacaagcuauuugagcggacacgaaaacaacugcgcgaaaacgccgaggacaugggaaauggcugcuucaagauuuaucauaagugugauaacgcuugcaucggguccaucagaaauggaacuuacgaccacgauguguacagggacgaggcccucaacaaucgguuucagauuaaagguguugaacuaaagagcggcuauaaagacuggauacuuuggaucucuuucgcaaccucaugcuuucuguugugugugguccuccugggguucauuaugugggccugccagaagggaaacauccgcuguaauauuugcaucuga

SEQ ID NO: 122187 - RNA, 1701 nt, Artificial Sequence; identical to SEQ ID NO: 122048
  derived and/or modified sequence opt3 from hemagglutinin__InfluenzaA__AAY46381

SEQ ID NO: 122188 - RNA, 1701 nt, Artificial Sequence
  derived and/or modified sequence opt3 from hemagglutinin__InfluenzaA__AAY46391
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcaucauaucgauuuacuggacaaucgugaagccuggggauauucuacucaucaacucuaccggaaaucugaucgcgccaagagguuauuucaaaauuagguccggcaagucaaguauaaugcggagcaacgcaccgaucgggaaguguaauuccgaaugcauuacgcccaacggaucuaucccuaaugacaaaccauuucagaacgucaaucgcauaacuuacggcgccuguccccgauauguuaagcagaacacacuuaaacuggcuaccgguaugagaaaugugccugagaagcagacuagggggauuuucggagccaucgcaggcuuuaucgaaaacggcugggaggggaugguagacggaugguacgguuuccggcaucaaaauagcgagggcacagggcaggcugccgauuugaaaucaacccaggcggccauuaaccaaaucaauggaaagcucaaccgucugauugagaaaacgaaugaaaaguuucaccagauagaaaaggaguucagugaaguggagggccgcauccaggacuuagagaaauaugucgaagauaccaagauugaccugugguccuacaacgcagagcuccuuguggcucuggaaaaccagcauacaaucgauuugacugacagcgagaugaauaaacuauucgaaagaaccaggaagcaacugcgggagaacgccgaggauauggguaaugggugcuuuaaaaucuaucacaagugugacaacgcuugcauuggcucuauacgaaauggaacauacgaucacgacguuuaccgcgaugaagcccucaacaauagauuccagaucaagggcguggagcugaaaucaggguauaaggacuggauucuuuggaucaguuuugcaauuagcugcuuccuguugugugucgugcuccugggauuuaucaugugggccugccagaaagguaacauaagguguaauaucugcauuuga

SEQ ID NO: 122189 - RNA, 1701 nt, Artificial Sequence
  derived and/or modified sequence opt3 from hemagglutinin__InfluenzaA__AAY46426
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacaagaaauuugacaaguuguauauauggggaguccaucacccuagcacugauucugaccagaucucccuguacgcucaggccucaggcagagugaccguaagcacaaaaaggagucaacagacuguuauuccaaacaucggcucucggcccugggugcgcggggucuccagcagaauuucgaucuacuggaccauagugaagccuggagauauucuacucaucaauucuacagguaaccugauugcgccaaggggcuauuucaagauccgguccgggaaaucaaguaucaugcgcagcgacgcaccgauuggaaaguguaauuccgagugcauaacccccaacggcucuaucccuaaugacaaaccauuucagaacgugaaucgaauuacguacggugccugucccagauaugucaagcagaacacucuuaaacuggcuacagggaugaggaauaucccugaaaagcaaacccggggaauauucggcgccauugcaggcuuuaucgagaacgggugggaaggaaugguugaugguugguacggcuuccgucaccagaauagcgaggggacuggacaggcugccgacuugaaaucaacacaagcggccaucaaccagauuaauggcaagcucaaccgccugaucgagaagaccaaugaaaaauuucaucagauugagaaggaguucagugaaguggaagguagaauacaggauuuagagaaauauguagaggacacgaagaucgaucugugguccuacaacgcagaacuccuuguggcucuggagaaccaacacaccauugacuugacagauagcgaaaugaauaaacuauucgagaggacuaagaagcagcugcgggaaaacgccgaggacauggggaauggcugcuuuaaaaucuaucauaagugugauaacgcuugcaucggaucuauucgaaauggcaccuacgaccacgaugucuaccgcgacgaggcccucaacaauagauuccagauaaaagggguggaacugaagucaggauauaaagacuggauccuuuggauuaguuuugcaaucagcugcuuccuguuguguguugugcuccuggguuuuauuaugugggccugccagaagggcaacaucagguguaauauaugcaucuga

SEQ ID NO: 122190 - RNA, 1701 nt, Artificial Sequence
  derived and/or modified sequence opt3 from hemagglutinin__InfluenzaA__AAY47013
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggaguggacccuggguccggggugugucuucccgcauuagcaucuacuggaccauagugaaaccuggcgacauucuacucaucaacucgacagggaaucugauugccccaagaggauauuucaagaucaggucuggcaaguccucaaucaugcggagugacgcgccgauugguaaauguaacagcgaaugcauaacccccaauggguccaucccuaacgauaagccauuucagaaugucaaccgcauuacguacggacccuguccucgauauguuaaacagaauacucuuaagcuggcaacaggcaugagaaacgugccagagaaacaaaccaggggcaucuucggggccauagcuggauuuauugaaaaugguugggagggcaugauggacgggugguacggauuccggcaccagaacucugagggcacuggucaggccgcagaucuaaagagcacacaagcugccaucaaucagaucaacgggaaacucaaucgucugauuaagaagaccaacgaaaaauuucaucagaucgagaaggaguucucagaaguagaaggccgcauucaggacuuagagaaauauguggaggauacgaagauagaccuguggaguuacaaugcggaacuccuugucgcccuggagaaccaacacaccaucgauuugacagacuccgaaaugaacaaacuauucgagagaacuaagaagcagcugagggaaaaugcagaggauaugggaaacggcugcuuuaaaauuuaucauaagugugacaaugcuugcaucgggagcauccggaacggaaccuacgaucacgacguguaccgagacgaggcccucaauaaccgcuuccagauuaaagguguugaacugaagucuggcuauaaagauuggauacuuuggaucucauuugcuauuaguugcuuccuguuguguaucgugcuccugggguuuauuaugugggccugccagaagggaaauaucagauguaacauaugcaucuga

SEQ ID NO: 122191 - RNA, 1701 nt, Artificial Sequence
  derived and/or modified sequence opt3 from hemagglutinin__InfluenzaA__AAY47023
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaauggggauuguucguggagaggucuaaggccuauucgaauuguuaccccuaugaugucccugacuacgugucacuccggagccugguugcaaguuccggcacucuggaauuuaacaaugagucuuucaacuggacagguguggcccaaaaugggaccagcuccgcuugcaaacgccgaucagauaagagcuuuuucagucgucucaacugguuacaccagcugaaguauaaauacccagcacuuaaugucacgaugcccaacaaugagaaguuugacaaauuguauauauggggagugcaucacccuggcacugauucugaccagaucucccuguacgcccaggcuucaggcagaguaaccguuagcacaaagaggagucaacagacugugauuccaaacaucgggucucggcccuggguccgcggaguguccagcagaauuucgaucuacuggaccauagugaaaccuggugauauucuacucaucaacucuacaggcaaucugauugccccaaggggguauuucaagauccgguccggaaagucaaguaucaugcgcagcgacgcgccgauuggcaaauguaacuccgaaugcauaacccccaaugguucuaucccuaacgacaagccauuucagaaugucaaccgaauuacguacggggcaugucccagauauguuaaacagaauacucuuaagcuggccacaggaaugaggaacgugccugagaaacaagcucggggcaucuucggcgccauagcaggguuuauugaaaauggaugggaggguaugauggauggcugguacggguuccgucaccagaacagcgagggaaccggccaggcugccgacuugaagucaacucaagcggccaucaaucagaucaacgguaaacucaaucgccugauugaaaagacaaacgagaaguuucaucagaucgaaaaagaguucagugaaguagaggggaggauucaggauuuagagaaguauguggaagacaccaaaauagaucugugguccuacaaugcagagcuccuugucgcucuggaaaaccaacacacgaucgacuugaccgauagcgagaugaacaagcuauucgaaagaacuaaaaagcagcugcgggagaaugccgaggacaugggcaacggaugcuuuaagauuuaucauaaaugugauaaugcuugcaucggcucuauccgaaacgggacauacgaccacgauguguaccgcgacgaagcccucaauaacagauuccagauuaagggaguugagcugaaaucagguuauaaggacuggauacuuuggaucaguuuugcaauuagcugcuuccuguuguguaucgugcuccugggcuuuauuaugugggccugccagaaagggaauaucagguguaacauaugcaucuga

SEQ ID NO: 122192 - RNA, 1701 nt, Artificial Sequence; identical to SEQ ID NO: 122188
  derived and/or modified sequence opt3 from hemagglutinin__InfluenzaA__AAY47052

SEQ ID NO: 122193 - RNA, 1701 nt, Artificial Sequence
  derived and/or modified sequence opt3 from hemagglutinin__InfluenzaA__AAY47075
augaagaccaucauugcccugagcuacauacucugccuuguguucgcucagaaacugcccggcaacgacaauuccauggcaacauuguguuuagggcaccaugccgucccuaacggaacucugguuaagacgaucaccaaugaucaaauugaggugacaaacgcgacugaacuuguacagucuucaaguaccgguagaaucugcgacagcccacaccagauucucgauggcgagaauuguacacugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacccuggaauuuaacaaugaguccuucaacuggacugguguggcccaaaaugggacaucuagcgcuugcaaacgccgauccaacaagucauuuuucagucgucucaauugguuacaccagcugaagaacaaauauccagcacuuaaugucaccaugcccaacaacgagaaguuugacaaauuguacauauggggagugcaucacccuggcacggauagcgaccagaucucucuguaugcccaggcuuccggcagaguaacuguuucaaccaagaggagccaacagacagugauuccaaauaucgggagucggccccgcgucagagauauuucuuccaggaucagcauauacuggacuauugugaaaccuggagacauccuacucauuaacucgaccgguaaucugaucgccccacggggcuacuucaagauccgcucugggaaguccucaauuaugcgaagugacgcgccgauaggaaaauguaacagcgaaugcaucacacccaauggcuccauuccuaacgauaagccauuucagaaugugaacagaaucaccuauggugcaugucccagguacgucaaacagaauacgcuuaagcuggccacugggaugcggaacguuccugagaaacaaacacguggaauauucggcgcuauugccggcuuuaucgaaaaugggugggagggaaugauggacgguugguauggcuuccgccaccagaacucugaggggaccggacaggcagcugauuugaaaagcacucaagccgcgaucaaucagauuaacggcaaacucaauagacugaucgaaaagacaaacgagaaguuucaucagauugaaaaagaguucucagaaguggaggguaggauacaggacuuagagaaguacguagaagauaccaaaaucgaccuguggaguuauaacgccgagcuccuuguggcacuggaaaaucaacacacgauugauuugaccgacuccgagaugaacaagcuauucgaacggacaaagaagcagcugcgagagaaugcugaggauauggggaacggcugcuuuaagaucuaccauaaaugugacaaugccugcaucggaagcauucgcaacggcacuuaugaucacgacgucuacagagacgaagcucucaauaacagguuccagauaaaggggguggagcugaaaucuggauacaaggauuggauccuuuggauuucauuugccaucaguugcuuccuguuguguauuguucuccuggguuuuaucaugugggcaugccagaaaggcaauauacgguguaacaucugcauuuga

SEQ ID NO: 122194 - RNA, 1701 nt, Artificial Sequence
  derived and/or modified sequence opt3 from hemagglutinin__InfluenzaA__AAY47085
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauauaaguacccagcacugaacgugaccaugcccaauaacgagaaauuugacaaacuuuauaucuggggcguccaccauccuggcacagauagcgaccagauuucuuuguacgcccaggcuuccgggcguaucacugugucaaccaagagaagccaacagacaguaauuccaaacguuggaaguaggccccgggugcgcgaugucucuuccagaaucagcauauacuggaccauugugaagccuggugacauccugcuaauuaauucgacgggcaaccucaucgccccaaggggguauuucaagauccggucuggaaaauccucaauuaugcgcagugacgcgccgauaggcaaguguaauagcgagugcaucacucccaacgguuccauuccuaaugauaaaccauuucagaacgugaaucgaaucacauacggggcaugucccagauaugucaagcagaacacccugaaacuugccacuggaaugaggaauguuccugaaaagcaaacacggggcauauucggcgcuauugccggguuuaucgagaacggaugggaagguaugguggacggcugguacggguuccgucaccaaaauucugagggaaccggccaggcagcugaucugaaaagcacgcaggccgcgaucaaccagauuaaugguaaguugaaccgccucaucgggaagaccaaugagaaauuucaccagauugaaaaggaguucucagaaguagagggcagaauacaggaccuggaaaaauauguggaggauacaaagaucgacuuauggaguuacaacgccgagcugcucgucgcacuugaaaaccaacauacuauugaucugaccgacuccgagaugaauaaauuguucgaaaggacaaagaagcagcuacgggagaacgcugaagauaugggaaauggcugcuuuaaaaucuaucacaagugugacaacgccugcaucgagagcauucgaaaugggacuuacgaucaugacguguaccgcgacgaggcucugaacaauagauuccagauaaaaggaguugaacucaagucugguuauaaagauuggauccuguggauuucauuugccaucaguugcuuccuucuguguguggcauugcucggcuuuauuaugugggccugccagaaggggaacaucagguguaauauaugcaucuga

SEQ ID NO: 122195 - RNA, 1701 nt, Artificial Sequence
  derived and/or modified sequence opt3 from hemagglutinin__InfluenzaA__AAY58320
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacauaucuuccagaauuagcaucuacuggaccauugugaagccuggugacauccugcuaaucaacucgacgggcaaucucauugccccaaggggguauuucaagauacggucuggaaaauccucaaucaugcgcagugaugcgccgauuggcaaguguaacagcgagugcaucacucccaaugguuccauaccuaacgacaaaccauuucagaaugucaaccgaauuacauacggggcaugucccagauaugugaagcagaauacccugaaacuugccacuggaaugaggaacgugccugaaaagcaaacacggggcaucuucggcgcuaucgccggguuuauugagaauggaugggaagguauggucgauggcugguacggguuccgucaccagaacucugagggaaccggccaggcagcugaccugaaaagcacgcaagccgcgaucaaucagauuaacgguaaguugaaucgccucauagggaagaccaacgagaaauuucaccagaucgaaaaggaguucucagaaguugagggcaggauucaggaucuggaaaaauauguggaggacacaaagaucgauuuauggaguuacaaugccgagcugcucguagcacuugaaaaccaacauacuaucgaccugaccgauuccgagaugaacaaauuguucgaaagaacaaagaagcagcuacgggagaaugcugaagacaugggaaacggcugcuuuaaaauuuaucacaagugugauaaugccugcauagggagcauccgaaacggaacuuacgaccaugacguguaccgcgaugaggcucugaauaacagauuccagauuaaaggugucgagcucaagucuggcuauaaagacuggauccuguggauuucauuugccaucaguugcuuccuucuguguguggcauugcucggguuuauaaugugggccugccagaagggaaauaucagguguaacauuugcaucuga

SEQ ID NO: 122196 - RNA, 1701 nt, Artificial Sequence
  derived and/or modified sequence opt3 from hemagglutinin__InfluenzaA__AAY59035
augaagaccaucauugcccugagcuacauacucugccuuguguucgcucagaaacugacagucaacgacaauuccacugcaacguuguguuuaggccaccaugccguucccaacgggacccuggugaagacaaucacuaaugaucacauugagguaaccaacgcgacagaacuugugcaaucuucaaguaccggaagaaucugcgacagcccucaucagauucucgauggugagaauuguacucugaucgacgcucuacugggcgauccacacugcgacggguuucagaacaaagaaugggauuuguucgucgagagguccacagccuauucuaauuguuacccguaugacgugcccgauuacgcaucgcuccggucacugguugccagcaguggaacccuggaauuuaacaaugaguccuucaacuggacgggcguggcucagaaugguacuucuagcgcaugcaagcgccgauccauaaaaucauuuuucagucgucucaacugguuacaucaacugaaguauaaguacccugcccuuaaugucaccaugccaaacaaugagaaauuugacaaguuguauaucuggggagugcaccaccccagcacagauucugaccagauuucccuguacgcucaggccucagggagaguaacuguuagcaccaaaaggagucagcaaacagugaucccuaacauuggcucucggccauggguccgcggcguguccagcagaaucucgauauacuggaccauugugaagcccggggauauccuacucauuaacucuacgggaaaucugaucgcgccuagggguuauuucaaaauccgguccggcaagucaaguauuaugcgcagcaacgcaccaauagggaaguguaauuccgaaugcaucacuccgaacggaucuauucccaaugacaaaccuuuucagaacgucaaucgaaucacauacggcgccuguccaagauauguuaagcagaacacccuuaaacuggcuacugguaugaggaaugugcccgagaagcagacacgggggauauucggagccauugcaggcuuuaucgaaaacggcugggaggggaugguagacggaugguacgguuuccgucaucaaaauagcgagggcaccgggcaggcugccgauuugaaaucaacgcaggcggccaucaaccaaauuaauggaaagcucaaccgccugaucgagaaaaccaaugaaaaguuucaccagauugaaaaggaguucagugaaguggagggcagaauacaggacuuagagaaauaugucgaagauacaaagaucgaccugugguccuacaacgcagagcuccuuguggcucuggaaaaccagcauacuauugauuugaccgacagcgagaugaauaaacuauucgaaaggacacggaagcaacugcgagagaacgccgaggauauggguaaugggugcuuuaaaaucuaucacaagugugacaacgcuugcaucggcucuauucgcaauggaacuuacgaucacgacguuuacagagaugaagcccucaacaauagguuccagauaaagggcguggagcugaaaucaggguauaaggacuggauccuuuggauuaguuuugcaaucagcugcuuccuguugugugucgugcuccugggauuuauuaugugggccugccagaaagguaacauccgguguaauauaugcaucuga

SEQ ID NO: 122197 - RNA, 1701 nt, Artificial Sequence
  derived and/or modified sequence opt3 from hemagglutinin__InfluenzaA__AAY64202
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcgagcggcgcuccaacaagucauuuuucagucgacugaauuggcucacucauuuaaaguauaaauacccagcacugaacgugaccaugcccaauaacgagaaguuugacaaacuuuauaucuggggcguccaccauccuggcacagauagcgaccagauuucuuuguacgcccaggcuuccgggcguaucacugugucaaccaagagaagccaacagacaguaauuccaaacaucggaaguaggccccggguucgcgaugugucuuccagaauaagcauuuacuggaccaucgucaaaccuggugacauucugcuaaucaauucgacgggcaaccucaucgccccaaggggguauuucaagauucggucuggaaaguccucaauaaugcgcagugacgcgccgaucggcaaauguaauagcgaaugcauuacucccaacgguuccaucccuaaugauaagccauuucagaacgugaaucgaauaacauacggggcaugucccagauaugugaaacagaacacccugaagcuggccacuggaaugaggaaugucccugagaaacaaaaccggggcauuuucggcgcuaucgccggguuuaucgaaaauggaugggaggguaugguugacggcugguacggguuccgucaccagaacucugagggaacaggccaggcagcugaucuuaagagcacccaagccgcgauuaaucagaucaacgguaaauugaaucgccucauugggaagacgaacgaaaaguuucaccagauagagaaagaguucucagaaguggaaggcagaauccaggaccuggagaaguauguagaggauaccaaaauugacuuauggaguuacaacgccgaacugcucguggcacuugagaaucaacauacaaucgaucugacugacuccgaaaugaacaaguuguucgagaggaccaaaaagcagcuacgggaaaaugcugaggauaugggaaacggcugcuuuaagaucuaucacaaaugugacaaugccugcauugggagcauacgaaacggaacauacgaucaugacgucuaccgcgacgaggcucugaauaacagauuccagaucaaggguguggaacucaaaucuggcuauaaggauuggauucuguggaucucauuugccauuaguugcuuccuucuguguguugcauugcucggguuuaucaugugggccugccagaaaggaaauauaaggugugacaucugcauuuga

SEQ ID NO: 122198 - RNA, 1701 nt, Artificial Sequence
  derived and/or modified sequence opt3 from hemagglutinin__InfluenzaA__AAY64212
augaagaccaucauugcccugagcuacauacucugccuuguguucgcucagaaaauccccgucaacgacaauuccacagcaacucuguguuugggccaccaugccguuccuaacgggacguuagugaagaccauuacaaaugagcacaucgaaguaacuaacgcgaccgagcuggugcaaucuucaaguacaggaagaauuugcgauagcccacaucagauccuagacggugaaaauuguacccucauagaugcucugcuuggcgacccgcacugcgauggguuucagaacaaagagugggaccuguucgucgaaagguccacugccuauucuaauuguuaccccuaugaugugccugacuacgcaucguugcggucacucguugccagcaguggaacacuggaguuuaacaaugaguccuucaacuggaccggcguggcucagaaugguacgucuagcgcaugcaagcgccgauccaucaaaucauuuuucagucgucugaacuggcuccaucaauuaaaguauaaguacccagcccugaaugucacuaugcccaacaaugaaaaauuugauaaacuuuauauuuggggagugcaccacccuagcaccgacucugaucagaucuccuuguacgcucaggccucagggagaguaacaguuagcacuaagaggagucagcaaaccgugauuccaaacaucggcucucggcccuggguccgcggcguguccagcagaauaucgauuuacuggacaaucgugaagccuggggacauucugcuaaucaacucuaccggaaaucucaucgcgccaagggguuauuucaaaauucgguccggcaagucaaguauaaugcgcagcaacgcacugaucgggaaguguaauuccgagugcauuacgccgaacggaucuauccccaaugauaaaccuuuucagaacgucaaucgaauaacuuacggcgccuguccaagauauguuaagcagaacacacuuaaacuggcuaccgguaugaggaaugugcccgaaaagcagacucgggggauuuucggagccaucgcaggcuuuaucgagaacggcugggaggggaugguagacggaugguacgguuuccgucaucaaaauagcgaaggcacagggcaggcugccgacuugaaaucaacccaggcggccauuaaccaaaucaauggaaagcucaaccgccugauugagaaaacgaaugaaaaguuucaccagauagagaaggaguucagugaaguggagggcagaauccaggauuuagaaaaauaugucgaggacaccaagauugaucugugguccuacaacgcagaacuccuuguggcucuggagaaccagcauacaaucgacuugacugauagcgaaaugaauaaacuauucgagaggacccggaagcaacugcgagagaacgccgaagacauggguaaugggugcuuuaaaaucuaucacaagugugauaacgcuugcauuggcucuauacgcaauggaacauacgaccacgauguuuacagagacgaggcccucaacaauagguuccagaucaagggcguggaacugaaaucaggguauaaggauuggauucuuuggaucaguuuugcaauuagcugcuuccuguugugugucgugcuccugggauuuaucaugugggccugccagaaagguaacauacgguguaauaucugcauuuga

SEQ ID NO: 122199 - RNA, 1701 nt, Artificial Sequence
  derived and/or modified sequence opt3 from hemagglutinin__InfluenzaA__AAY64222
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguaucgguagaauuugcgacagcccacaccagauccucgauggcgagaauuguacacugauagacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacccuggaauuuaacaaugaguccuucaacuggacugguguggcccaaaaugggacaucuagcuccugcaaacgccgaucagacaagagcuuuuucagucgucucaacugguuacaccagcugaaguauaaauacccagcucuuaaugucaccaugcccaacaaugagaaguuugauaaauuguauaucuggggagugcaucacccuggcacggacucugaucagauuucccuguacgcacaggccucaggcagaguaacuguuagcaccaagaggagucaacagacagugaucccaaacauugggucucggcccuggguccgcggaguguccagcagaaucucgauauacuggacuauugugaaaccuggugacauccuacucauuaacucuaccggcaaucugaucgcuccaaggggguauuucaagauccgguccggaaagucaaguauuaugcgcagcgacgccccgauaggcaaauguaacuccgaaugcaucacacccaaugguucuauuccuaacgauaagccauuucagaaugucaaccgaaucaccuacgggcccuguccuagauauguuaaacagaauacgcuuaagcuggcgacuggaaugaggaacgugccagagaaacaaacacggggcauauucggcgcaauugccggguuuaucgaaaauggaugggaggguaugauggacggcugguacggguuccgucaccagaacagcgagggaaccggccaggcugccgauuugaagucaacucaagcagcuaucaaucagauuaacgguaaacucaaucgccugaucgaaaagacaaacgagaaguuucaucagauugaaaaagaguucagugaaguagaggggagaauacaggacuuagagaaguauguggaagauaccaaaaucgaccugugguccuacaaugccgagcuccuugucgcgcuggaaaaccaacacacgauugauuugaccgacagcgagaugaacaagcuauucgagaaaacaaagaagcagcugagggaaaaugccgaggauaugggcaacggaugcuuuaaaaucuaucauaagugugacaaugcaugcaucggcucuauucggaacgggacuuacgaucacgacguguaccgagacgaagcucucaauaaccgcuuccagauaaaaggaguugagcugaagucagguuauaaagauuggauccuuuggauuaguuuugccaucagcugcuuccuguuguguauugugcuccugggcuuuaucaugugggcuugccagaaggggaauauaagauguaacaucugcauuuga

SEQ ID NO: 122200 - RNA, 1701 nt, Artificial Sequence
  derived and/or modified sequence opt3 from hemagglutinin__InfluenzaA__AAY64262
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugaaaagaccaaugagaaguuucaucagaucgaaaaagaguucagugaaguagaggguaggauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugcgggagaacgccgaggacauggggaauggcugcuuuaagauuuaucauaaaugugauaacgcuugcaugggaucuauccgaaauggcaccuacgaccacgauguguaccgcgacgaagcccucaacaauagauuccagaucaaggggguugagcugaaaucaggauauaaggacuggauucuuuggauaaguuuugcaaucagcugcuuccuguugugugugguccuccuggguuuuauuaugugggccugccagaaaggcaacaucagguguaauauuugcaucuga

SEQ ID NO: 122201 - RNA, 1701 nt, Artificial Sequence
  derived and/or modified sequence opt3 from hemagglutinin__InfluenzaA__AAY64272
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauauaaguacccagcacugaacgugaccaugcccaauaacgagaaauuugacaaacuuuauaucuggggcguccaccauccuggcacagauagcgaccagauuucuuuguacgcccaggcuuccgggcguaucacugugucaaccaagagaagccaacagacaguaauuccaaacaucggaaguaggccccggguucgcgaugugucuuccagaauaagcauuuacuggaccaucgucaagccuggugacauucugcuaaucaauucgacgggcaaccucaucgccccaaggggguauuucaagauucggucuggaaaauccucaauaaugcgcagugacgcgccgaucggcaaguguaauagcgagugcauuacucccaacgguuccaucccuaaugauaaaccauuucagaacgugaaucgaauaacauacggggcaugucccagauaugugaagcagaacacccugaaacuugccacuggaaugaggaaugucccugaaaagcaaacacggggcauuuucggcgcuaucgccggguuuaucgagaacggaugggaagguaugguugacggcugguacggguuccgucaccaaaauucugagggaaccggccaggcagcugaucugaaaagcacgcaggccgcgauuaaccagaucaaugguaaguugaaccgccucauugggaagaccaaugagaaauuucaccagauagaaaaggaguucucagaaguggagggcagaauccaggaccuggaaaaauauguagaggauacaaagauugacuuauggaguuacaacgccgagcugcucguggcacuugaaaaccaacauacuaucgaucugaccgacuccgagaugaauaaauuguucgaaaggacaaagaagcagcuacgggagaacgcugaagauaugggaaauggcugcuuuaaaaucuaucacaagugugacaacgccugcauugagagcauacgaaaugggacuuacgaucaugacgucuaccgcgacgaggcucugaacaauagauuccagaucaaaggaguggaacucaagucugguuauaaagauuggauucuguggaucucauuugccauuaguugcuuccuucuguguguugcauugcucggcuuuaucaugugggccugccagaaggggaacauaagguguaauaucugcauuuga

SEQ ID NO: 122202 - RNA, 1701 nt, Artificial Sequence
  derived and/or modified sequence opt3 from hemagglutinin__InfluenzaA__AAY64282
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugaaaagaccaaugagaaguuucaucagaucgaaaaagaguucagugaaguagaggguaggauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugcgggagaacgccgaggacauggggaauggcugcuuuaagauuuaucauaaaugugauaacgcuugcaucggaucuauccgaaauggcaccuacgaccacgauguguaccgcgacgaagcccucaacaauagauuccagauuaaggggguugagcugaaaucaggauauaaggacuggauacuuuggaucaguuuugcaauuagcugcuuccuguugugugugguccuccuggguuuuaucaugugggccugccagaaaggcaacauuagguguaauaucugcauauga

SEQ ID NO: 122203 - RNA, 1701 nt, Artificial Sequence
  derived and/or modified sequence opt3 from hemagglutinin__InfluenzaA__AAY64292
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagacaaaaucugcgauagcccacaccagauucucgacgguggcaauuguacccugaucgaugcucuacugggggacccgcauugcgauggauuucagaacaaggagugggacuuguucguggaaagauccaaagccuauucuaauuguuaccccuaugaugucccugacuacgugucgcucaggucacugguugcaagcaguggcacucuggaguuuaacaaugaauccuucaacuggacagguguggcccaaaaugggaccucuagcgcuugcaagcggcgcuccgauaagucauuuuucagucgacucaacugguuacaccagcugaaaaauaaguauccagcacuuaacgucacgaugcccaauaacgagaaauuugacaaguuguacauauggggagugcaucacccuggcacugauagcgaccagaucucucuguaugcccaggcuuccggccguguaaccguuucaacaaaaagaagccaacagacugugauuccaaacaucgggaguaggccccggguccgcgacauuucuuccagaaucagcauauacuggaccauugugaagccuggagauauccuacucauuaauucgacagguaaccugaucgccccaaggggcuacuucaagauccggucugggaaauccucaauuaugcgcagugacgcgccgauaggaaaguguaauagcgagugcaucacccccaacggcuccauuccuaaugauaaaccauuucagaacgugaaucgaaucacguauggugcaugucccagauacgucaagcagaacacucuuaaacuggccacagggaugaggaauguuccugaaaagcaaacccggggaauauucggcgcuauugccggcuuuaucgagaacgggugggaaggaaugguggacgguugguauggcuuccgucaccaaaauucugaggggacuggacaggcagcugauuugaaaagcacacaggccgcgaucaaccagauuaauggcaagcucaaccgccugaucgagaagaccaaugaaaaauuucaucagauugagaaggaguucucagaaguagaagguagaauacaggacuuagagaaauacguggaggauacgaagaucgaccuguggaguuauaacgccgaacuccuugucgcacuggagaaccaacacaccauugauuugacagacuccgaaaugaauaaacuauucgagaggacuaagaagcagcugcgggaaaacgcugaggauauggggaauggcugcuuuaaaaucuaccauaagugugacaacgccugcaucggaagcauucgaaauggcaccuaugaccacgauguguaccgcgacgaggcucucaacaauagauuccagauaaaagggguugaacugaagucuggauacaaagauuggauccuuuggauuucauuugccaucaguugcuuccuguuguguauugugcuccuggguuuuaucaugugggcaugccagaagggcaacauaagguguaauaucugcauuuga

SEQ ID NO: 122204 - RNA, 1701 nt, Artificial Sequence
  derived and/or modified sequence opt3 from hemagglutinin__InfluenzaA__AAY64302
augaagaccaucauugcccugagcuacauacucugccuuguguucgcucagaaacugcccggcaacgacaauuccacagcaacuuuguguuuagggcaccaugccgucccuaacggaacgcugguuaagaccaucacaucugaucaaauugaggugacuaaugcgaccgaacuuguacagucaaguagcacagguagaaucugcgacuccccacacaggauucucgauggcgagaacuguacccugaucgacgcucuacugggggauccgcauugcgacggauuucagaauaaagaaugggauuuguucguggagcggucuaaggccuauucgaacuguuaccccuaugacgucccugauuacgcaucacuccgcagccugguggccaguuccggcacucuggaauuuaauaacgagucuuucaauuggacagguguugcucagaacgggaccagcuuugcaugcaaacgacguuccauaaagucauucuuuaguagacucaauugguuacaccaacugaaguauaaauacccagcccuuaacgugacgaugcccaauaacgacaaguucgauaaauuguauaucuggggaguccaucacccuagcacugacucugaucagaccucccuguacgcucaggccucaggcagggugacaguaagcacuaagcggagucagcaaaccguuauuccaaauaucggcucucgccccugggugagaggggucuccagcaggauuucgaucuacuggacaauagugaaaccuggagacauucuacucaucaacucuaccgguaaccugauugcgccacggggcuauuuuaagauccgcuccgggaagucaaguaucaugaaaagcgacgcaccgauuggaaaguguaauuccgagugcauaacgcccaacggcucuaucccuaaugauaaaccauuccagaacgugaaucgaauuacuuacggugccugucccagauaugucaagcagaacacacuuaaacuggcuaccgggaugaggaauguuccugaaaagcagacucggggaaucuuuggcgccauagcaggcuucauugagaacgggugggaaggaaugguggacgguugguacggcuuucgucaccaaaauagcgaggggacaggacaggcugccgauuugaaaucaacccaggcggccaucaaccaaaucaauggcaagcucaaccgccugauugagaagacgaaugaaaaauuccaucagaucgagaaggaguucaccgaaguagaagguaggauucaggacuuagagaaauauguggaggauacaaagauagaccuguggaguuacaacgcagaacuccuugucgcucuggagaaucagcacacuaucgauuugaccgacuccgaaaugaacaaacuauuugagagaacacggaagcaacugcgagaaaacgccgaggauauggggaauggcugcuucaagauuuaucauaaaugugacaacgugugcaucggaagcauccgcaauggcacuuacgaucacgacguuuacagagacgaggcucucaacaauagguuucagauuaaggggguggaacugaaaucuggauauaaggauuggauacuuuggaucucauucgccaccaguugcuuucuguugugugucgugcuccuggguuucauuaugugggcaugccagaaaggcaacauccgguguaauauuugcaucuga

SEQ ID NO: 122205 - RNA, 1701 nt, Artificial Sequence; identical to SEQ ID NO: 122199
  derived and/or modified sequence opt3 from hemagglutinin__InfluenzaA__AAY64312

SEQ ID NO: 122206 - RNA, 1701 nt, Artificial Sequence; identical to SEQ ID NO: 122202
  derived and/or modified sequence opt3 from hemagglutinin__InfluenzaA__AAY64322

SEQ ID NO: 122207 - RNA, 1701 nt, Artificial Sequence
  derived and/or modified sequence opt3 from hemagglutinin__InfluenzaA__AAY64332
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccgguggcauuugcgacagcccacaccagauccuagauggggagaauuguacucucauagacgcgcugcuuggagauccgcagugcgacggcuuucaaaacaaaaagugggaucuguucguggaaagauccaaggcuuauucuaauuguuaccccuaugacgucccugauuacgccucguugaggucacucguggcaagcagugguacacuggaguuuaacaaugaauccuucgacuggaccgggguuacgcagaacggaacuucuagcgccugcaagcggcgcuccaauaagucauuuuucagucgacugaacuggcucacccauuuaaaauuuaaguauccagcucugaaugugacaaugcccaacaaugagaaauucgauaaacuuuacaucuggggcguccaccauccuggcacugacagcgaucagauuucuuuguaugcacaggccuccgggcguaucaccgugucaacaaaaagaagccaacagaccguaauuccaaacaucggaaguaggccccggguucgcgacgugucuuccagaauaagcauuuacuggacgaucgucaagccuggugacauucugcuaaucaacucgacuggcaaucucaucgcuccaaggggguacuuuaagauucggucuggaaaauccucaauaaugcgcagugaugccccgaucggcaaguguaacagcgagugcauuacacccaaugguuccaucccuaacgacaaaccauuccagaaugugaaccgaauaaccuauggggcgugucccagauacgugaagcagaauacucugaaacuugcaacaggaaugaggaacgucccugaaaagcaaacccggggcauuuuuggcgccaucgcuggguucaucgagaauggaugggaagguaugguugauggcugguauggguuucgucaccagaacucugagggaacgggccaggccgcagaccugaaaagcacccaagcugccauuaaucagaucaacgguaaguugaaucgccucauugggaagacaaacgagaaauuccaccagauagaaaaggaguucucagaaguggagggcagaauccaggaucuggaaaaauacguagaggacacuaagauugauuuauggaguuauaaugcggagcugcucguggcccuugaaaaccaacauaccaucgaccugacagauuccgagaugaacaaauuguuugaaaggacuaagaagcagcuacgggagaaugcagaagacaugggaaacggcugcuucaaaaucuaccacaagugugauaaugcuugcauugggagcauacgaaacggaaccuaugaccaugacgucuaccgcgaugaggcccugaauaacagauuucagaucaaagguguggagcucaagucuggcuacaaagacuggauucuguggaucucauucgcuauuaguugcuuucuucuguguguugccuugcucggguucaucaugugggcaugccagaagggaaauauaaggugugauaucugcauuuga

SEQ ID NO: 122208 - RNA, 1701 nt, Artificial Sequence
  derived and/or modified sequence opt3 from hemagglutinin__InfluenzaA__AAY64342
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugaaaagaccaaugagaaguuucaucagaucgaaaaagaguucagugaaguagaggguaggauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugcgggagaacgccgaggacauggggaauggcugcuuuaagauuuaucauaaaugugauaacgcuugcaucggaucuauccgaaauggcaccuacgaccacgauguguaccgcgacgaagcccucaacaauagauuccagauuaaggggguugagcugaaaucaggauauaaggacuggauacuuuggaucaguuuugcaacaagcugcuuccuguugugugugguccuccuggguuuuauuaugugggccugccagaaaggcaacaucagguguaauauuugcaucuga

SEQ ID NO: 122209 - RNA, 1701 nt, Artificial Sequence; identical to SEQ ID NO: 122048
  derived and/or modified sequence opt3 from hemagglutinin__InfluenzaA__AAY64352

SEQ ID NO: 122210 - RNA, 1701 nt, Artificial Sequence
  derived and/or modified sequence opt3 from hemagglutinin__InfluenzaA__AAY64362
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucgacuggacagguguuacccagaacgggacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggaguccaccauccuggcacagacagcgaucagauuucuuuguacgcccaggcuuccggccguaucacugugucaaccaagagaagccaacagacaguaauuccaaacaucgggaguaggccccggguucgcgacauaucuuccagaauuagcaucuacuggaccauugugaagccuggagacauccugcuaaucaacucgacggguaaucucauugccccaaggggcuauuucaagauacggucugggaaauccucaaucaugcgcagugaugcgccgauuggaaaguguaacagcgaaugcaucacucccaauggcuccauaccuaacgacaaaccauuucagaaugucaaccgaauuacauacggugcaugucccagauauaucaagcagaauacccugaaacuugccacugggaugaggaacgugccugagaagcaaacacggggaaucuucggcgcuauugccggcuuuaucgaaaaugggugggagggaaugguggaugguugguacggcuuccgucaccagaacucugaggggaccggacaggcagcugaccugaaaagcacgcaagccgcgauuaaucagauaaacggcaaguugaaucgccucaucgguaagaccaacgaaaaauuucaccagauugagaaggaguucucagaagucgaagggagaauccaggaucuggagaaauauguugaggacacaaagaucgauuuauggaguuacaaugccgaacugcucguggcacuugagaaccaacauacuauugaccugaccgauuccgaaaugaacaaauuguucgagaggacaaagaagcagcuacgggaaaaugcugaggacaugggcaacggaugcuuuaaaauauaucacaagugugauaaugccugcaucggcagcauucgaaacgggacuuacgaccaugacguauaccgcgaugaggcucugaauaacagauuccagaucaaaggaguggaacucaagucugguuauaaagacuggauucuguggaucucauuugccauaaguugcuuccuucugugugucgcauugcucggcuuuaucaugugggccugccagaaggggaauauuagguguaacaucugcauuuga

SEQ ID NO: 122211 - RNA, 1701 nt, Artificial Sequence; identical to SEQ ID NO: 122202
  derived and/or modified sequence opt3 from hemagglutinin__InfluenzaA__AAY64382

SEQ ID NO: 122212 - RNA, 1701 nt, Artificial Sequence
  derived and/or modified sequence opt3 from hemagglutinin__InfluenzaA__AAY64392
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauauaaguacccagcacugaacgugaccaugcccaauaacgagaaauuugacaaacuuuauaucuggggcguccaccauccuggcacagauaacgaccagauuagcuuguacgcccaggcuucugggcguaucacuguguccaccaagagaucacaacagacaguaauuccaaauaucggaagcaggccccggguucgcgaugugaguucuagaauauccauuuacuggaccaucgucaagccuggugacauucugcuaaucaacagcacgggcaaucucaucgccccaaggggguauuucaagauucggucgggaaaaucuuccauaaugcgcucagacgcgccgaucggcaaguguaacagugagugcauuacucccaaugguagcaucccuaacgauaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugacggcugguacggguuccgucaccagaacuccgagggaaccggccaggcagcugaucugaaaucuacgcaagccgcgauuaaucagaucaacgguaaguugaaucgccucauugggaagaccaacgagaaauuucaccagauagaaaaggaguucagcgaaguggagggcagaauccaggaccuggaaaaauauguagaggauacaaagauugacuuauggucauacaacgccgagcugcucguggcacuugaaaaucaacauacuaucgaucugaccgacagugagaugaacaaauuguucgaaaggacaaagaagcagcuacgggagaaugcugaagauaugggaaacggcugcuuuaaaaucuaucacaagugugacaaugccugcauuggguccauacgaaacggaacuuacgaucaugacgucuaccgcgacgaggcucugaauaacagauuccagaucaaagguguggagcucaagagcggcuauaaagauuggauucuguggaucucuuuugccauuucaugcuuccuucuguguguugcauugcucggguuuaucaugugggccugccagaagggaaauauaagguguaacaucugcauuuga

SEQ ID NO: 122213 - RNA, 1701 nt, Artificial Sequence; identical to SEQ ID NO: 122204
  derived and/or modified sequence opt3 from hemagglutinin__InfluenzaA__AAY64402

SEQ ID NO: 122214 - RNA, 1701 nt, Artificial Sequence; identical to SEQ ID NO: 122202
  derived and/or modified sequence opt3 from hemagglutinin__InfluenzaA__AAY98037

SEQ ID NO: 122215 - RNA, 1701 nt, Artificial Sequence; identical to SEQ ID NO: 122202
  derived and/or modified sequence opt3 from hemagglutinin__InfluenzaA__AAY98047

SEQ ID NO: 122216 - RNA, 1701 nt, Artificial Sequence; identical to SEQ ID NO: 122063
  derived and/or modified sequence opt3 from hemagglutinin__InfluenzaA__AAY98057

SEQ ID NO: 122217 - RNA, 1701 nt, Artificial Sequence
  derived and/or modified sequence opt3 from hemagglutinin__InfluenzaA__AAY98067
augaagaccaucauugcccugagcuacauacucugccuuguguucgcucaggagcugcccggcaacgacaauuccacagcaacuuuguguuuagggcaccaugccgucccuaacggaacgcugguuaaaaccaucacaaaugaucaaauugaagugacuaacgcgaccgagcuaguacagucuucaaguacagguagaaucugcgacagcccacaccagauucucgauggcgaaaauuguacccugaucgacgcucugcuuggggauccgcauugcgacggauuucagaacaaggagugggauuuguucguggaaagguccaaagccuauucuaauuguuaccccuaugacgucccugauuacgugucgcuccggucacugguugcaagcaguggcacucuggaguuuaacaaugaguccuucaacuggacagguguggcccaaaaugggaccucuagcgcuugcaagcgccgauccgacaaaucauuuuucagucgucucaacugguuacaccagcugaaguauaaguacccagcacuuaaugucacgaugcccaacaaugaaaaauuugauaaguuguauauauggggagugcaucacccuggcacugacagcgaucagaucucucuguacgcccaggcuuccggcagaguaaccguuucaacaaaaaggagccaacagacugugauuccaaacaucgggaguggacccuggguccggggugugucuucccgcauuagcaucuacuggaccauagugaagccuggcgacauucuacucaucaacucgacagggaaucugauugccccaagaggauauuucaaaaucaggucuggcaaguccucaaucaugcggagugacgcgccgauugguaaguguaacagcgagugcauaacccccaauggguccaucccuaacgauaaaccauuucagaaugucaaccgcauuacguacggacccuguccucgauauguuaagcagaauacucuuaaacuggcaacaggcaugagaaacgugccagaaaagcaaaccaggggcaucuucggggccauagcuggauuuauugagaaugguugggagggcaugauggacgggugguacggauuccggcaccagaacucugaaggcacuggucaggccgcagauuugaaaagcacacaagcugccaucaaucagaucaacgggaagcucaaucgucugauugagaaaaccaacgaaaaguuucaucagaucgagaaggaguucucagaaguagagggccgcauucaggacuuagaaaaauauguggaggauacgaagauagaccuguggaguuacaaugcggaacuccuugucgcccuggagaaccaacacaccaucgauuugacagacuccgaaaugaacaaacuauucgagagaacuaagaaacagcugagggagaaugcagaagauaugggaaacggcugcuuuaagauuuaucauaagugugacaaugcuugcaucgggagcauccggaacggaaccuacgaucacgacguguaccgagacgaggcccucaauaaccgcuuccagauuaaagguguugaacugaagucuggcuauaaagauuggauacuuuggaucucauuugcuauuaguugcuuccuguuguguaucgugcuccugggguuuauuaugugggccugccagaagggaaauaucagauguaacauaugcaucuga

SEQ ID NO: 122218 - RNA, 1701 nt, Artificial Sequence
  derived and/or modified sequence opt3 from hemagglutinin__InfluenzaA__AAY98077
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaagugcuagcagaaucugcgacuccccacaccagauucucgauggugaaaauuguacacugaucgacgcccuucugggcgauccgcauugcgacggguuucagaacaaagaaugggauuuguucguggagaggucuaaggcauauucgaauuguuaccccuaugacgucccugauuacgugucacuccggagccugguugccaguuccggaacccuggaauuuaacaaugagucuuucaacuggacuggcguggcucaaaaugguacaagcuccgcaugcaaacgccgaucagacaagagcuuuuucagucgucucaacugguuacaccagcugaaguauaaauacccagcccuuaaugucaccaugcccaacaaugagaaguuugauaaauuguauauauggggagugcaucacccugggacggacucugaucagaucucccuguacgcucaggccucaggcagaguaacuguuagcaccaagaggagucaacagacagugauuccaaacaucggcucucggcccuggguccgcgggguguccagcagaauuucgaucuacuggacuauagugaaaccuggagacauucuacucaucaacucuaccgguaaucugauugcgccaaggggcuauuucaagauccgguccgggaagucaaguaucaugcgcagcgacgcaccgauuggaaaauguaacuccgaaugcauaacacccaauggcucuaucccuaacgauaagccauuucagaaugucaaccgaauuaccuacggugccugucccagauauguuaaacagaauacgcuuaagcuggcuacugggaugaggaacgugccugagaaacaaacacggggaaucuucggcgccauagcaggcuuuauugaaaaugggugggagggaaugauggacgguugguacggcuuccgucaccagaacagcgaggggaccggacaggcugccgauuugaagucaacucaagcggccaucaaucagaucaacggcaaacucaaucgccugauugaaaagacaaacgagaaguuucaucagaucgaaaaagaguucagugaaguagaggguaggauucaggacuuagagaaguauguggaagauaccaaaauagaccugugguccuacaaugcagagcuccuugucgcucuggaaaaccaacacacgaucgauuugaccgacagcgagaugaacaagcuauucgaaagaacuaaaaagcagcugcgggagaaugccgaggauauggggaacggcugcuuuaagauuuaucauaaaugugacaaugcuugcaucggaucuauccgaaacggcacauacgaucacgacguguaccgcgacgaagcccucaauaacagauuccagauuaaggggguugagcugaaaucaggauauaaggauuggauacuuuggaucaguuuugcaauuagcugcuuccuguuguguaucgugcuccuggguuuuauuaugugggccugccagaaaggcaauaucagguguaacauaugcaucuga

SEQ ID NO: 122219 - RNA, 1701 nt, Artificial Sequence
  derived and/or modified sequence opt3 from hemagglutinin__InfluenzaA__AAY98087
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcgagaauuguacccugaucgacgcucuacugggggauccgcauugcgacggauuucagaacaaagaaugggauuuguucguggagcgguccaaggccuauucuaauuguuaccccuaugacgucccugauuacgcaucgcuccgcucacugguggccagcaguggcacucuggaauuuaacaaugaguccuucaacuggacagguguugcucagaaugggaccucuagcgcaugcaaacgacguuccauaaagucauuuuucaguagacucaacugguuacaccaacugaaguauaaauacccagcccuuaaugugacgaugcccaacaaugacaaguuugauaaauuguauaucuggggaguccaucacccuagcacugacucugaucagaccucccuguacgcucaggccucaggcagggugacaguaagcacuaagcggagucagcaaaccguuauuccaaacaucggcucucgccccugggugagaggggucuccagcaggauuucgaucuacuggacaauagugaaaccuggagacauucuacucaucaacucuaccgguaaucugauugcgccacggggcuauuucaagauccgcuccgggaagucaaguaucaugcgaagcgacgcaccgauuggaaaauguaacuccgagugcauaacgcccaauggcucuaucccuaacgauaagccauuucagaaugugaacagaauuacuuacggugccugucccagguaugucaaacagaauacacuuaagcuggcuaccgggaugcggaacguuccugaaaaacagacucguggaaucuucggcgccauagcaggcuuuauugagaaugggugggaaggaaugguggacgguugguacggcuuccgccaccaaaacagcgaggggacaggacaggcugccgauuugaagucaacccaggcggccaucaaucaaaucaacggcaaacucaauagacugauugagaagacgaacgaaaaguuucaucagaucgagaaagaguucagugaaguagaagguaggauucaggacuuagagaaguauguggaggauaccaaaauagaccugugguccuacaaugcagaacuccuugucgcucuggagaaccagcacacaaucgauuugacugacagcgaaaugaacaagcuauucgagcggacccgaaaacaacugcgcgaaaaugccgaggauauggggaacggcugcuuuaagauuuaucauaagugugacaaugcuugcaucggaucuaucagaaacggcacauacgaucacgacguguacagggacgaggcccucaauaaccgguuccagauuaaagggguugaacugaagucaggauauaaagauuggauacuuuggaucaguuuugcaauuagcugcuuccuguugugugugguccuccuggguuuuaucaugugggccugccagaagggcaauauucgcuguaacaucugcauauga

SEQ ID NO: 122220 - RNA, 1701 nt, Artificial Sequence; identical to SEQ ID NO: 122202
  derived and/or modified sequence opt3 from hemagglutinin__InfluenzaA__AAY98097

SEQ ID NO: 122221 - RNA, 1701 nt, Artificial Sequence; identical to SEQ ID NO: 122202
  derived and/or modified sequence opt3 from hemagglutinin__InfluenzaA__AAY98107

SEQ ID NO: 122222 - RNA, 1701 nt, Artificial Sequence
  derived and/or modified sequence opt3 from hemagglutinin__InfluenzaA__AAY98117
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgcggauccaacaagucauuuuucagucgacucaauugguuacaccagcugaaguauaaauacccagcccuuaacgugacgaugcccaauaacgagaaguuugaaaaauuguauauauggggcguccaucacccuagcacugacucugaucagaucucccuguacgcucaggccucaggccgugugaccguaagcacaaagagaagucaacagacuguuauuccaaacaucgggucuaggcccugggugcggggagucuccagccgcauuucgaucuacuggaccauagugaaaccuggugacauucuacucaucaauucuacaggcaaccugauugcgccaagaggguauuucaagaucagguccggaaagucaaguaucaugcggagcgaugcaccgauuggcaaauguaauuccgagugcauaacccccaacgguucuaucccuaaugacaagccauuucagaacgugaaucgcauuacguacggggccuguccccgauaugucaaacagaacacucuuaagcuggcuacaggaaugagaaauguuccugaaaaacaaaccaggggcaucuucggcgccauagcaggguuuauugagaacggaugggaggguaugguggacggcugguacggguuccggcaccagaauagcgaaggaacuggccaggcugccgauuugaagucaacacaagcggccaucaaccagaucaaugguaaacucaaccgucugauugagaagaccaaugaaaaguuucaucagaucgagaaagaguucagugaaguagaggggcgcauucaggacuuagaaaaguauguggaggauacgaaaauagaccugugguccuacaacgcagaacuccuugucgcucuggagaaccaacacaccaucgauuugacagacagcgaaaugaauaagcuauucgagagaacuaaaaagcagcugagggagaacgccgaagauaugggcaauggaugcuuuaagauuuaucauaaaugugacaacgcuugcaucggcucuauccggaaugggaccuacgaucacgacguguaccgagaugaggcccucaacaaucgcuuccagauuaagggaguugaacugaaaucagguuauaaggacuggauacuuuggaucaguuuugcaauuagcugcuuccuguugugugugguccuccugggcuuuaucaugugggccugccagaaagggaacauuagauguaauaucugcauauga

SEQ ID NO: 122223 - RNA, 1701 nt, Artificial Sequence; identical to SEQ ID NO: 122202
  derived and/or modified sequence opt3 from hemagglutinin__InfluenzaA__AAY98147

SEQ ID NO: 122224 - RNA, 1701 nt, Artificial Sequence; identical to SEQ ID NO: 122202
  derived and/or modified sequence opt3 from hemagglutinin__InfluenzaA__AAY98157

SEQ ID NO: 122225 - RNA, 1701 nt, Artificial Sequence
  derived and/or modified sequence opt3 from hemagglutinin__InfluenzaA__AAY98167
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacacaaaggagucagcagacuguuauuccaaacaucggcucucggcccugggugcgcggggucuccagcagaauuucgaucuacuggaccauagugaagccuggagauauucuacucaucaauucuacagguaaccugauugcgccaaggggcuauuucaaaauccgguccgggaagucaaguaucaugcgcagcgacgcaccgauuggaaaguguaauuccgaaugcauaacccccaacggcucuaucccuaaugacaaaccauuucagaacgugaaucgaauuacguacggugccugucccagauaugucaagcaaaacacucuuaaacuggcuacagggaugaggaauguuccugagaagcagacccggggaaucuucggcgccauagcaggcuuuauugaaaacgggugggagggaaugguggaugguugguacggcuuccgucaccagaauagcgaggggacuggacaagcugccgacuugaaaucaacacaggcggccaucaaccagaucaauggcaagcucaaccgccugauugagaaaaccaaugaaaaguuucaucagaucgaaaaggaguucagugaaguagaggguaggauucaagauuuagagaaauauguggaagacacgaagauagaucugugguccuacaacgcagagcuccuugucgcucuggaaaaccagcacaccaucgacuugacagauagcgagaugaauaaacuauucgaaagaacuaagaaacagcugcgggagaacgccgaggacauggggaauggcugcuuuaagauuuaucauaagugugauaacgcuugcaucggaucuauccgaaauggcaccuacgaccacgauguguaccgcgacgaagcccucaacaauagauuccagauuaaagggguugagcugaagucaggauauaaagacuggauacuuuggaucaguuuugcaauuagcugcuuccuguugugugugguccuccuggguuuuaucaugugggccugccaaaagggcaacauuagguguaauaucugcauauga

SEQ ID NO: 122226 - RNA, 1701 nt, Artificial Sequence
  derived and/or modified sequence opt3 from hemagglutinin__InfluenzaA__AAY98177
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugaaaagaccaaugagaaguuucaucagaucgaaaaagaguucagugaaguagaggguaggauucaggauuuagagaaguauguggaagacacgaaaauagaucugugguccuacaacgcagggcuccuugucgcucuggagaaccaacacaccaucgacuugacagauagcgaaaugaauaagcuauucgagagaacuaaaaagcagcugcgggaaaacgccgaggacaugggcaauggaugcuuuaagauuuaucauaaaugugauaacgcuugcaucggcucuauccgaaaugggaccuacgaccacgauguguaccgcgacgaggcccucaacaauagauuccagauuaagggaguugaacugaaaucagguuauaaggacuggauacuuuggaucaguuuugcaauuagcugcuuccuguugugugugguccuccugggcuuuaucaugugggccugccagaaagggaacauuagguguaauaucugcauauga

SEQ ID NO: 122227 - RNA, 1701 nt, Artificial Sequence
  derived and/or modified sequence opt3 from hemagglutinin__InfluenzaA__AAY98195
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugaaaagaccaaugagaaguuucaucagaucgaaaaagaguucagugaaguagaggguaggauucaggauuuagagaaguauguggaagacacgaaaauagaucugugguccuacaacgcagagcuccuugucgcucuggaaaaccaacacaccaucgacuugacagauagcgagaugaauaagcuauucgaaagaacucggaaacagcugcgagagaacgccgaggacauggggaauggcugcuuuaagauuuaucauaagugugauaacgcuugcaucggaucuauccgcaauggcaccuacgaccacgauguguacagagacgaagcccucaacaauagguuccagauuaaagggguugagcugaagucaggauauaaagacuggauacuuuggaucaguuuugcaauuagcugcuuccuguugugugugguccuccuggguuuuaucaugugggccugccagaagggcaacauucgguguaauaucugcauauga

SEQ ID NO: 122228 - RNA, 1701 nt, Artificial Sequence; identical to SEQ ID NO: 122202
  derived and/or modified sequence opt3 from hemagglutinin__InfluenzaA__AAY98207

SEQ ID NO: 122229 - RNA, 1701 nt, Artificial Sequence; identical to SEQ ID NO: 122204
  derived and/or modified sequence opt3 from hemagglutinin__InfluenzaA__AAY98217

SEQ ID NO: 122230 - RNA, 1701 nt, Artificial Sequence; identical to SEQ ID NO: 122202
  derived and/or modified sequence opt3 from hemagglutinin__InfluenzaA__AAY98227

SEQ ID NO: 122231 - RNA, 1701 nt, Artificial Sequence; identical to SEQ ID NO: 122202
  derived and/or modified sequence opt3 from hemagglutinin__InfluenzaA__AAY98237

SEQ ID NO: 122232 - RNA, 1701 nt, Artificial Sequence
  derived and/or modified sequence opt3 from hemagglutinin__InfluenzaA__AAY98247
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauauaucaaacagaacacucuuaagcuggcuacagggaugaggaaugucccugagaaacaaacccggggaauauucggcgccauugcaggcuuuaucgaaaacgggugggagggaaugguugaugguugguacggcuuccgucaccagaauagcgaggggacuggacaggcugccgacuugaagucaacacaagcggccaucaaccagauuaauggcaaacucaaccgccugaucgaaaagaccaaugagaaguuucaucagauugaaaaagaguucagugaaguggaggguagaauacaggauuuagagaaguauguagaagacacgaaaaucgaucugugguccuacaacgcagagcuccuuguggcucuggaaaaccaacacaccauugacuugacagauagcgagaugaauaagcuauucgaaaggacuaaaaagcagcugcgggagaacgccgaggacauggggaauggcugcuuuaagaucuaucauaaaugugauaacgcuugcaucggaucuauucgaaauggcaccuacgaccacgaugucuaccgcgacgaagcccucaacaauagauuccagauaaaggggguggagcugaaaucaggauauaaggacuggauccuuuggauuaguuuugcaaucagcugcuuccuguuguguguugugcuccuggguuuuauuaugugggccugccagaaaggcaacaucagguguaauauaugcaucuga

SEQ ID NO: 122233 - RNA, 1701 nt, Artificial Sequence; identical to SEQ ID NO: 122202
  derived and/or modified sequence opt3 from hemagglutinin__InfluenzaA__AAY98319

SEQ ID NO: 122234 - RNA, 1701 nt, Artificial Sequence
  derived and/or modified sequence opt3 from hemagglutinin__InfluenzaA__AAY98329
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacucguacagucuucaaguacagguagaaucugcgacagcccacaccagauucucgauggcgagaauuguacccugaucgacgcucugcugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggcccuaggcagagugaccguaucaacaaagaggagccaacagacuguuauuccaaacaucggcagucggcccugggugcgcggggucucuuccagaauuagcaucuacuggaccauagugaaaccuggagauauucuccugaucaauucgacagguaaccuuauugcgccaaggggcuauuucaagauccggucugggaaguccucaaucaugcgcagugacgcaccgauuggaaaauguaauagcgaaugcauaacccccaacggcuccaucccuaaugacaagccauuucagaacgugaaucgaauuacguacggugccugucccagauaugucaaacagaacacucugaaguuggcuacagggaugaggaauguuccugagaaacaaacccggggaaucuucggcgccauagcaggcuuuauugaaaacgggugggagggaaugguggaugguugguacggcuuccgucaccucaauucugaggggacuggacaggcugccgaccuuaagagcacacaggcggccaucaaccaaaucaauggcaaauuaaaccgccugauugaaaagaccaaugagaaguuucaucagaucgaaaaagaguucucagaaguagaggguaggauucaggaucucgagaaguauguggaagacacgaaaauagaucuuuggaguuacaacgcagagcuguuggucgcucuagaaaaccagcacaccaucgaccugacagauuccgagaugaauaagcuauucgaaagaacuaaaaagcaacugcgggagaacgccgaggacauggggaauggcugcuuuaagauuuaucauaaaugugauaacgcuugcaucggaagcauccgaaauggcaccuacgaccacgauguguaccgcgacgaagcccuuaacaauagauuccagauuaaggggguugagcugaaaucuggauauaaggacuggauauuguggaucucauuugcaauuaguugcuuccuccuguguguggucuuacuggguuuuaucaugugggccugccagaaaggcaacauuagguguaauaucugcauauga

SEQ ID NO: 122235 - RNA, 1701 nt, Artificial Sequence; identical to SEQ ID NO: 122202
  derived and/or modified sequence opt3 from hemagglutinin__InfluenzaA__AAY98339

SEQ ID NO: 122236 - RNA, 1701 nt, Artificial Sequence; identical to SEQ ID NO: 122202
  derived and/or modified sequence opt3 from hemagglutinin__InfluenzaA__AAY98353

SEQ ID NO: 122237 - RNA, 1701 nt, Artificial Sequence
  derived and/or modified sequence opt3 from hemagglutinin__InfluenzaA__AAY98366
augaagaccaucauugcccugagcuacauacucugccuuguguucgcucagaaacugcccggcaacgacaauuccacagcaacuuuguguuuagggcaccaugccgucccuaacggaacgcugguuaagaccaucacaucugaucaaauugaggugacuaaugcgaccgaacugguacagucaaguagcacagguagaaucugcgacuccccacacaggauucucgauggcgagaacuguacccugaucgacgcuuugcugggggauccgcauugcgacggauuucagaauaaagaaugggauuuguucguggagcggucuaaggccuauucgaacuguuaccccuaugacgucccugauuacgcaucacuccgcagccugguggccaguuccggcacucuggaauuuaauaacgagucuuucaauuggacagguguugcucagaacgggaccagcuuugcaugcaaacgacguuccauaaagucauucuuuaguagacucaauugguuacaccaacugaaguauaaauacccagcccuuaacgugacgaugcccaauaacgacaaguucgauaaauuguauaucuggggaguccaucacccuggcacugacagcgaucagaccucucuguacgcucaggccuccggcagggugacaguaucaacuaagcggagccagcaaaccguuauuccaaauaucgggagucgccccugggugagaggagucucuuccaggauuagcaucuacuggacaauagugaaaccuggugacauucuacucaucaacucgaccggcaaccugauugcgccacggggguauuuuaagauccgcucuggaaaguccucaaucaugcgaagugacgcaccgauuggcaaauguaauagcgagugcauaacgcccaacgguuccaucccuaaugauaagccauuccagaacgugaauagaauuacuuacggggccugucccagguaugucaaacagaacacacuuaagcuggcuaccggaaugcggaauguuccugaaaaacagacucguggcaucuuuggcgccauagcaggguucauugagaacggaugggaagguaugguggacggcugguacggguuucgccaccaaaauucugagggaacaggccaggcugccgaucuuaagagcacccaggcggccaucaaccaaaucaaugguaaacucaacagacugauugagaagacgaaugaaaaguuccaucagaucgagaaagaguucaccgaaguagaagggaggauucaggacuuagagaaguauguggaggauacaaaaauagaccuguggucauacaacgcagaacuccuugucgcucuggagaaucagcacacuaucgauuugaccgacagugaaaugaacaagcuauuugagcggacacgaaaacaacugcgcgaaaacgccgaggauaugggcaauggaugcuucaagauuuaucauaagugugacaacgcuugcaucggcuccaucagaaaugggacuuacgaucacgacguguacagggacgaggcccucaacaaucgguuucagauuaaaggaguugaacuaaagagcgguuauaaagauuggauacuuuggaucucuuucgcaaccucaugcuuucuguugugugugguccuccugggcuucauuaugugggccugccagaaggggaacauccgcuguaauauuugcaucuga

SEQ ID NO: 122238 - RNA, 1701 nt, Artificial Sequence
  derived and/or modified sequence opt3 from hemagglutinin__InfluenzaA__AAY98376
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccauaaagucauuuuucagucgucucaacugguuacaccagcugaaguauaaauacccagcccuuaaugugacgaugcccaacaaugacaaguuugauaaauuguauaucuggggaguccaucacccuagcacugacucugaucagaccucccuguacgcucaggccucaggcagagugacaguaagcacuaagaggagucaacagaccguuauuccaaacaucggcucucggcccugggugcgcggggucuccagcagaauuucgaucuacuggacaauagugaaaccuggagacauucuacucaucaacucuaccgguaaucugauugcgccaaggggcuauuucaagauccgguccgggaagucaaguaucaugcgcagcgacgcaccgauuggaaaauguaacuccgagugcauaacgcccaauggcucuaucccuaacgauaagccauuucagaaugugaaccgaauuacuuacggugccugucccagauaugucaaacagaauacacuuaagcuggcuaccgggaugaggaacguuccugaaaaacaaacucggggaaucuucggcgccauagcaggcuuuauugagaaugggugggaaggaaugguggacgguugguacggcuuccgucaccagaacagcgaggggacaggacaggcugccgauuugaagucaacccaagcggccaucaaucagaucaacggcaaacucaaucgccugauugagaagacgaacgaaaaguuucaucagaucgagaaagaguucagugaaguagaagguaggauucaggacuuagagaaguauguggaggauaccaaaauagaccugugguccuacaaugcagaacuccuugucgcucuggagaaccaacacacaaucgauuugacugacagcgaaaugaacaagcuauucgagagaacccggaaacagcugcgagaaaaugccgaggauauggggaacggcugcuuuaagauuuaucauaagugugacaaugcuugcaucggaucuauccgcaacggcacauacgaucacgacguguacagagacgaggcccucaauaacagguuccagauuaaagggguugaacugaagucaggauauaaagauuggauacuuuggaucaguuuugcaauuagcugcuuccuguugugugugguccuccuggguuuuaucaugugggccugccagaagggcaauauucgguguaacaucugcauauga

SEQ ID NO: 122239 - RNA, 1701 nt, Artificial Sequence
  derived and/or modified sequence opt3 from hemagglutinin__InfluenzaA__AAY98386
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgggaauuguacccugaucgacgcucuacugggagauccgcauugcgacggcuuucagaacaaagagugggauuuguucguggaaagguccaaggucuauucuaauuguuaccccuaugacgugccugauuacgccucgcuccggucacugguugcaagcagugguacucuggaguuuaacaaugaauccuucaacuggacagggguggcccaaaauggaaccucuagcgcuugcaaacgccgauccauaaagucauuuuucagucgucucaacugguuacaccagcugaaguauaaauacccagcacuuaaugucacgaugcccaacaaugagaaguuugacaaauuguauaucuggggcgugcaucacccuagcacugauucugaccagauuucccuguacgcccaggcuucaggcagaguaaccguuagcacaaagaggagucaacagacugugaucccaaacauugggucucggcccuggguccgcggaguguccagcagaaucucgauauacuggaccauugugaaaccuggugauauccuacucauuaacucuacaggcaaucugaucgccccaaggggguauuucaagauccgguccggaaagucaaguauuaugcgcagcgacgcgccgauaggcaaauguaacuccgagugcaucacccccaaugguucuauuccuaacgacaagccauuucagaaugucaaccgaaucacguacggggcaugucccagauauguuaaacagaauacucuuaagcuggccacaggaaugaggaacgugccugaaaaacaaacccggggcauauucggcgcuauugccggguuuaucgagaauggaugggaagguaugguagauggcugguacggguuccgucaccagaacagcgagggaacuggccaggcagcugacuugaagucaacacaagccgcgaucaaucagauuaacgguaaacucaaucgccugaucgagaagaccaacgaaaaguuucaucagauugagaaagaguucagugaaguggaagggagaauacaggauuuagagaaguaugucgaggacacgaaaaucgaucugugguccuacaaugccgaacuccuuguggcacuggagaaccaacacaccauugacuugacagauagcgaaaugaacaagcuauucgagaggacuaaaaagcagcugcgggaaaaugcugaggacaugggcaacggaugcuuuaagaucuaucauaaaugugauaaugccugcaucggcucuauucgaaacgggaccuacgaccacgauguuuaccgcgacgaggcucucaauaacagauuccagauaaagggaguggaacugaaaucagguuauaaggacuggauccuuuggauuaguuuugccaucagcugcuuccuguugugugucgugcuccugggcuuuauuaugugggcaugccagaaagggaauaucagguguaacauaugcaucuga

SEQ ID NO: 122240 - RNA, 1701 nt, Artificial Sequence; identical to SEQ ID NO: 122202
  derived and/or modified sequence opt3 from hemagglutinin__InfluenzaA__AAY98396

SEQ ID NO: 122241 - RNA, 1701 nt, Artificial Sequence; identical to SEQ ID NO: 122202
  derived and/or modified sequence opt3 from hemagglutinin__InfluenzaA__AAY98406

SEQ ID NO: 122242 - RNA, 1701 nt, Artificial Sequence
  derived and/or modified sequence opt3 from hemagglutinin__InfluenzaA__AAZ32946
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccgaggccuauucuaauuguuaccccuaugacgucccugauuacgcaucguugaggucacucaucgccagcagugguacucuggaauuuacaaacgaguccuucaauuggaccggggugacgcagaacggaacuucuagcgcuugcaaacggcgcuccaauaagucauuuuucagucgacugaacuggcucacccauuuaaaguauaaauacccagcacugaauguuacaaugcccaacaaugagaaguuugacaaacuuuauauuuggggcgugcaccauccuggcacugauagcgaccagaucucuuuguacgcccaggcuuccgggcguauuaccgucucaacaaagagaagccaacagaccgugaucccaaacauaggaaguaggccccggguacgcgauguuucuuccagaauuagcaucuacuggacgauugugaaaccuggugacauccugcuaaucaacucgacuggcaaucucauugccccaaggggguauuucaagauacggucuggaaaguccucaaucaugcgcagugacgcgccgauuggcaaauguaacagcgaaugcaucacacccaaugguuccauaccuaacgauaagccauuucagaauauuaaccgaaucaccuacgggacuugucccagauaugucaaacagaauacacugaagcuggcaaccggaaugaggaacgugccugagaaacaaacgcggggcaucuucggcgccauugcuggguuuaucgaaaauggaugggaggguaugguggacggcugguacggguuccgucaccagaacucugagggaaccggccaggccgcagaucuuaagagcacacaagcugccauuaaucagauaaacgguaaauugaaucgccucaucgggaagacuaacgaaaaguuucaccagauugagaaagaguucucagaagucgaaggcagaauccaggaccuggagaaguauguugaggauaccaaaaucgacuuauggaguuacaaugcggaacugcucguggcccuugagaaccaacauacaauugaucugacugacuccgaaaugaacaaguuguucgagaggaccaaaaagcagcuacgggaaaaugcagaggauaugggaaacggcugcuuuaagauauaucacaaaugugacaaugcuugcaucgggagcauucgaaacggaacauacgaucaugacguauaccgcgacgaggcccugaauaacagauuccagaucaaggguguggaacucaaaucuggcuauaaggauuggauucuguggaucucauuugcuauaaguugcuuccuucugugugucguguugcucggguuuaucaugugggccugccagaaaggaaauauuagguguaacaucugcauuuga

SEQ ID NO: 122243 - RNA, 1701 nt, Artificial Sequence
  derived and/or modified sequence opt3 from hemagglutinin__InfluenzaA__AAZ32949
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccgaggccuauucuaauuguuaccccuaugacgucccugauuacgcaucguugaggucacucaucgccagcagugguacucuggaauuuacaaacgaguccuucaauuggaccggggugacgcagaacggaacuucuagcgcuugcaaacggcgcuccaauaagucauuuuucagucgacugaacuggcucacccauuuaaaguauaaauacccagcacugaauguuacaaugcccaacaaugagaaguuugacaaacuuuauauuuggggcgugcaccauccuggcacugauagcgaccagaucucuuuguacgcccaggcuuccgggcguauuaccgucucaacaaagagaagccaacagaccgugaucccaaacauaggaaguaggccccggguacgcgauauuucuuccagaaucagcauuuacuggacgaucguuaaaccuggugacauccugcuaauuaacucgacuggcaaucucauagccccaaggggguauuucaagauccggucuggaaaguccucaauuaugcgcagugacgcgccgaucggcaaauguaacagcgaaugcauaacacccaaugguuccauuccuaacgauaagccauuucagaauaucaaccgaaucaccuacggggcaugucccagauaugugaaacagaauacucugaagcuggccacaggaaugaggaacgucccugagaaacaaacccggggcauuuucggcgcuaucgccggguuuauugaaaauggaugggaggguaugguggacggcugguacggguuccgucaccagaacucugagggaacgggccaggcagcugaucuuaagagcacccaagccgcgauaaaucagaucaacgguaaauugaaucgccucauugggaagacaaacgaaaaguuucaccagaucgagaaagaguucucagaaguggaaggcagaauccaggaccuggagaaguaugucgaggauacuaaaauugacuuauggaguuacaaugccgaacugcucguugcacuugagaaccaacauaccauagaucugacagacuccgaaaugaacaaguuguucgagaggacuaaaaagcagcuacgggaaaaugcugaggauaugggaaacggcugcuuuaagaucuaucacaaaugugacaaugccugcauugggagcauccgaaacggaaccuacgaucaugacguguaccgcgacgaggcucugaauaacagauuccagauuaaggguguagaacucaaaucuggcuauaaggauuggauccuguggauaucauuugccaucaguugcuuccuucuguguguggucuugcucggguuuauuaugugggcaugccagaaaggaaauaucagguguaacauuugcaucuga

SEQ ID NO: 122244 - RNA, 1701 nt, Artificial Sequence
  derived and/or modified sequence opt3 from hemagglutinin__InfluenzaA__AAZ32950
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccgaggccuauucuaauuguuaccccuaugacgucccugauuacgcaucguugaggucacucaucgccagcagugguacucuggaauuuacaaacgaguccuucaauuggaccggggugacgcagaacggaacuucuagcgcuugcaaacggcgcuccaauaagucauuuuucagucgacugaacuggcucacccauuuaaaguauaaauacccagcacugaauguuacaaugcccaacaaugagaaguuugacaaacuuuauauuuggggcgugcaccauccuggcacugauagcgaccagaucucuuuguacgcccaggcuuccgggcguauuaccgucucaacaaagagaagccaacagaccgugaucccaaacauaggaaguaggccccggguacgcgauguuucuuccagaauuagcaucuacuggacgauugugaaaccuggugacauccugcuaaucaacucgacuggcaaucucauugccccaaggggguauuucaagauacggucuggaaaguccucaaucaugcgcagugacgcgccgauuggcaaauguaacagcgaaugcaucacacccaaugguuccauaccuaacgauaagccauuucagaauauuaaccgaaucaccuacggggcaugucccagauaugucaaacagaauacucugaagcuggccacaggaaugaggaacgugccugagaaacaaacccggggcaucuucggcgcuauugccggguuuaucgaaaauggaugggaggguaugguggacggcugguacggguuccgucaccagaacucugagggaacgggccaggcagcugaucuuaagagcacccaagccgcgauuaaucagauaaacgguaaauugaaucgccucaucgggaagacaaacgaaaaguuucaccagauugagaaagaguucucagaagucgaaggcagaauccaggaccuggagaaguauguugaggauacuaaaaucgacuuauggaguuacaaugccgaacugcucguggcacuugagaaccaacauaccauugaucugacagacuccgaaaugaacaaguuguucgagaggacuaaagaacagcuacgggagaaugcugaggauaugggaaacggcugcuuuaagauauaucacaagugugacaaugccugcaucgggagcauucgaaacggaaccuacgaucaugacguauaccgcgacgaagcucugaauaacagauuccagaucaaagguguggagcucaagucuggcuauaaagauuggauucuguggaucucauuugccauaaguugcuuccuucugugugucguguugcucggguuuaucaugugggcaugccagaagggaaauauuagguguaacaucugcauuuga

SEQ ID NO: 122245 - RNA, 1701 nt, Artificial Sequence
  derived and/or modified sequence opt3 from hemagglutinin__InfluenzaA__AAZ32951
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcauugcgacggcuuucagaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccaaaauggaacgucuagcgcuugcaagcggcgcuccaacaagucauuuuucagucgacugaauuggcuccaccaguuaaaauauaaguacccagcacugaacguggccaugcccaauaacgagaaauuugacaaacuuuauaucuggggcguccaucacccuggcacugauagcgaccagauuucuuuguacgcucaggccuccgggcguaucaccgugucaacaaagagaagccaacagacuguaauuccaaacaucggaaguaggccccggguucgcgauauaucuuccagaauuagcaucuacuggaccauugugaagccuggugacauccugcuaaucaauucgacaggcaaccucauugcgccaaggggguauuucaagauacggucuggaaaauccucaaucaugcgcagugacgcaccgauuggcaaguguaauagcgagugcaucacccccaacgguuccauaccuaaugauaaaccauuucagaacgucaaucgaauuacguacggggccugucccagauaugugaagcagaacacucugaaacuugcuacaggaaugaggaaugugccugaaaagcaaacccggggcaucuucggcgccaucgcaggguuuauugagaacggaugggaagguauggucgacggcugguacggguuccgucaccaaaauucugagggaacuggccaggcugccgaucugaaaagcacacaggcggccaucaaccagauuaaugguaaguugaaccgccucauagggaagaccaaugagaaauuucaucagaucgaaaaggaguucucagaaguugagggcaggauucaggaccuggaaaaauauguggaggauacgaagaucgacuuauggaguuacaacgcagagcugcucguagcucuugaaaaccaacacaccaucgaucugacagacuccgagaugaauaaauuguucgaaagaacuaagaagcagcuacgggagaacgccgaagauaugggaaauggcugcuuuaaaauuuaucauaagugugacaacgcuugcauagggagcauccgaaauggaaccuacgaucacgacguguaccgcgacgaggcccugaacaauagauuccagauuaaaggugucgagcucaagucuggcuauaaagauuggauccuguggauuucauuugcaaucaguugcuuccuucuguguguggccuugcucggguuuauaaugugggcuugccagaagggaaacaucagguguaauauuugcaucuga

SEQ ID NO: 122246 - RNA, 1701 nt, Artificial Sequence
  derived and/or modified sequence opt3 from hemagglutinin__InfluenzaA__AAZ32952
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcauugcgacggcuuucagaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccaaaauggaacgucuagcgcuugcaagcggcgcuccaacaagucauuuuucagucgacugaauuggcuccaccaguuaaaauauaaguacccagcacugaacguggccaugcccaauaacgagaaauuugacaagcuguauaucuggggcguccaucacccuggcacugauagcgaccagauuucuuuguacgcucaggccuccgggcguaucaccgugucaacaaaaagaagccaacagacuguaauuccaaacaucggaaguaggccccggguucgcgaugugucuuccagaauaagcauuuacuggaccaucgucaagccuggugacauucugcuaaucaauucgacaggcaaccucaucgcgccaaggggguauuucaagauucggucuggaaaauccucaauaaugcgcagugacgcaccgaucggcaaguguaauagcgagugcauuacccccaacgguuccaucccuaaugauaaaccauuucagaacgugaauaagauaacguacggggccuguccccgauaugugaaacagaacacucugaaacuugcuacaggaaugagaaaugucccugaaaagcaaaccaggggcauuuucggcgccaucgcaggguuuaucgagaacggaugggaagguaugguugacggcugguacggguuccggcaccaaaauucugagggaacuggccaggcugccgaucuuaagagcacacaggcggccauuaaccagaucaaugguaaguugaaccgucucauugggaaaaccaaugagaaguuucaucagauagaaaaagaguucucagaaguggagggccgcauccaggaccuggaaaaguauguagaggauacgaaaauugacuuauggaguuacaacgcagagcugcucguggcucuugaaaaccaacacaccaucgaucugacagacuccgagaugaauaaguuguucgaaagaacuaagaaacagcuaagggagaacgccgaagauaugggaaauggcugcuuuaagaucuaucauaaaugugacaacgcuugcauugggagcauacggaauggaaccuacgaucacgacgucuaccgagacgaggcccugaacaaucgcuuccagaucaaggguguggagcucaaaucuggcuauaaggauuggauucuguggaucucauuugcaauuaguugcuuccuucuguguguugccuugcucggguuuaucaugugggcuugccagaagggaaacauaagauguaauaucugcauuuga

SEQ ID NO: 122247 - RNA, 1701 nt, Artificial Sequence
  derived and/or modified sequence opt3 from hemagglutinin__InfluenzaA__AAZ32953
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcauugcgacggcuuucagaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccaaaauggaacgucuagcgcuugcaagcggcgcuccaacaagucauuuuucagucgacugaauuggcuccaccaguuaaaauauaaguacccagcacugaacguggccaugcccaauaacgagaaauuugacaaacuuuauaucuggggcguccaucacccuggcacugauagcgaccagauuucuuuguacgcucaggccuccgggcguaucaccgugucaacaaagagaagccaacagacuguaauuccaaacaucggaaguaggccccggguucgcgaugugucuuccagaauaagcauuuacuggaccaucgucaagccuggugacauucugcuaaucaauucgacaggcaaccucaucgcgccaaggggguauuucaagauucggucuggaaaauccucaauaaugcgcagugacgcaccgaucggcaaguguaauagcgagugcauuacccccaacgguuccaucccuaaugauaaaccauuucagaacgugaaucgaauaacguacggggccugucccagauaugugaagcagaacacucugaaacuugcuacaggaaugaggaaugucccugaaaagcaaacccggggcauuuucggcgccaucgcaggguuuaucgagaacggaugggaagguaugguugacggcugguacggguuccgucaccaaaauucugagggaacuggccaggcugccgaucugaaaagcacacaggcggccauuaaccagaucaaugguaaguugaaccgccucauugggaagaccaaugagaaauuucaucagauagaaaaggaguucucagaaguggagggcagaauccaggaccuggaaaaauauguagaggauacgaagauugacuuauggaguuacaacgcagagcugcucguggcucuugaaaaccaacacaccaucgaucugacagacuccgagaugaauaaauuguucgaaaggacuaagaagcagcuacgggagaacgccgaagauaugggaaauggcugcuuuaaaaucuaucauaagugugacaacgcuugcauugggagcauacgaaauggaaccuacgaucacgacgucuaccgcgacgaggcccugaacaauagauuccagaucaaagguguggagcucaagucuggcuauaaagauuggauucuguggaucucauuugcaauuaguugcuuccuucuguguguugccuugcucggguuuaucaugugggcuugccagaagggaaacauaagguguaauaucugcauuuga

SEQ ID NO: 122248 - RNA, 1701 nt, Artificial Sequence
  derived and/or modified sequence opt3 from hemagglutinin__InfluenzaA__AAZ38462
augaagaccaucauugcccugagcuacauacucugccuuguguucgcucagaaacugcccggcaacgacaauuccacagcaacuuuguguuuagggcaccaugccgucccuaacggaacgcugguuaagaccaucacaucugaucaaauugaggugacuaaugcgaccgaauugguacagucaaguagcacagguagaaucugcgacuccccacacaggauucucgauggcgagaacuguacccugaucgacgcccuucugggggauccgcauugcgacggauuucagaauaaagaaugggauuuguucguggagcggucuaaggcuuauucgaacuguuaccccuaugacgucccugauuacgcaucacuccgcagccugguggccaguuccggcacucuggaauuuaauaacgagucuuucaauuggacagguguugcucagaacgggaccagcuuugcaugcaaacgacguuccauaaagucauucuuuaguagacucaauugguuacaccaacugaaguauaaauacccagcccuuaacgugacgaugcccaauaacgacaaguucgauaaauuguauaucuggggaguccauuacccuggcacugacagcgaucagaccucucuguacgcucaggccuccggcagggugacaguaucaacuaagcggagccagcaaaccguuauuccaaauaucgggagucgccccugggugagaggagucucuuccaggauuagcaucuauuggacaauagugaaaccuggugacauucuacucaucaacucgaccggcaaccugauugcgccacggggguacuuuaagauccgcucuggaaaguccucaaucaugcgaagugacgcaccgauuggcaaauguaauagcgagugcauaacgcccaacgguuccaucccuaaugggaagccauuccagaacgugaauagaauuacuuauggagccugucccagguacgucaaacagaacacacuuaagcuggcuaccggcaugcggaauguuccugaaaaacagacucguggcaucuuuggggccauagcaggauucauugagaacgguugggaaggcaugguggaugggugguauggauuucgccaccaaaauucugagggcacaggucaggcugccgaccuaaagagcacccaggcggccaucaaccaaaucaaugggaaacucaacagacugauugagaagacgaaugaaaaguuccaccagaucgagaaagaguucaccgaaguagaaggcaggauucaggauuuagagaaguacguggaggacacaaaaauagaucuguggucauauaacgcagaacuccuugucgcucuggagaaucagcauacuaucgacuugaccgauagugaaaugaacaagcuauuugagcggacacgacgccaacugagagaaaacgccgaggacaugggaaauggcugcuucaaaauuuaccacaagugugauaacgcuugcaucggguccaucaggaauggaacuuacgaccaugauguguaucgggacgaggcccucaacaaucgcuuucagauuaaggguguugaacugaaaagcggcuacaaggacuggauacuuuggaucucuuucgcaaccucaugcuuucuguugugugugguccuccugggguucauuaugugggccugccagaaaggaaacaucagauguaauauuugcaucuga

SEQ ID NO: 122249 - RNA, 1701 nt, Artificial Sequence
  derived and/or modified sequence opt3 from hemagglutinin__InfluenzaA__AAZ38473
augaagaccaucauugcccugagcuacauacucugccuuguguucgcucagaaacugcccggcaacgacaauuccacagcaacuuuguguuuagggcaccaugccgucccuaacggaacgcugguuaagaccaucacaucugaucaaauugaggugacuaaugcgaccgaacuuguacagucaaguagcacagguagaaucugcgacuccccacacaggauucucgauggcgagaacuguacccugaucgacgcucuacugggggauccgcauugcgacggauuucagaauaaagaaugggauuuguucguggagcggucuaaggccuauucgaacuguuaccccuaugacgucccugauuacgcaucacuccgcagccugguggccaguuccggcacucuggaauuuaauaacgagucuuucaauuggacagguguugcucagaacgggaccagcuuuacgugcaaacgacguuccauaaagucauucuuuaguagacucaauugguuacaccaacugaaguauaaauacccagcacuuaacgugacuaugcccaauaacgacaaguucgauaaauuguauaucuggggaguccaucacccuagcaccgacucugaucagacaucccuguacgcccaggcuucaggcagggugacuguaagcaccaagcggagucagcaaacaguuauuccaaauaucggcucucgccccugggugagaggggucuccagcaggauuucgaucuacuggaccauagugaaaccuggagacauucuacucaucaacucuacggguaaccugauugccccacggggcuauuuuaagauccgcuccgggaagucaaguaucaugaaaagcgacgcgccgauuggaaaguguaauuccgagugcauaacucccaacggcucuaucccuaaugauaaaccauuccagaacgugaaucgaauuacauacggugcaugucccagauaugucaagcagaacacccuuaaacuggccacugggaugaggaauguuccugaaaagcagacacggggaaucuuuggcgcuauagccggcuucauugagaacgggugggaaggaaugguggacgguugguacggcuuucgucaccaaaauagcgaggggaccggacaggcagcugauuugaaaucaacgcaggccgcgaucaaccaaaucaauggcaagcucaaccgccugauugagaagaccaaugaaaaauuccaucagaucgagaaggaguucacagaaguagaagguaggauucaggacuuagagaaauauguggaggauacuaagauagaccuguggaguuacaacgccgaacuccuugucgcacuggagaaucagcacaccaucgauuugacagacuccgaaaugaacaaacuauuugagagaacucggaagcaacugcgagaaaacgcugaggauauggggaauggcugcuucaagauuuaucauaaaugugacaacgugugcaucggaagcauccgcaauggcaccuacgaucacgacguuuacagagacgaggcccucaacaauagguuucagauuaaggggguggaacugaaaucuggauauaaggauuggauacuuuggaucucauucgcuacaaguugcuuucuguugugugucgugcuccuggguuucauuaugugggccugccagaaaggcaacauccgguguaauauuugcaucuga

SEQ ID NO: 122250 - RNA, 1701 nt, Artificial Sequence; identical to SEQ ID NO: 122202
  derived and/or modified sequence opt3 from hemagglutinin__InfluenzaA__AAZ38484

SEQ ID NO: 122251 - RNA, 1701 nt, Artificial Sequence
  derived and/or modified sequence opt3 from hemagglutinin__InfluenzaA__AAZ38495
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcaaaauuucgaucuacuggaccauagugaagccuggagauauucuacucaucaauucuacagguaaccugauugcgccaagaggcuauuucaagaucagguccgggaaaucaaguaucaugcggagcgacgcaccgauuggaaaguguaauuccgaaugcauaacccccaacggcucuaucccuaaugacaaaccauuucagaacgugaaucgcauuacguacggugccuguccccgauaugucaagcagaacacucuuaaacuggcuacagggaugagaaauguuccugagaagcaaaccaggggaaucuucggcgccauagcaggcuuuauugaaaacgggugggagggaaugguggaugguugguacggcuuccggcaccagaauagcgaggggacuggacaggcugccgacuugaaaucaacacaagcggccaucaaccagaucaauggcaagcucaaccgucugauugaaaagaccaaugagaaauuucaucagaucgaaaaggaguucagugaaguagagggucgcauucaggauuuagagaaauauguggaagacacgaagauagaucugugguccuacaacgcagagcuccuugucgcucuggaaaaccaacacaccaucgacuugacagauagcgagaugaauaaacuauucgaaagaacuaagaagcagcugagggagaacgccgaggacauggggaauggcugcuuuaaaauuuaucauaagugugauaacgcuugcaucggaucuauccggaauggcaccuacgaccacgauguguaccgagacgaagcccucaacaaucgcuuccagauuaaagggguugagcugaagucaggauauaaagacuggauacuuuggaucaguuuugcaauuagcugcuuccuguugugugugguccuccuggguuuuaucaugugggccugccagaagggcaacauuagauguaauaucugcauauga

SEQ ID NO: 122252 - RNA, 1701 nt, Artificial Sequence
  derived and/or modified sequence opt3 from hemagglutinin__InfluenzaA__AAZ38517
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucgacggcugguauggguuucgucaccagaauagcgagggaaucggccaggcagcugaucugaaguccacccaagccgcgauuaaccagauaaaugguaaauugaaccgccucaucgggaagacgaacgagaaguuccaccagauugaaaaagaguucucugaaguugagggcagaauccaggaccuggaaaaguacguggaggauaccaaaaucgacuuauggagcuauaaugccgagcugcucguagcacuugaaaaccaacauacaauugaucugacugacucagagaugaauaaguuguuugaaaggaccaaaaagcagcuacgggagaacgcugaagauaugggaaauggcugcuucaagauauaccacaaauguaacaaugccugcaucgggaguauucgaaacggaacauaugaccaugauguguaccgcgacgaggcucugaauaacagauuucagaucaagggugucgagcucaaauccggcuacaaggacuggauucuguggaucagcuucgccauaucuugcuuucuucugugugugguuuugcucggguucaucaugugggcaugccagaaaggaaauauuagguguaacaucugcauuuga

SEQ ID NO: 122253 - RNA, 1701 nt, Artificial Sequence
  derived and/or modified sequence opt3 from hemagglutinin__InfluenzaA__AAZ38539
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccaaaauuagcaucuacuggaccauagugaagccuggugacauuuuccuaaucaacucgacaggcaaucucauugccccaagaggguauuuuaagaucaggucuggaaaauccucaaucaugcggagugacgcgccgauuggcaaguguaacagcgaaugcauaacccccaaugguuccaucccuaacgauaaaccauuccagaaugucaaccgcauuacguacgggcccuguccucgauauguuaagcagaauacucugaaacuugcaacaggaaugagaaacgugccagagaagcaaaccaggggcaucuuuggcgccauagcuggguucauugaaaauggaugggaggguaugauggacggcugguacggguuucggcaccagaacucugagggaacuggccaggccgcagaucugaaaagcacacaagcugccaucaaucagaucaacgguaaguugaaucgucucauugaaaagaccaacgagaaauuccaucagaucgaaaaggaguucucagaaguagaggggcgcauucaggaccuggagaaauauguggaagauacgaagauagacuuauggaguuacaaugcggagcugcucgucgcccuugaaaaccaacacaccaucgaucugacagacuccgagaugaacaaauuguuugaaagaacuaagaagcagcuaagggagaaugcagaggauaugggcaacggaugcuucaaaauuuaucauaagugugacaaugcuugcaucggcagcauccggaacgggaccuacgaucacgacguguaccgagacgaagcccugaauaaccgcuuucagauuaaaggaguugagcucaagucugguuauaaagauuggauacuguggaucucauucgcuauuaguugcuuucuucuguguaucguguugcucggcuucauuaugugggccugccagaaggggaauaucagauguaacauaugcaucuga

SEQ ID NO: 122254 - RNA, 1701 nt, Artificial Sequence; identical to SEQ ID NO: 122202
  derived and/or modified sequence opt3 from hemagglutinin__InfluenzaA__AAZ38561

SEQ ID NO: 122255 - RNA, 1701 nt, Artificial Sequence
  derived and/or modified sequence opt3 from hemagglutinin__InfluenzaA__AAZ38583
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacagguggcaucugcgacagcccacaccagauacuggauggggagaauuguacccuaaucgacgcucuccugggagauccgcagugcgacggcuuucaaaacaaaaagugggaucuuuucguggaaagauccaaagccuauucuaauuguuaccccuaugacgucccugauuacgcaucgcugaggucauugguggccagcagugguacucucgaguuuaacaaugaauccuucaacuggacagggguuacccagaauggaacgucuagcgcuugcaagcggcgcuccaacaauucauuuuucagucgacugaacuggcugacucaucucaaguuuaaauauccagcauuaaaugugaccaugcccaacaacgagaaguucgacaaacuguacauuuggggcguccaccauccuggcacaaauaacgaucagaucagccuuuaugcccaggcuucugggcguauuacuguguccaccaagagaucacaacagacaguaaucccaaauauaggaagcaggccccggguucgcgacauuccuaguagaaucucuauuuacuggaccaucgugaaaccaggugauaucuugcugauuaacuccacgggcaaucuaauagccccgaggggguacuuuaagauccggagcggaaagucgucuauuaugcgcuccgacgcgcccaucggcaaauguaacucagagugcauaacuccuaaugguaguauuccaaacgacaagcccuuccagaaugucaaccgaaucacauauggggcauguccuagauacgugaaacagaauacccucaagcuggccacuggaaugaggaacgugccagaaaaacaaacacggggcaucuuuggcgcuauugccggguucaucgagaauggaugggaagguauggucgauggcugguauggguuucgucaccagaacagcgagggaauuggccaggcagcugaccuuaaguccacccaagccgcgauaaaucagaucaacgguaaacugaaccgcuugauugggaagacgaaugagaaguuccaccagaucgaaaaagaguucucugaaguugagggcagaauccaggaucucgaaaaguacguggaggacaccaaaauugaucuguggagcuauaacgccgaguuacugguagcacucgaaaaucaacauacaauagaccuuacugauucagagaugaacaagcuguuugaaaggaccaaaaagcaguugcgggagaaugcugaagacaugggaaacggcugcuucaagaucuaccacaaaugugauaaugccugcauugggaguauccgaaacggaacauaugaccaugauguguaccgcgacgaggcucuaaauaacagauuucagauuaagggugucgagcugaaauccggcuacaaggacuggaucauauggaucagcuucgccauuucuugcuuucuccuguguguggcacuucugggguucaucaugugggccugccagaaaggaaauauuagguguaacaucugcauauga

SEQ ID NO: 122256 - RNA, 1701 nt, Artificial Sequence
  derived and/or modified sequence opt3 from hemagglutinin__InfluenzaA__AAZ38594
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacucaaguuucuuuagccgacugaauuggcucacucauuuaaaguuuaaauauccagcacugaacgugaccaugcccaauaacgagaaguucgacaaacuuuacaucuggggcguccaccauccuggcacagauaacgaccagauuucuuuguaugcccaggcuuccgggcguaucacugugucaaccaagagaagccaacagacaguaauuccaaauaucggaaguaggccccggguucgcgauauaccuucuagaauuuccaucuacuggaccauugugaaaccaggugacauccugcuaaucaacagcacgggcaaucucauugccccgaggggguacuuuaagauacggucgggaaagucuuccaucaugcgcucagacgcgcccauuggcaaauguaacagugagugcaucacuccuaaugguagcauaccaaacgauaagcccuuccagaaugucaaccgaauuacauauggggcauguccuagauacgugaaacagaauacccugaaacuugccacuggaaugaggaacgugccagaaaagcaaacacggggcaucuuuggcgcuaucgccggguucauugagaauggaugggaagguauggucgacggcugguauggguuucgucaccagaacuccgagggaaucggccaggcagcugaucugaagucuacccaagccgcgauuaaucagauaaacgguaaauugaaucgccucaucgggaagacgaacgagaaguuccaccagauugaaaaagaguucagcgaaguugagggcagaauccaggaccuggaaaaguacguggaggauaccaaaaucgacuuauggucauauaacgccgagcugcucguagcacuugaaaaucaacauacaauugaucugacugacagugagaugaacaaguuguuugaaaggaccaaaaagcagcuacgggagaaugcugaagauaugggaaacggcugcuucaagauauaccacaaaugugacaaugccugcaucggguccauucgaaacggaacauaugaucaugacguguaccgcgacgaggcucugaauaacagauuucagaucaagggugucgagcucaaaagcggcuacaaggauuggauucuguggaucucuuucgccauaucaugcuuucuucuguguguggcauugcucggguucaucaugugggccugccagaaaggaaauauuagguguaacaucugcauuuga

SEQ ID NO: 122257 - RNA, 1701 nt, Artificial Sequence
  derived and/or modified sequence opt3 from hemagglutinin__InfluenzaA__AAZ38605
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccgguggcauuugcgacagcccacaccagauccuagauggggagaauuguacucucauagacgcgcugcuuggagauccgcagugcgacggcuuucaaaacaaaaagugggaucuguucguggaaagauccaaggcuuauucuaauuguuaccccuaugacgucccugauuacgccucguugaggucacucguggcaagcagugguacacuggaguuuaacaaugaauccuucaacuggaccgggguuacgcagaauggaacuucuagcgccugcaagcggcgcuccaacaauucauuuuucagucgacugaacuggcucacccauuuaaaguuuaaauauccagcucugaaugugacaaugcccaacaacgagaaguucgacaaacuuuacaucuggggcguccaccauccuggcacugauaaugaccagauuagcuuguaugcacaggccucugggcguaucaccguguccacaaagagaucacaacagaccguaauuccaagcaucggaaguaggccccggauacgcgauguuccuucuagaauuuccaucuacuggacgauugugaaaccaggugacauccugcuaaucaacagcacuggcaaucucauugcuccgaggggguacuuuaagauacggucgggaaagucuuccaucaugcgcucagacgcccccauuggcaaauguaacagugagugcaucacaccuaaugguagcauaccaaacgauaagcccuuccagaaugucaaccgaauuaccuauggggcguguccuagauacgugaaacagaauacucugaaacuugcaacaggaaugaggaacgugccagaaaaacaaacccggggcaucuuuggcgccaucgcuggguucauugagaauggaugggaagguauggucgacggcugguauggguuucgucaccagaacuccgagggaacgggccaggccgcagaucugaagucuacccaagcugccaucaaucagauuaacgguaaauugaaucgccucauagggaagacaaacgagaaguuccaccagaucgaaaaagaguucagcgaaguugagggcaggauucaggaccuggaaaaguacguggaggauacuaaaaucgacuuauggucauauaacgcggagcugcucguagcccuugaaaaucaacauaccaucgaucugacagacagugagaugaacaaguuguuugaaagaacuaaaaagcagcuacgggagaaugcagaagauaugggaaacggcugcuucaagauuuaccacaaaugugacaaugcuugcauaggguccauccgaaacggaaccuaugaucaugacguguaccgcgacgaggcccugaauaacagauuucagauuaagggugucgagcucaaaagcggcuacaaggauuggauccuguggauuucuuucgcuaucucaugcuuucuucuguguguggccuugcucggguucauaaugugggcaugccagaaaggaaauaucagguguaacauuugcaucuga

SEQ ID NO: 122258 - RNA, 1698 nt, Artificial Sequence
  derived and/or modified sequence opt3 from hemagglutinin__InfluenzaA__AAZ38627
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuauuacuggacacuucuggaaccaggcgauacuauuaucuuugaggccaacgggaauuugauugcuccgugguaugccuucgcgcucucucgcggauuuggcuccgguaucauaaccagcaacgcacccauggacgagugugaugccaagugccagacaccucaaggggcuauuaauucgucucugccauuccagaacguucaccccgugaccaucggagaauguccuaaguacguaagauccgccaaauuaaggauggcaacgggccugcggaauauuccaucaauccagagucgcggccucuuuggggcuaucgccggauucauugaggguggcuggacugggaugguggacggaugguauggcuaccaucaccagaacgaacaagguagcggguacgcggccgaucagaaguccacacagaaugcaauaaacggcaucaccaauaaagucaacucugugauugagaagaugaauacucaguuuacagcuguuggaaaagaguucaacaagcuagaacgaagaauggagaaucugaacaaaaagguggacgauggcuucuuggacaucuggaccuauaacgccgaacuacugguccuccuggagaaugaaaggacgcuugacuuucacgauagcaacgugaagaaucuguacgagaaaguaaagucacaauugaaaaacaaugcuaaggaaauagggaacggaugcuucgaguuuuaucauaaauguaauaacgagugcauggaaaguguuaagaaugguaccuacgacuaucccaaguacuccgaggaaagcaaacucaaccgggagaagauugauggcgugaaacuggagucuaugggggucuaucagaucuuagccaucuacucaacaguggcaaguagccugguccuacucgugucccugggagccauuucuuucuggaugugcucgaauggcagccuucagugucguaucugcauuuga

SEQ ID NO: 122259 - RNA, 1701 nt, Artificial Sequence
  derived and/or modified sequence opt3 from hemagglutinin__InfluenzaA__AAZ38638
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucgacggcugguauggguuucgucaccagaauagcgagggaaucggccaggcagcugaucugaaguccacccaagccgcgauuaaccagauaaaugguaaauugaaccgccucaucgggaagacgaacgagaaguuccaccagauugaaaaagaguucucugaaguugagggcagaauccaggaccuggaaaaguacguggaggauaccaaaaucgacuuauggagcuauaaugccgagcugcucguagcacuugaaaaccaacauacaauugaucugacugacucagagaugaauaaguuguuugaaaggaccaaaaagcagcuacgggagaacgcugaagauaugggaaauggcugcuucaagauauaccacaaaugugacaacgccugcaucgggaguauucgaaauggaacauaugaucaugacguguaccgcgacgaggcucugaacaauagauuucagaucaagggugucgagcucaaauccggcuacaaggauuggauucuguggaucagcuucgccauaucuugcuuucuucuguguguggcauugcucggguucaucaugugggccugccagaaaggaaacauuagguguaauaucugcauuuga

SEQ ID NO: 122260 - RNA, 1701 nt, Artificial Sequence; identical to SEQ ID NO: 122259
  derived and/or modified sequence opt3 from hemagglutinin__InfluenzaA__AAZ38650

SEQ ID NO: 122261 - RNA, 1701 nt, Artificial Sequence
  derived and/or modified sequence opt3 from hemagglutinin__InfluenzaA__AAZ43370
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuauagaacgguccaaagccuucucuaauuguuaucccuacgacgugccugauuaugcaucguugcgcucacucgucgccagcaguggcacucuggaguuuaucaacgaagguuucaauuggacaggggugacccaguccggaggcucuuacgcuugcaagcgaggcagcguuaaguccuuuuucucacgucugaacuggcucuaugagagugaguacaaauauccagcauuaaaugugacgaugcccaacaaugggaaguuugacaaacuguacauuuggggaguccaccauccuagcacugaaaaggagcaaaccaaccuuuacgugagagccucugguaggguaacaguuuccacuaaacggucacagcagaccgugaucccaaauauuggcagccgccccugggucagaggguugaguucuaggaucuccauauauuggacaauugugaagccuggagauauccugcuaauuaacagcaccggcaaccucaucgcuccacgggguuacuucaagauccgcacggggaaaucgucuauuaugcgauccgacgccccgauaggaacuuguucaagugaaugcaucacacccaauggcagcauuccuaacgauaagccauuucagaaugugaacaaaaucaccuauggcgcgugucccagauacgucaagcaaaauacucugaaacuugcaacagggaugaggaacguuccugagaagcagacccggggaauauucggugccauugcuggcuuuaucgagaaugggugggaaggaaugguggacggcugguaugguuuccgucaccagaacuccgaggggacgggccaggccgcagaccugaaaucuacccaagcugccaucgaucagauuaauggaaaguugaaccgccucaucgaaaagacaaaugagaaauuccaccagauugaaaaggaguuuagcgagguagaaggcagaauacaagaccuggagaaauacguggaagauacuaagaucgacuuauggucauauaacgcggagcugcucgucgcccuugaaaaucagcauaccauugaucugacagacagugagaugaacaaauuguucgagaagacuaggaagcagcuacgggaaaaugcagaggauauggggaacggaugcuuuaaaaucuaccacaagugugacaacgcuugcaucgguuccauucgaaauggcaccuacgaucaugacguguaucgcgaugaagcccugaacaauagauuccagauaaaagggguugagcucaagagcggauacaaagacuggauccuguggauuucuuuugcuaucucaugcuuccuucuguguguggucuugcucggcuuuauuaugugggccugccaaaaggguaacaucagguguaauauaugcaucuga

SEQ ID NO: 122262 - RNA, 1701 nt, Artificial Sequence; identical to SEQ ID NO: 122134
  derived and/or modified sequence opt3 from hemagglutinin__InfluenzaA__AAZ43394

SEQ ID NO: 122263 - RNA, 1701 nt, Artificial Sequence
  derived and/or modified sequence opt3 from hemagglutinin__InfluenzaA__AAZ43405
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauuguacagguaaccugauugcgccaaggggcuauuucaagauccggucugggaaguccucaaucaugcgcagugacgcaagcauuggaaaaugcaauuccgaauguauaaccccgaacggcucuauccccaaugacaagccuuuucagaacgugaaucgaauuacguacggugccugcccaagauaugucaaacagaacacucuuaagcuggcuacagggaugaggaauguucccgagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugaaaagaccaaugagaaguuucaucagaucgaaaaagaguucagugaaguagaggguaggauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugcgggagaacgccgaggacauggggaauggcuguuuuaagauuuaucauaaaugcgauaacgcuugcaucggaucuauccgaaauggcaccuacgaccacgauguguaccgcgacgaagcccucaacaauagauuccagauuaaggggguugagcugaaaucaggauauaaggacuggauacuuuggaucaguuuugcaauuagcuguuuccuguugugcgugguccuccuggguuuuaucaugugggccugucagaaaggcaacauuaggugcaauaucuguauauga

SEQ ID NO: 122264 - RNA, 1701 nt, Artificial Sequence; identical to SEQ ID NO: 122063
  derived and/or modified sequence opt3 from hemagglutinin__InfluenzaA__AAZ74352

SEQ ID NO: 122265 - RNA, 1701 nt, Artificial Sequence; identical to SEQ ID NO: 122219
  derived and/or modified sequence opt3 from hemagglutinin__InfluenzaA__AAZ74363

SEQ ID NO: 122266 - RNA, 1698 nt, Artificial Sequence
  derived and/or modified sequence opt3 from hemagglutinin__InfluenzaA__AAZ74374
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuaccggaauuuacuguggcuuaccggcaaaaacggauuguaucccaaucugagcaagucuuacgccaacaauaaagaaaaggaggugcuaauacucuggggcguacaucacccuccaaacaucggggaucagcgcacgcuguaccacacugaaaacgcuuauguuuccguggucucaagccauuacggacgacguuucacccccgagauuacaaaaagaccuaaggugagggaccaggaaggucggaucaauuauuacuggacucuucuggagccaggcgauaccauuaucuuugaggcaaacgggaauuugauagccccgugguaugcuuucgcccucagucgcggauuuggcucugguauuaucacauccaacgcgcccauggacgaaugugaugcaaagugccagaccccucaaggggccauuaauagcucgcugccauuccagaacgugcaccccgucacgaucggagaguguccuaaauacguuagaucugcuaaguuaaggauggugacuggccugcggaauaucccauccauucagucacgcggccucuuuggggccauagcaggauucaucgaagguggcuggacagggaugguagacggaugguauggcuaccaucaccagaacgagcaagguaguggguacgcugccgaucagaaaagcacccagaaugcgauuaacggcaucacuaauaaggugaacuccgucauagaaaagaugaauacacaguuuaccgccgugggaaaagaguucaacaaacuugagcgaagaauggaaaaucugaacaagaagguugacgauggcuucuuggacguguggacguauaacgcagagcuacugguccuccuggaaaaugagaggacccuugacuuucacgauucuaacgugaaaaaucuguacgaaaagguaaaaagccaauugaagaacaaugcuaaagagauugggaacggaugcuucgaguuuuaucauaaguguaauaacgaaugcauggagucaguuaagaaugguacauacgacuaucccaaauacagugaagaguccaagcucaaccgggagaaaaucgauggcgugaagcuggacagcaugggggucuaucagaucuuagccauuuacucuacuguggcuucaagucugguccuacucgugagccugggagccaucuccuucuggaugugcucuaauggcucgcuucagugucguauuugcauauga

SEQ ID NO: 122267 - RNA, 1701 nt, Artificial Sequence
  derived and/or modified sequence opt3 from hemagglutinin__InfluenzaA__AAZ74397
augaacaccaucauugcccugagcuacauacucugccuuguguucgcucagaagcugcccggcaaugacaacuccacagcaacuuuguguuuagggcaccaugccgucccuaauggaacgcugguuaaaaccaucacaucugaucaaauugaggugacuaacgcgaccgaacuuguacagucaaguagcacagguagaaucugcgacuccccacacaggauucucgauggcgagaauuguacccugaucgacgcucuacugggggauccguugugcgacggauuucagaacaaggaaugggaucucuucguggagcggucuaaagccuauucgaauuguuaccccuaugacgucccugauuacgcaucacugcgcagccugguggccaguuccggcacucucgaauuuaacaaugagucuuucaacuggacagguguugcucagaaugggaccagcuuugcaugcaagcgacguuccauaaaaucauucuuuaguagauuaaacuggcugcaucaacuuaaguauaaguacccagccuugaaugugacgaugcccaacaaugacaaauucgauaagcuguauaucuggggaguccaccauccuggcacugacagcgaucagaccucucuauacgcucaggccuccggcagggugacaguaucaacuaaacggagccagcaaaccguuauuccaaacaucgggagucgccccugggugagaggagucucuuccaggauuagcaucuacuggacaauagugaagccuggugacauucuccugaucaacucgaccggcaaucuuauugcgccacggggguauuuuaaaauccgcucuggaaaguccucaaucaugcgaagugacgcaccgauuggcaaguguaacagcgagugcauaacgcccaaugguuccaucccuaacgggaaaccauuccagaaugugaacagaauuacuuacggagccugucccagguaugucaagcagaauacacugaaauuggcuaccggcaugcggaacguuccugaaaagcagacucguggcaucuuuggggccauagcaggauucauugagaaugguugggaaggcaugguggaugggugguacggauuucgccaccaaaacucugagggcacaggucaggcugccgaccucaaaagcacccaggcggccaucaaucaaaucaacgggaagcugaauagauuaauugagaaaacgaacgaaaaguuccaccagaucgagaaggaguucaccgaaguagaaggcaggauucaggaucuggagaaauauguggaggacacaaagauagaucucuggucauacaaugcagaacuucuggucgcuuuggagaaccagcauacuaucgaccuaaccgauagugaaaugaacaaacuguuugagcggacacgaaagcaacuccgcgaaaaugccgaggacaugggaaacggcugcuucaaaauuuaucacaagugugauaaugcuugcaucggguccaucagaaacggaacuuacgaccaugauguguacagggacgaggcccugaauaaccgguuucagauuaaggguguugaacuuaaaagcggcuauaaggacuggauacuguggaucucuuucgcaaccucaugcuuuuugcucugugugguccuguuaggguucauuaugugggccugccagaaaggaaauauccgcuguaacauuugcaucuga

SEQ ID NO: 122268 - RNA, 1701 nt, Artificial Sequence
  derived and/or modified sequence opt3 from hemagglutinin__InfluenzaA__AAZ74408
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugaaaagaccaaugagaaguuucaucagaucgaaaaagaguucagugaaguagaggguaggauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugcgggagaacgccgaggacauggggaauggcugcuuuaagauuuaucauaaaugugauaacgcuugcaucggaucuauccgaaauggcaccuacaaccacgacguguaccgcgaugaagcccucaauaacagauuccagauuaaggggguugagcugaaaucaggauauaaggacuggauacuuuggaucaguuuugcaauuagcugcuuccuguugugugugguccuccuggguuuuaucaugugggccugccagaaaggcaauauuagguguaacaucugcauauga

SEQ ID NO: 122269 - RNA, 1701 nt, Artificial Sequence; identical to SEQ ID NO: 122202
  derived and/or modified sequence opt3 from hemagglutinin__InfluenzaA__AAZ74430

SEQ ID NO: 122270 - RNA, 1701 nt, Artificial Sequence; identical to SEQ ID NO: 122259
  derived and/or modified sequence opt3 from hemagglutinin__InfluenzaA__AAZ74441

SEQ ID NO: 122271 - RNA, 1701 nt, Artificial Sequence
  derived and/or modified sequence opt3 from hemagglutinin__InfluenzaA__AAZ74452
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucaucgaaagauccaaagccuauucuaauuguuaccccuaugacgugccugauuacgcaucguugaggucacucgucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagauaaugaccagaucagcuuguaugcccaggcuucugggcguauuacugucuccaccaagagaucacaacagacagugaucccaaacauaggaagcaggccccggguacgcgauauuccuaguagaaucucuauuuacuggaccaucguuaaaccaggugacauccugcuaauuaauuccacgggcaaccucauagccccgaggggguacuuuaagauccggagcggaaagucgucuauuaugcgcuccgacgcgcccaucggcaaauguaauucagagugcauaacuccuaacgguaguauuccaaaugauaagcccuuccagaacgugaaucgaaucacauauggggcauguccuagauacgucaaacagaacacccugaaacuugccacuggaaugaggaaugugccagaaaagcaaacacggggcaucuuuggcgcuauugccggguucaucgagaacggaugggaagguaugguggacggcugguauggguuucgucaccagaauagcgagggaauuggccaggcagcugaucugaaguccacccaagccgcgauaaaccagaucaaugguaaauugaaccgccucauugggaagacgaacgagaaguuccaccagaucgaaaaagaguucucugaagucgagggcagaauccaggaccuggaaaaguacguugaggauaccaaaauugacuuauggagcuauaaugccgagcugcucguggcacuugaaaaccaacauacaauagaucugacugacucagagaugaauaaguuguuugaaaggaccaaaaagcagcuacgggagaacgcugaagauaugggaaauggcugcuucaagaucuaccacaaaugugacaacgccugcauugggaguauccgaaauggaacauaugaucaugacguauaccgcgacgaggcucugaacaauagauuucagauuaaggguguggagcucaaauccggcuacaaggauuggauccuguggaucagcuucgccauaucuugcuuucuucugugugucgcauugcucggguucauuaugugggccugccagaaaggaaacaucagguguaauauuugcaucuga

SEQ ID NO: 122272 - RNA, 1701 nt, Artificial Sequence
  derived and/or modified sequence opt3 from hemagglutinin__InfluenzaA__AAZ74463
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucgacggcugguauggguuucgucaccagaauagcgagggaaucggccaggcagcugaucugaaguccacccaagccgcgauuaaccagauaaaugguaaauugaaccgccucaucgggaagacgaacgagaaguuccaccagauugaaaaagaguucucugaaguugagggcagaauccaggaccuggaaaaguacguggaggauaccaaaaucgacuuauggagcuauaaugccgagcugcucguagcacuugaaaaccaacauacaauugaucugacugacucagagaugaauaaguuguuugaaaggaccaaaaagcagcuacgggagaacgcugaagauaugggaaauggcugcuucaagauauaccacaaaugugacaacgccugcaucgggaguauucgaaauggaacauaugaucaugacguguaccgcgacgaggcucugaacaauagauuucagaucaagggugucgagcucaaauccggcuacaaggauuggauucuguggaucagcuucgccauaucuugcuuucuucugugugugguuuugcucggguucaucaugugggcaugccagaaaggaaacauuagguguaauaucugcauuuga

SEQ ID NO: 122273 - RNA, 1701 nt, Artificial Sequence
  derived and/or modified sequence opt3 from hemagglutinin__InfluenzaA__AAZ74474
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagaagcgguccaacaauucauuuuucagucgccugaacuggcucacucauuuaaaauuuaaguauccagcacugaaugugaccaugcccaacaacgagaaauucgacaaacuuuacaucuggggcguccaccauccuggcacagauaaugaccagauuagcuuguaugcccaggcuucugggcgaaucacuguguccaccaagcguucacaacagacaguaauuccaaacaucggaagcagacccaggguucgggauauaccuagucgcauuucuaucuacuggaccauugugaagccaggugacauccugcuaaucaauuccacgggcaaccucauugccccgagaggguacuuuaagauaaggagcggaaaaucgucuaucaugcgguccgacgcgcccauuggcaaguguaauucagagugcaucacuccuaacgguaguauaccaaaugauaaacccuuccagaacgucaaucgcauuacauauggggcauguccucgauacgugaagcagaacacccugaaacuugccacuggaaugagaaaugugccagaaaagcaaacaaggggcaucuuuggcgcuaucgccggguucauugagaacggaugggaagguauggucgacggcugguauggguuucggcaccagaauagcgagggaaucggccaggcagcugaucugaaauccacccaagccgcgauuaaccagauaaaugguaaguugaaccgucucaucgggaagacgaacgagaaauuccaccagauugaaaaggaguucucugaaguugagggccgcauccaggaccuggaaaaauacguggaggauaccaagaucgacuuauggagcuauaaugccgagcugcucguagcacuugaaaaccaacauacaauugaucugacugacucagagaugaauaaauuguuugaaagaaccaagaagcagcuaagggagaacgcugaagauaugggaaauggcugcuucaaaauauaccacaagugugacaacgccugcaucgggaguauucggaauggaacauaugaucaugacguguaccgagacgaggcucugaacaaucgcuuucagaucaaaggugucgagcucaaguccggcuacaaagauuggauucuguggaucagcuucgccauaucuugcuuucuucuguguguggcauugcucggguucaucaugugggccugccagaagggaaacauuagauguaauaucugcauuuga

SEQ ID NO: 122274 - RNA, 1701 nt, Artificial Sequence; identical to SEQ ID NO: 122271
  derived and/or modified sequence opt3 from hemagglutinin__InfluenzaA__AAZ74485

SEQ ID NO: 122275 - RNA, 1701 nt, Artificial Sequence; identical to SEQ ID NO: 122272
  derived and/or modified sequence opt3 from hemagglutinin__InfluenzaA__AAZ74496

SEQ ID NO: 122276 - RNA, 1701 nt, Artificial Sequence; identical to SEQ ID NO: 122271
  derived and/or modified sequence opt3 from hemagglutinin__InfluenzaA__AAZ74507

SEQ ID NO: 122277 - RNA, 1701 nt, Artificial Sequence; identical to SEQ ID NO: 122272
  derived and/or modified sequence opt3 from hemagglutinin__InfluenzaA__AAZ74518

SEQ ID NO: 122278 - RNA, 1701 nt, Artificial Sequence; identical to SEQ ID NO: 122271
  derived and/or modified sequence opt3 from hemagglutinin__InfluenzaA__AAZ74529

SEQ ID NO: 122279 - RNA, 1701 nt, Artificial Sequence
  derived and/or modified sequence opt3 from hemagglutinin__InfluenzaA__AAZ74551
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucgacggcugguauggguuucgucaccagaauagcgagggaaucggccaggcagcugaucugaaguccacccaagccgcgauuaaccagauaaaugguaaauugaaccgccucaucgggaagacgaacgagaaguuccaccagauugaaaaagaguucucugaaguugagggcagaauccaggaccuggaaaaguacguggaggauaccaaaaucgacuuauggagcuauaaugccgagcugcucguagcacuugaaaaccaacauacacuggauuugacugacucagagaugaauaagcuauuugaaaggaccaaaaagcagcugcgggagaacgcugaagauaugggaaauggcugcuucaagauuuaccacaaaugugacaacgccugcauagggaguauccgaaauggaacauaugaucaugacguguaccgcgacgaggcucucaacaauagauuucagauuaagggugucgagcugaaauccggcuacaaggauuggauccuuuggauuagcuucgccaucucuugcuuucuguuguguguggcacuccugggguucauaaugugggccugccagaaaggaaacaucagguguaauauuugcaucuga

SEQ ID NO: 122280 - RNA, 1701 nt, Artificial Sequence; identical to SEQ ID NO: 122202
  derived and/or modified sequence opt3 from hemagglutinin__InfluenzaA__AAZ74562

SEQ ID NO: 122281 - RNA, 1701 nt, Artificial Sequence
  derived and/or modified sequence opt3 from hemagglutinin__InfluenzaA__AAZ74573
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucaucgaaagauccaaagccuauucuaauuguuaccccuaugacgugccugauuacgcaucguugaggucacucgucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagggaaugaucagaucagcuuguaugcccaggcuucuggacguauuacugucuccaccaagagaucacaacagacagugaucccaaacauagguagcaggccccggguacgcgacauuccuaguagaaucucuauuuacuggaccaucguuaaaccaggcgauauccugcuaauuaauuccacggggaaccucauagccccgaggggauacuuuaagauccggagcggcaagucgucuauuaugcgcuccgacgcgcccaucgguaaauguaauucagagugcauaacuccuaacgggaguauuccaaaugacaagcccuuccagaacgugaaucgaaucacauauggagcauguccuagauacgucaaacagaacacccugaaacuugccacuggcaugaggaaugugccagaaaagcaaacacggggcaucuuuggggcuauugccggauucaucgagaacgguugggaaggcaugguggaugggugguauggauuucgucaccagaauagcgagggcauuggucaggcagcugaccugaaguccacccaagccgcgauaaaccagaucaaugggaaauugaaccgccucauuggcaagacgaacgagaaguuccaccagaucgaaaaagaguucucugaagucgagggaagaauccaggaucuggaaaaguacguugaggacaccaaaauugauuuauggagcuauaaugccgagcugcucguggcacuugaaaaccaacauacaauagaccugacugauucagagaugaauaaguuguuugaaaggaccaaaaagcagcuacgggagaacgcugaagacaugggcaaugggugcuucaagaucuaccacaaaugugauaacgccugcauuggaaguauccgaaaugguacauaugaccaugauguauaccgcgacgaggcucugaacaauagauuucagauuaagggcguggagcucaaauccggguacaaggacuggauccuguggaucagcuucgccauaucuugcuuucuucugugugucgcauugcucggauucauuaugugggccugccagaaaggcaacaucagguguaauauuugcaucuga

SEQ ID NO: 122282 - RNA, 1701 nt, Artificial Sequence
  derived and/or modified sequence opt3 from hemagglutinin__InfluenzaA__AAZ74584
augaagaccaucauugcccugagcuacauacucugccuuguguucgcucagaaacugcccggcaacgacaauuccacagcaacuuuguguuuagggcaccaugccgucccuaacggaacgcugguuaagaccaucgcgaaugaucaaauugaggugacaaacgcuacugagcuaguacagucuucaaguaccgguagaaucugcgacagcccacaccagauucucgauggcgaaaauuguacacugaucgacgcccuucugggggauccgcauugcgacggauuucagaacaaagaaugggauuuguucguggagagguccaaggcauauucuaauuguuaccccuaugacgucccugauuacgccucgcuccggucacugguggcuagcaguggcacccuggaauuuaacaaugaguccuucaacuggacugguguugcacaaaaugggacaucuagcgccugcaaacgccgauccaacaagucauuuuucagucgucucaauugguuacaccagcugaaguauaaauacccagcucagaacgugaccaugcccaauaacgagaaguuugacaaacuuuauauauggggaguccaucacccuagcacggauucugaccagaucuccuuguacgcccaagcgucaggcagagugacuguaagcaccaagaggagucagcagacaguuauuccaaacaucggcucucggcccugggugcgcggggucuccagcagaauuucgaucuacuggacuauagugaaaccuggagauauucugcuaaucaauucuaccgguaaccucauugcaccaaggggcuauuucaagauccgguccgggaagucaaguaucaugcgcagcgacgccccgauuggaaaauguaauuccgaaugcauaacacccaacggcucuaucccuaaugacaagccauuucagaacgugaaucgaauuaccuacggugcuugucccagauaugucaaacaaaacacgcugaaacuugccacugggaugaggaauguuccugagaaacagacacggggaaucuucggcgcaauagcuggcuuuauugaaaacgggugggagggaaugguggaugguugguacggcuuccgucaccagaauagcgaggggaccggacaagccgcggaccugaagucaacucaggccgcaaucaaccagaucaauggcaaauugaaccgccucauugaaaagacaaaugagaaguuucaucagaucgaaaaagaguucagugaaguagaggguaggauucaagaucuggagaaguauguggaagacaccaaaauagauuuaugguccuacaacgcugagcugcucgucgcccuugaaaaccagcacacgaucgaccugaccgauagcgagaugaauaaguuguucgaaagaacaaagaagcagcuacgggagaacgcugaggacauggggaauggcugcuuuaagauuuaucauaaaugugauaacgccugcaucggaucuauccgaaauggcacuuacgaccacgauguguaccgcgacgaagcacugaacaauagauuccagauuaaggggguugagcucaaaucaggauauaaggacuggauacuguggaucaguuuugccauuagcugcuuccuucuguguguggcuuugcucgguuuuaucaugugggcgugccaaaaaggcaacauuagguguaauaucugcauauga

SEQ ID NO: 122283 - RNA, 1701 nt, Artificial Sequence; identical to SEQ ID NO: 122259
  derived and/or modified sequence opt3 from hemagglutinin__InfluenzaA__AAZ74595

SEQ ID NO: 122284 - RNA, 1701 nt, Artificial Sequence
  derived and/or modified sequence opt3 from hemagglutinin__InfluenzaA__AAZ74617
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcaagaucucgauauacuggacaauugugaaaccuggggauauccuacucauuaacucuaccggaaaucugaucgcgccaagagguuauuucaagaucagguccggcaagucaaguauuaugcggagcaacgcaccgauagggaaauguaauuccgaaugcaucacgcccaacggaucuauuccuaaugacaagccauuucagaacgucaaucgcaucacuuacggcgccuguccccgauauguuaaacagaacacacuuaagcuggcuaccgguaugagaaaugugccugagaaacagacuagggggauauucggagccauugcaggcuuuaucgaaaacggcugggaggggaugguagacggaugguacgguuuccggcaucaaaauagcgagggcacagggcaggcugccgauuugaagucaacccaggcggccaucaaccaaauuaauggaaaacucaaccgucugaucgaaaagacgaaugagaaguuucaccagauugaaaaagaguucagugaaguggagggccgcauacaggacuuagagaaguaugucgaagauaccaaaaucgaccugugguccuacaacgcagagcuccuuguggcucuggaaaaccagcauacaauugauuugacugacagcgagaugaauaagcuauucgaaagaaccaggaaacaacugcgggagaacgccgaggauauggguaaugggugcuuuaagaucuaucacaagugugacaacgcuugcaucggcucuauucgaaauggaacauacgaucacgacguuuaccgcgaugaagcccucaacaauagauuccagauaaaaggcguggagcugaagucaggguauaaagacuggauccuuuggauuaguuuugcaaucagcugcuuccuguugugugucgugcuccugggauuuauuaugugggccugccagaaggguaacaucagguguaauauaugcaucuga

SEQ ID NO: 122285 - RNA, 1701 nt, Artificial Sequence; identical to SEQ ID NO: 122063
  derived and/or modified sequence opt3 from hemagglutinin__InfluenzaA__AAZ79505

SEQ ID NO: 122286 - RNA, 1701 nt, Artificial Sequence
  derived and/or modified sequence opt3 from hemagglutinin__InfluenzaA__AAZ79516
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugaaaagaccaaugagaaguuucaucagaucgaaaaagaguucagugaaguagaggguaggauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugcgggagaacgccgaggacauggggaauggcugccucaagauuuaucauaaaugugauaacgcuugcaucggaucuauccgaaauggcaccuacgaccacgauguguaccgcgacgaagcccugaacaauagauuucagauuaaggggguugagcuuaaaucaggauauaaggacuggauacuguggaucaguuucgcaauuagcugcuuuuugcucugugugguccuguuagguuucaucaugugggccugccagaaaggcaacauuagguguaauaucugcauauga

SEQ ID NO: 122287 - RNA, 1701 nt, Artificial Sequence
  derived and/or modified sequence opt3 from hemagglutinin__InfluenzaA__AAZ79527
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaagcuguauaucuggggcguccaccauccuggcacagacagcgaucagauuucuuuguacgcccaggcuuccgggcguaucacugugucaaccaaaagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccugaaacuugccacuggaaugaggaacgucccugaacggcaaacacguggcauuuucggcgcuaucgccggguuuaucgagaauggaugggaagguaugguugauggcugguacggguuccgccaccagaacucugagggaaccggccaggcagcugaccuuaagagcacgcaagccgcgauuaaucagaucaacgguaaauugaauagacucauugggaagaccaacgagaaguuucaccagauagaaaaagaguucucagaaguggagggcaggauccaggaucuggaacgguauguagaggacacaaagauugauuuauggaguuacaaugccgagcugcucguggcacuugaaaaccaacauacuaucgaccugaccgauuccgagaugaacaaauuguucgaacgaacaaagaaacagcuacgcgagaaugcugaagacaugggaaacggcugcuuuaagaucuaucacaagugugauaaugccugcauugggagcauaagaaacggaacuuacgaccaugacgucuacagggaugaggcucugaauaaccgguuccagaucaaagguguggagcucaagucuggcuauaaagacuggauucuguggaucucauuugccauuaguugcuuccuucuguguguugcauugcucggguuuaucaugugggccugccagaagggaaauauacgcuguaacaucugcauuuga

SEQ ID NO: 122288 - RNA, 1698 nt, Artificial Sequence
  derived and/or modified sequence opt3 from hemagglutinin__InfluenzaA__AAZ79549
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuucaucuuucgaaagguuugagaucuucccuaaggagaguuccuggccaaaucauacugugacaggugucucugcaagcugcucccacaacgggaagucaaguuuuuaccggaauuuacuguggcuuaccggcaaaaacggauuguaucccaaucugagcaagucuuacgccaacaauaaagaaaaggaggugcuaauacucuggggcguacaucacccuccaaacaucgggaaccagcgcacgcuguaccacacugaaaaugcuuauguuuccguggucucaagccauuacagucgacguuucacccccgagauuacaaaaagaccuaaggugagggaucaggaaggacggaucaacuauuacuggacucuucuggagccaggugacaccauuaucuuugaggcaaauggcaacuugauagccccgugguaugcuuucgcccucucucgcggguuuggauccggcauuaucacaagcaaugcgcccauggaugaaugugacgcaaagugccagaccccucaaggugccauuaacucgucucugccauuccagaaugugcaccccgucacgaucggggaguguccuaaauacguuagauccgcuaaguuaaggauggugacuggacugcggaacaucccaucaauucagagucgcggccucuuuggcgccauagcaggguucaucgaaggagguuggacaggcaugguagaugggugguauggauaccaucaccagaaugagcaaggcagcgguuacgcugccgaccagaaauccacccagaacgcgauuaaugggaucacuaacaaggugaauagcgucauagaaaagaugaacacacaguuuaccgccgugggcaaagaguucaauaaacuugagcgaagaauggaaaaccugaacaagaagguugaugacggauucuuggauauuuggacguauaaugcagagcuacuggugcuccuggaaaacgagaggacccuugacuuucacgacagcaaugucaaaaaccuguacgaaaaggugaaaucacaauugaagaauaacgcuaaagagaucggcaaugggugcuucgaguuuuaucauaaguguaacaaugaaugcauggagaguguaaagaacggaacauacgauuaucccaaauacuccgaagagagcaagcucaaucgggagaaaaucgacgguguuaagcuggauucuaugggcguguaucagauuuuagccaucuacucaacugucgcuaguagccuggugcuacucgucucccugggggccauuucuuucuggaugugcucgaacggaagccuucagugucguauaugcaucuga

SEQ ID NO: 122289 - RNA, 1701 nt, Artificial Sequence
  derived and/or modified sequence opt3 from hemagglutinin__InfluenzaA__AAZ79560
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcucaaaucacugguggccagcaguggcacucuggaauuuaacaaugaguccuucaacuggacagguguugcucaaaaugggaccucuagcgcaugcaagcggcgcuccaacaagucauuuuucagucgacucaauugguuacaccagcugaaauauaaguacccagcccuuaacgugacgaugcccaauaacgagaaauuugacaaguuguauauauggggaguccaucacccuagcacugauucugaccagaucucccuguacgcucaggccucaggccgugugaccguaagcacaaaaagaagucaacagacuguuauuccaaacaucggcucuaggcccugggugcgcggggucuccagccggauuucgaucuacuggaccauagugaagccuggagauauucuacucaucaauucuacagguaaccugauugcgccaagaggcuauuucaagaucagguccgggaaaucaaguaucaugcggagcaaugcaccgauuggaaaguguaacuccgaaugcauaacccccaauggcucuaucccuaacgacaaaccauuucagaaugugaaccgcauuacguacggugccuguccccgauaugucaagcagaauacucuuaaacuggcuacagggaugagaaacguuccugagaagcaaaccaggggaaucuucggcgccauagcaggcuuuauugaaaaugggugggagggaaugguggacgguugguacggcuuccggcaccagaacagcgaggggacuggacaggcugccgauuugaaaucaacacaagcggccaucaaucagaucaacggcaagcucaaucgucugauugaaaagaccaacgagaaauuucaucagaucgaaaaggaguucagugaaguagagggucgcauucaggacuuagagaaauauguggaagauacgaagauagaccugugguccuacaacgcagagcuccuugucgcucuggaaaaucaacacaccaucgauuugacagacagcgagaugaacaaacuauucgaaagaacuaagaagcagcugagggagaaugccgaggauauggggaacggcugcuuuaaaauuuaucauaagugugacaaugcuugcaucggaucuauccggaacggcaccuacgaucacgacguguaccgagaugaagcccucaauaaccgcuuccagauuaaagggguugagcugaagucaggauauaaagacuggauacuuuggaucaguuuugcaauuagcugcuuccuguugugugugguccuccuggguuuuaucaugugggccugccagaagggcaauauuagauguaacaucugcauauga

SEQ ID NO: 122290 - RNA, 1701 nt, Artificial Sequence
  derived and/or modified sequence opt3 from hemagglutinin__InfluenzaA__AAZ79571
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgaggugcgacggauuucagaacaaagaaugggauuuguucguggagcgguccaaggccuauucuaauuguuaccccuaugacgucccugauuacgcaucgcuccgcucacugguggccagcaguggcacucuggaauuuaacaaugaguccuucaacuggacagguguugcucaaaaugggaccucuagcgcaugcaaacgacguuccaacaagucauuuuucaguagacucaauugguuacaucagcugaaguauaaauacccagcccuuaacgugacgaugcccaauaacgagaaguuugacaaauuguauauauggggaguccaccauccuagcacugauucugaccagaucucccuguacgcucaggccucaggcagggugaccguaagcacaaagcggagucaacagacuguuauuccaaacaucggcucucgccccugggugagaggggucuccagcaggauuucgaucuacuggaccauagugaaaccuggagauauucuacucaucaauucuacagguaaccugauugcgccacggggcuauuucaagauccgcuccgggaagucaaguaucaugcgaagcgacgcaccgauuggaaaauguaauuccgaaugcauaacccccaacggcucuaucccuaaugacaagccauuucagaacgugaauagaauuacguacggugccugucccagguaugucaaacagaacacucuuaagcuggcuacagggaugcggaauguuccugagaaacaaacccguggaaucuucggcgccauagcaggcuuuauugaaaacgggugggagggaaugguggaugguugguacggcuuccgccaccagaauagcgaggggacuggacaggcugccgacuugaagucaacacaagcggccaucaaccagaucaauggcaaacucaacagacugauugaaaagaccaaugagaaguuucaccagaucgaaaaagaguucagugaaguagaggguaggauucaggauuuagagaaguauguggaagacacgaaaauagaucugugguccuacaacgcagagcuccuugucgcucuggaaaaccaacauaccaucgacuugacagauagcgagaugaauaagcuauucgaacggacuaaaaagcagcugcgagagaacgccgaggacauggggaauggcugcuuuaagauuuaucacaaaugugauaacgcuugcaucggaucuauccgcaauggcaccuacgaccaugauguguacagagacgaagcccucaacaauagguuccagauuaaggggguugagcugaaaucaggauauaaggacuggauacuuuggaucaguuuugcaauuagcugcuuccuguugugugugguccuccuggguuuuaucaugugggccugccagaaaggcaacauucgguguaauaucugcauauga

SEQ ID NO: 122291 - RNA, 1701 nt, Artificial Sequence
  derived and/or modified sequence opt3 from hemagglutinin__InfluenzaA__AAZ79582
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucugggcccugggugcggggagucuccagccgcauuucgaucuacuggaccauagugaaaccuggugauauucuacucaucaauucuacaggcaaccugauugcgccaagaggguauuucaagaucagguccggaaagucaaguaucaugcggagcgacgcaccgauuggcaaauguaauuccgaaugcauaacccccaacgguucuaucccuaaugacaagccauuucagaacgugaaucgcauuacguacggggccuguccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucaacacaagcggccaucaaccagaucaaugguaaacucaaccgucugauugaaaagaccaaugagaaguuucaucagaucgaaaaagaguucagugaaguagaggggcgcauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugagggagaacgccgaggacaugggcaauggaugcuuuaagauuuaucauaaaugugauaacgcuugcaucggcucuauccggaaugggaccuacgaccacgauguguaccgagacgaagcccucaacaaucgcuuccagauuaagggaguugagcugaaaucagguuauaaggacuggauacuuuggaucaguuuugcaauuagcugcuuccuguugugugugguccuccugggcuuuaucaugugggccugccagaaagggaacauuagauguaauaucugcauauga

SEQ ID NO: 122292 - RNA, 1698 nt, Artificial Sequence
  derived and/or modified sequence opt3 from hemagglutinin__InfluenzaA__AAZ79604
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuauuacuggacacuucuggaaccaggcgauacuauuaucuuugaggccaacgggaauuugauugcuccgugguaugccuucgcgcucucucgcggauuuggcuccgguaucauaaccagcaacgcacccauggacgagugugaugccaagugccagacaccucaaggggcuauuaauucgucucugccauuccagaacguucaccccgugaccaucggagaauguccuaaguacguaagauccgccaaauuaaggauggugacgggccugcggaauauuccaucaauccagagucgcggccucuuuggggcaaucgcuggauucauugaggguggcuggacugggauggucgacggaugguauggcuaccaucaccagaacgaacaagguagcggguacgccgcggaucagaaguccacacagaaugccauaaaccgaaucaccaauaaagugaacucuguuauugagaagaugaauacucaguuuacagcagugggcaaagaguucaacaagcuagaaagaaggauggagaaucugaacaaaaaggucgacgauggauucuuggacaucuggaccuauaacgcugaacuacuggugcuccuggagaaugaacggacgcuugacuuucacgauagcaacguaaagaaucuguacgagaaaguuaagucacaauugaaaaacaaugccaaggaaauaggcaacgggugcuucgaguuuuaucauaaauguaauaacgagugcauggaaagugugaagaauggaaccuacgacuaucccaaguacuccgaggaaagcaaacucaaccgugagaagauugauggugucaaacuggagucuaugggcguguaucagaucuuagcuaucuacucaacagucgccaguagccuggugcuacucguuucccugggggcaauuucuuucuggaugugcucgaauggaagccuucagugucgcaucugcauuuga

SEQ ID NO: 122293 - RNA, 1701 nt, Artificial Sequence
  derived and/or modified sequence opt3 from hemagglutinin__InfluenzaA__AAZ79615
augaagaccaucauugcccugagcuacauacucugccuuguguucgcucagaaaauccccggcaacgacaauuccacagcaacucugugugucgggcaccaugccguuccuaacggaacgauugugaagaccaucacaaaugaucaaauugagguaacuaacgcgaccgaauuggugcagucuucaaguacagguggcaucugcgacagcccacaccagauauuagauggggagaauuguacccugaucgacgcucuacucggagauccgcagugcgacggcuuucaaaacaaaaagugggaucuguucgucgaaagauccaaagccuauucuaauuguuaccccuaugacgugccugauuacgcaucgcuuaggucacugguugccagcagugguacuuuggaguuuaacaaugaauccuucaacuggacaggggugacccagaauggaacgucuagcgcuugcaagcggcgcuccaacaauucauuuuucagucgacucaacuggcugacucaucugaaguuuaaauauccagcacucaaugucaccaugcccaacaacgagaaguucgacaaauuauacauuuggggcgugcaccauccuggcacagauaaugaccagaucagccuguaugcccaggcuucugggcguauuacuguauccaccaagagaucacaacagacaguuaucccaaacauaggaagcaggccccgggugcgcgauauuccuaguagaaucucuauuuacuggaccaucgucaaaccaggugacauccuuuugauuaauuccacgggcaaccugauagccccgaggggguacuuuaagauccggagcggaaagucgucuauuaugcgcuccgacgcgcccaucggcaaauguaauucagagugcauaacuccuaacgguaguauuccaaaugauaagcccuuccagaacgugaaucgaaucacauauggggcauguccuagauacgugaaacagaacacccuaaagcucgccacuggaaugaggaaugucccagaaaaacaaacacggggcaucuuuggcgcuauugccggguucaucgagaacggaugggaagguaugguugacggcugguauggguuucgucaccagaauagcgagggaauuggccaggcagcugaucugaaguccacccaagccgcgauaaaccagaucaaugguaaacuuaaccgccugauugggaagacgaacgagaaguuccaccagaucgaaaaagaguucucugaaguggagggcagaauccaggacuuggaaaaguacguagaggauaccaaaauugaccucuggagcuauaaugccgagcuguuaguggcacuggaaaaccaacauacaauagaucucacugacucagagaugaauaaacuuuuugaaaggaccaagaagcagcugcgggagaacgcugaagauaugggaaauggcugcuucaagaucuaccacaaaugugacaacgccugcauugggaguauccgaaauggaacauaugaucaugacgucuaccgcgacgaggcuuugaacaauagauuucagauuaaggguguggagcuaaaauccggcuacaaggauuggauccuguggaucagcuucgccauaucuugcuuucuccuguguguugugcuucugggguucauuaugugggcaugccagaaaggaaacaucagguguaauauuugcaucuga

SEQ ID NO: 122294 - RNA, 1701 nt, Artificial Sequence
  derived and/or modified sequence opt3 from hemagglutinin__InfluenzaA__AAZ79627
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacucauccuuuuucagccgacugaauuggcucacucauuuaaaguuuaaauauccagcacugaaggugaccaugcccaacaaugagaaauucgacaaacuuuacaucuggggcguccaccauccuggcacagauaacgaccagauuucuuuguaugcccaggcuuccgggcguaucacugugucaaccaagagaagccaacagacaguaauuccaaacaucggaaguaggccccggguucgcgauauaccuucuagaauuuccaucuacuggaccauugugaagccaggugacauccugcuaaucaauagcacgggcaaccucauugccccgaggggguacuuuaagauacggucgggaaaaucuuccaucaugcgcucagacgcgcccauuggcaaguguaauagugagugcaucacuccuaacgguagcauaccaaaugauaaacccuuccagaacgucaaucgaauuacauauggggcauguccuagauacgugaagcagaacacccugaaacuugccacuggaaugaggaaugugccagaaaagcaaacacggggcaucuuuggcgcuaucgccggguucauugagaacggaugggaagguauggucgacggcugguauggguuucgucaccagaauagugagggaaucggccaggcagcugaucugaaaucuacccaagccgcgauuaaccagauaaaugguaaguugaaccgccucaucgggaagacgaaugagaaauuccaccagauugaaaaggaguucagcgaaguugagggcagaauccaggaccuggaaaaauacguggaggauaccaagaucgacuuauggucauauaacgccgagcugcucguagcacuugaaaaccaacauacaauugaucugacugacagugagaugaauaaauuguuugaaaggaccaagaagcagcuacgggagaacgcugaagauaugggaaauggcugcuucaaaauauaccacaagugugacaacgccugcaucggguccauucgaaauggaacauaugaucaugacguguaccgcgacgaggcucugaacaauagauuucagaucaaaggugucgagcucaagagcggcuacaaagauuggauucuguggaucucuuucgccauaucaugcuuucuucuguguguggcauugcucggguucaucaugugggccugccagaagggaaacauuagguguaauaucugcauuuga

SEQ ID NO: 122295 - RNA, 1701 nt, Artificial Sequence; identical to SEQ ID NO: 122272
  derived and/or modified sequence opt3 from hemagglutinin__InfluenzaA__AAZ79941

SEQ ID NO: 122296 - RNA, 1701 nt, Artificial Sequence; identical to SEQ ID NO: 122271
  derived and/or modified sequence opt3 from hemagglutinin__InfluenzaA__AAZ79944

SEQ ID NO: 122297 - RNA, 1701 nt, Artificial Sequence
  derived and/or modified sequence opt3 from hemagglutinin__InfluenzaA__AAZ79963
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaagcaucggaaguaggccccggauacgcgauguuccuucuagaauuuccaucuacuggaccauugugaaaccaggugacauccugcuaaucaacagcacgggcaaucucauugccccgaggggguacuuuaagauacggucgggaaagucuuccaucaugcgcucagacgcgcccauuggcaaauguaacagugagugcaucacuccuaaugguagcauaccaaacgauaagcccuuccagaaugucaaccgaauuacauauggggcauguccuagauacgugaaacagaauacccugaaacuugccacuggaaugaggaacgugccagaaaaacaaacacggggcaucuuuggcgcuaucgccggguucauugagaauggaugggaagguauggucgacggcugguauggguuucgucaccagaacuccgagggaaccggccaggcagcugaucugaagucuacgcaagccgcgaucaaucagauuaacgguaaauugaaucgccucauagggaagaccaacgagaaguuccaccagaucgaaaaagaguucagcgaaguugagggcaggauucaggaccuggaaaaguacguggaggauacaaaaaucgacuuauggucauauaacgccgagcugcucguagcacuugaaaaucaacauacuaucgaucugaccgacagugagaugaacaaguuguuugaaagaacaaagaagcagcuacgggagaaugcugaagauaugggaaacggcugcuucaagauuuaccacaaaugugacaaugccugcauaggguccauccgaaacggaacuuaugaucaugacguguaccgcgacgaggcucugaauaacagauuucagauuaagggugucgagcucaaaagcggcuacaaggauuggauccuguggauuucuuucgccaucucaugcuuucuucuguguguggcauugcucggguucauaaugugggccugccagaaaggaaauaucagguguaacauuugcaucuga

SEQ ID NO: 122298 - RNA, 1701 nt, Artificial Sequence
  derived and/or modified sequence opt3 from hemagglutinin__InfluenzaA__AAZ79974
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacaaauaacgaucagauuagcuuguaugcccaggcuucugggcguaucacuguguccaccaagagaucacaacagacaguaauuccaaauaucggaagcaggccccggguucgcgacauaccuaguagaauuucuaucuacuggaccauugugaaaccaggugauauccugcuaaucaacuccacgggcaaucucauugccccgaggggguacuuuaagauacggagcggaaagucgucuaucaugcgcuccgacgcgcccauuggcaaauguaacucagagugcaucacuccuaaugguaguauaccaaacgacaagcccuuccagaaugucaaccgaauuacauauggggcauguccuagauacgugaaacagaauacccugaaacuugccacuggaaugaggaacgugccagaaaagcaaacacggggcaucuuuggcgcuaucgccggguucauugagaauggaugggaagguauggucgauggcugguauggguuucgucaccagaacagcgagggaaucggccaggcagcugaccugaaguccacccaagccgcgauuaaucagauaaacgguaaauugaaccgccucaucgggaagacgaaugagaaguuccaccagauugaaaaagaguucucugaaguugagggcagaauccaggaucuggaaaaguacguggaggacaccaaaaucgauuuauggagcuauaacgccgagcugcucguagcacuugaaaaucaacauacaauugaccugacugauucagagaugaacaaguuguuugaaaggaccaaaaagcagcuacgggagaaugcugaagacaugggaaacggcugcuucaagauauaccacaaaugugauaaugccugcaucgggaguauucgaaacggaacauaugaccaugauguguaccgcgacgaggcucugaauaacagauuucagaucaagggugucgagcucaaauccggcuacaaggacuggauucuguggaucagcuucgccauaucuugcuuucuucuguguguggcauugcucggguucaucaugugggccugccagaaaggaaauauuagguguaacaucugcauuuga

SEQ ID NO: 122299 - RNA, 1701 nt, Artificial Sequence; identical to SEQ ID NO: 122271
  derived and/or modified sequence opt3 from hemagglutinin__InfluenzaA__AAZ79996

SEQ ID NO: 122300 - RNA, 1701 nt, Artificial Sequence
  derived and/or modified sequence opt3 from hemagglutinin__InfluenzaA__AAZ80007
augaagaccaucauugcccugagccacauauucugccucgugcuuggccaguaccugcccgggaacgacaauuccacagcuacuuuguguuuaggacaucacgcagucccuaacgguacgcugguuaaaaccaucacaaaugaucaaauugaggugacuaacgccaccgaauugguacagucuucaaguacaggcaagaucugcaauaacccacauaggauucucgacgggaucgauuguacccugauagacgcgcuucugggagauccgcacugcgacggcuuucagaaugagacuugggauuuguucguggaaagaagcaaggcuuuuuccaacuguuaucccuacgacgucccugauuaugccucucuccggucgcugguggcaucaagcgguacacuggaguucaucaccgaaggguuuacguggacuggaguuacccagaauggcggcaguaacgccugcaagcgcgggccaggauccgguuucuuuucucgacucaauugguuaacaaaaagcgaguccacuuaccccgugcugaacgucaccaugccuaauaacgacaauuucgauaaacuuuauauuuggggcgugcaucacccaucaacaaaccaagagcagaccaguuuguacguacaggcuagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaauuccaacgggaaucucaucgcaccgaggggauacuuuaaaaugcggacuggcaagagcucgaucaugcgcucugaugcccccauugacacauguauauccgaaugcaucaccccuaacggcucaauuccaaaugacaaacccuuccagaacguuaauaagaucacguacggggcuuguccuaaauaugugaagcagaacacccugaaacuugccacaggaaugcgaaauguaccagagaaacagacuagaggucuguuuggcgcgauagcaggguucauugaaaacggaugggagggcaugaucgaugguugguacggguuuaggcaccaaaauagugagggcaccggacaggccgcugaccuaaagagcacacaggccgcaaucgaucaaauuaacggcaaacucaaucgggugaucgaaaagacuaacgagaaauuccaucagauugaaaaggaguucuccgaagucgaggggcguauacaggaccuggagaaauauguggaagauaccaagaucgacuuauggucuuacaaugcugagcugcucguugcccuugaaaaccagcacacaauugaucugaccgacagcgagaugaacaaguuguuugaaaagacucgcagacaacuaagggagaaugcggaggauaugggaaacgguugcuucaagaucuaucauaaaugugacaaugccugcaucgaaucaauucggaacggcacguacgaucacgacguguaucgagacgaggcacugaauaaccgcuuucagauaaagggggucgaacucaaaaguggauacaaggauuggauccuguggauuuccuucgcuaucagcugcuuucuucugugugugguauugcucggcuucauuaugugggccugccagagagguaauaucagguguaacauaugcaucuga

SEQ ID NO: 122301 - RNA, 1701 nt, Artificial Sequence; identical to SEQ ID NO: 122272
  derived and/or modified sequence opt3 from hemagglutinin__InfluenzaA__AAZ80017

SEQ ID NO: 122302 - RNA, 1701 nt, Artificial Sequence
  derived and/or modified sequence opt3 from hemagglutinin__InfluenzaA__AAZ80030
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacagguggcauuugcgacagcccacaccagauccuagauggggaaaauuguacccucauagacgcucugcuuggagauccgcagugcgacggcuuucaaaacaagaaaugggaucuguucguggagagauccaaggccuauucuaauuguuaccccuaugacgucccugauuacgcaucguugaggucacucguggccagcagugguacucuggaauuuaacaaugaguccuucaacuggacagggguuacccagaauggaacgucuagcgcuugcaaacggcgcuccaacaauucauuuuucagucgacugaacuggcucacucauuuaaaguuuaaguauccagcacugaaugugaccaugcccaacaacgagaaauucgacaaacuuuacaucuggggcguccaccauccuggcacagauaaugaccagacuagcuuguaugcccaggcuucugggcguauuaccguguccacaaagagaucacaacagaccguaaucccaaacauuggaagcaggccccggguucgcgauaucccuaguagaauaucuauuuacuggacgaucgugaagccaggugacauucugcuaaucaauuccacuggcaaccucaucgccccgaggggguacuuuaaaauucggagcggaaagucgucuauaaugcgcuccgacgcgcccaucggcaaguguaauucagaaugcauuacaccuaacgguaguaucccaaaugauaaacccuuccagaacgucaaucgaauaaccuauggggcauguccuagauacgugaagcagaacacucugaaacuugccacaggaaugaggaaugugccagagaagcaaacccggggcauuuuuggcgcuaucgccggguucaucgaaaacggaugggaggguauggucgacggcugguauggguuucgucaccagaauagcgagggaauuggccaggcagcugaucugaaauccacgcaagccgcgaucaaccagauuaaugguaaguugaaccgccucauagggaaaaccaacgaaaaguuccaccagaucgagaaggaguucucugaaguugaaggcaggauucaggaccuggagaaauacguggaggauacaaagaucgacuuauggagcuauaaugccgaacugcucguagcacuugagaaccaacauacuaucgaucugaccgacucagaaaugaauaaauuguuugagagaacaaagaaacagcuacgggaaaacgcugaggauaugggaaauggcugcuucaagauuuaccacaagugugacaacgccugcauagggaguauccgaaauggaacuuaugaucaugacguguaccgcgacgaggcucugaacaauagauuucagauuaaaggugucgaacucaaguccggcuacaaagauuggauccuguggauuagcuucgccaucucuugcuuucuucuguguguggcauugcucggguucauaaugugggccugccagaagggaaacaucagguguaauauuugcaucuga

SEQ ID NO: 122303 - RNA, 1701 nt, Artificial Sequence
  derived and/or modified sequence opt3 from hemagglutinin__InfluenzaA__AAZ83242
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagaaauaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcaagcggcgcagcaauaaguccuuuuucucacgacugaacuggcucacucauuuaaaauauaaguacccagcacugaaugugaccaugcccaacaacgagaaauuugacaaacuuuauaucuggggaguccaccauccuggcacagauagugaccagauuaauuuguacgcccaggcuagcggccguaucacugugucuaccaagagaucccaacagacaguaauuccaaacaucggguacaggccccggguucgcgaugugccuucaagaauaagcauuuauuggaccaucgucaagccaggagacauucugcuaaucaauaguacggguaaccucaucgccccgaggggcuacuucaagauucggucugggaaauccagcauaaugcgcucggacgcgcccaucggaaaguguaauucugaaugcauuacuccuaacggcuccaucccaaaugauaaacccuuucagaacgugaaucgaauaacauauggugcauguccuagauacgugaagcagaacacccugaaacuugccacugggaugaggaaugucccagagaagcaaacacggggaauuuucggcgcuaucgccggcuuuaucgaaaacgggugggagggaaugguugacgguugguauggcuuccgucaccaaaauucagaggggaccggacaggcagcugaucugaaaaguacgcaggccgcgauuaaccagaucaauggcaaguugaaccgccucauugguaagaccaacgaaaaauuucaccagauagagaaggaguucagcgaaguggaagggagaauccaggaccuggagaaauacguagaggauacaaagauugacuuaugguccuauaaugccgaacugcucguggcacuugagaaccaacauacuaucgaucugaccgacucugaaaugaauaaauuguucgagaggacaaagaagcagcuacgggaaaacgcugaggauaugggcaauggaugcuuuaaaaucuaccacaagugugacaacgccugcauuggcagcauacgaaaugggacuuacgaucaugacgucuaucgcgacgaggcucugaacaauagauuccagaucaaaggaguggaacucaagucagguuacaaagauuggauucuguggaucaguuuugccauuuccugcuuccuucuguguguugcauugcucggcuuuaucaugugggccugccagaaggggaacauaagguguaauaucugcauuuga

SEQ ID NO: 122304 - RNA, 1701 nt, Artificial Sequence
  derived and/or modified sequence opt3 from hemagglutinin__InfluenzaA__AAZ83266
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaaugaacuuguacagucuucaaguaccgguagaaucugcgacagcccacaccagauucucgauggcgagaacuguacacugaucgacgcucuacugggggauccgaggugcgacggauuucagaauaaagaaugggauuuguucguggagcgguccaaggccuauucuaacuguuaccccuaugacgucccugauuacgcaucgcuccgcucacugguggccagcaguggcacccuggaauuuaauaacgaguccuucaauuggacugguguugcucaaaacgggacaucuagcgcaugcaaacgacguuccaauaagucauuuuucaguagacucaacugguuacaucagcugaaguauaaauacccagcccuuaaugugaccaugcccaacaacgagaaguuugacaaauuguauauauggggaguccaccauccuagcacggauucugaccagaucucccuguacgcucaggccucaggcagggugacuguaagcaccaagcggagucaacagacaguuauuccaaauaucggcucucgccccugggugagaggggucuccagcaggauuucgaucuacuggacuauagugaaaccuggagauauucuacucaucaacucuaccgguaaucugauugcgccacggggcuauuucaagauccgcuccgggaagucaaguaucaugcgaagcgacgcaccgauuggaaaauguaacuccgaaugcauaacacccaauggcucuaucccuaacgacaagccauuucagaaugugaacagaauuaccuacggugccugucccagguaugucaaacagaauacgcuuaagcuggcuacugggaugcggaacguuccugagaaacaaacacguggaaucuucggcgccauagcaggcuuuauugaaaaugggugggagggaaugguggaugguugguacggcuuccgccaccagaacagcgaggggaccggacaggcugccgacuugaagucaacucaagcggccaucaaucagaucaacggcaaacucaauagacugauugaaaagacaaacgagaaguuucaccagaucgaaaaagaguucagugaaguagaggguaggauucaggauuuagagaaguauguggaagacaccaaaauagaucugugguccuacaacgcagagcuccuugucgcucuggaaaaucaacauacgaucgacuugaccgauagcgagaugaacaagcuauucgaacggacuaaaaagcagcugcgagagaaugccgaggacauggggaacggcugcuuuaagauuuaucacaaaugugauaaugcuugcaucggaucuauccgcaacggcacauacgaccaugauguguacagagacgaagcccucaauaacagguuccagauuaaggggguugagcugaaaucaggauauaaggacuggauacuuuggaucaguuuugcaauuagcugcuuccuguugugugugguccuccuggguuuuaucaugugggccugccagaaaggcaauauucgguguaacaucugcauauga

SEQ ID NO: 122305 - RNA, 1701 nt, Artificial Sequence; identical to SEQ ID NO: 122202
  derived and/or modified sequence opt3 from hemagglutinin__InfluenzaA__AAZ83277

SEQ ID NO: 122306 - RNA, 1701 nt, Artificial Sequence; identical to SEQ ID NO: 122088
  derived and/or modified sequence opt3 from hemagglutinin__InfluenzaA__AAZ83288

SEQ ID NO: 122307 - RNA, 1701 nt, Artificial Sequence
  derived and/or modified sequence opt3 from hemagglutinin__InfluenzaA__AAZ83312
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccauaaagucauuuuucagucgucucaacugguuacaccagcugaaguauaaauacccagcccuuaaugugacgaugcccaacaaugacaaguuugauaaauuguauaucuggggaguccaucacccuagcacugacucugaucagaccucccuguacgcucaggccucaggcagagugacaguaagcacuaagaggagucaacagaccguuauuccaaacaucggcucucggcccugggugcgcggggucuccagcagaauuucgaucuacuggacaauagugaaaccuggagacauucuacucaucaacucuaccgguaaucugauugcgccaaggggcuauuucaagauccgguccgggaagucaaguaucauucgcagcgacgcaccgauaggaaaauguaacuccgagugcaucacgcccaauggcucuauuccuaacgauaagccauuucagaaugugaaccgaaucacuuacggugccugucccagauaugucaaacagaauacacuuaagcuggcuaccgggaugaggaacguuccugaaaaacaaacucggggaauauucggcgccauugcaggcuuuaucgagaaugggugggaaggaaugguggacgguugguacggcuuccgucaccagaacagcgaggggacaggacaggcugccgauuugaagucaacccaagcggccaucaaucagauuaacggcaaacucaaucgccugaucgagaagacgaacgaaaaguuucaucagauugagaaagaguucagugaaguagaagguagaauacaggacuuagagaaguauguggaggauaccaaaaucgaccugugguccuacaaugcagaacuccuugucgcucuggagaaccaacacacaauugauuugacugacagcgaaaugaacaagcuauucgagaggacccggaaacagcugcgagaaaaugccgaggauauggggaacggcugcuuuaagaucuaucauaagugugacaaugcuugcaucggaucuauucgcaacggcacauacgaucacgacguguacagagacgaggcccucaauaacagguuccagauaaaagggguugaacugaagucaggauauaaagauuggauccuuuggauuaguuuugcaaucagcugcuuccuguugugugugguccuccuggguuuuauuaugugggccugccagaagggcaauauccgguguaacauaugcaucuga

SEQ ID NO: 122308 - RNA, 1701 nt, Artificial Sequence
  derived and/or modified sequence opt3 from hemagglutinin__InfluenzaA__AAZ83323
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcgagaauuguacccugaucgacgcucuacugggggauccgcauugcgacggauuucagaacaaagaaugggauuuguucguggagcgguccaaggccuauucuaauuguuaccccuaugacguccaggauuacgcaucgcuccgcucacugguggccagcaguggcacucuggaauuuaacaaugaguccuucaacuggacagguguugcucaaaaugggaccucuuaugcaugcaaacgacguagcauaaaguccuuuuucucaagacucaacugguuacaccagcugaaguacaaauauccugcccuuaaugugacgaugccaaacaaugacaaguuugauaaauuguacaucuggggaguccaucaccccaguacugacagcgaucagaccucucuguacgcucaggccuccggcagggugacaguaucaacuaagcggagccaacagaccguuauuaguaacaucggcucucgcccuugggugagaggggucuccagcaggauuucgaucuauuggacaauagugaaaccaggagacauucuacucaucaccucuacggguaaccugauugcgccccggggcuacuucaagauccgcuccgggaagucaaguaucaugcgaagcgacgcaccuauuggaaaauguaauuccgagugcauaacuccaaacggcucuaucccgaaugauaagcccuuucagaacgugaauagaauuacauauggugccuguccuagguacgucaaacagaacacccuuaagcuggcuacugggaugcggaauguuccagaaaaacaaacacguggaaucuucggcgccauagcaggcuuuauugagaacgggugggaaggaaugguggacgguugguauggcuuccgccaccagaauagcgaggggaccggacaggcugccgauuugaagucaacgcaagcggccaucaaccagaucaauggcaaacucaacagacugauugagaagaccaaugaaaaguuucaucagaucgagaaagaguucagugaaguagaagguaggauucaggacuuagagaaguacguggaggauacaaaaauagaccugugguccuauaacgcagaacuccuugucgcucuggagaaucaacacacuaucgauuugaccgacagcgaaaugaacaagcuauucgagcggacacgaaaacagcugcgcgaaaacgccgaggauauggggaauggcugcuuuaagauuuaccauaagugugacaacgcuugcaucggaucuaucagaaauggcacuuacgaucacgacguguauagggacgaggcccucaacaaucgguuccagauuaaagggguugaacugaagucaggauacaaagauuggauacuuuggaucaguuuugcaauuagcugcuuccuguugugugugguccuccuggguuuuaucaugugggccugccagaagggcaacauucgcuguaauaucugcauauga

SEQ ID NO: 122309 - RNA, 1701 nt, Artificial Sequence; identical to SEQ ID NO: 122298
  derived and/or modified sequence opt3 from hemagglutinin__InfluenzaA__AAZ83371

SEQ ID NO: 122310 - RNA, 1701 nt, Artificial Sequence; identical to SEQ ID NO: 122271
  derived and/or modified sequence opt3 from hemagglutinin__InfluenzaA__AAZ83688

SEQ ID NO: 122311 - RNA, 1698 nt, Artificial Sequence
  derived and/or modified sequence opt3 from hemagglutinin__InfluenzaA__ABA06510
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucgcuaaagagaguuggagcuacauuguggaaaccccaaauccggagaacggagccuguuaucccggcuacuuugcagacuaugaggaacugagagagcaacucuccucuguuucgucauucgaaagguuugagaucuucccuaaggagagcaguuggccaaaucauacugugacaggugucuccgccucuugcagccacaacgggaaguccucauuuuaccggaauuuacuguggcuuaccggcaaaaacggauuguaucccaaucugaguaagagcuacgcuaacaauaaagaaaaggaggugcuaauacucuggggcguacaucacccuccaaacaucggggaucagcgcacgcuguaccacacugaaaacgcauauguuucuguggucuccucacauuacagccgacguuucacccccgagauuacaaaaagaccuaaggugagggaccaggaaggacggaucaauuauuacuggacucuucuggagccaggugauaccauuaucuuugaggccaacggcaauuugauagcuccgugguaugccuucgcgcucagucgcggguuuggaucuggcauuaucacauccaacgcacccauggacgaaugugaugccaagugccagaccccucaaggugcuauuaauagcucgcugccauuccagaacgugcaccccgucacgaucggggaguguccuaaauacguuagaucugccaaguuaaggauggugacuggacugcggaauaucccauccauucagucacgcggccucuuuggcgcaauagcuggguucaucgaaggagguuggacaggcaugguagacgggugguauggauaccaucaccagaacgagcaaggcagugguuacgccgcggaucagaaaagcacccagaaugccauuaacgggaucacuaauaaggugaacuccgucauagaaaagaugaauacacaguuuaccgcagugggcaaagaguucaacaaacuugagcgaagaauggaaaaucugaacaagaagguugacgauggauucuuggacauuuggacguauaacgcugagcuacuggugcuccuggaaaaugagaggacccuugacuuucacgauucuaacgucaaaaaucuguacgaaaaggugaaaagccaauugaagaacaaugccaaagagaucggcaacgggugcuucgaguuuuaucauaaguguaauaacgaaugcauggagucaguaaagaauggaacauacgacuaucccaaauacagugaagaguccaagcucaaccgggagaaaaucgaugguguuaagcuggacagcaugggcguguaucagauuuuagcuaucuacucuacugucgccucaagucuggugcuacucgucagccugggggcaauuuccuucuggaugugcucuaauggaucgcuucagugucguauaugcaucuga

SEQ ID NO: 122312 - RNA, 1698 nt, Artificial Sequence
  derived and/or modified sequence opt3 from hemagglutinin__InfluenzaA__ABA08464
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuauuacuggacacuucuggaaccaggcgauacuauuaucuuugaggccaacgggaauuugauugcuccgugguaugccuucgcgcucucucgcggauuuggcuccgguaucauaaccagcaacgcacccauggacgagugugaugccaagugccagacaccucaaggggcuauuaauucgucucugccauuccagaacguucaccccgugaccaucggagaauguccuaaguacguaagauccgccaaauuaaggauggugacgggccugcggaauauuccaucaauccagagucgcggccucuuuggggcaaucgcuggauucauugaggguggcuggacugggauggucgacggaugguauggcuaccaucaccagaacgaacaagguagcggguacgccgcggaucagaaguccacacagaaugccauaaacggcaucaccaauaaagugaacucuguuauugagaagaugaauacucaguuuacagcagugggaaaagaguucaacaagcuagaacgaagaauggagaaucugaacaaaaaggucgacgauggcuucuuggacaucuggaccuauaacgcugaacuacuggugcuccuggagaaugaaaggacgcuugacuuucacgauagcaacguaaagaaucuguacgagaaaguuaagucacaauugaaaaacaaugccaaggaaauagggaacggaugcuucgaguuuuaucauaaauguaauaacgagugcauggaaagugugaagaaugguaccuacgacuaucccaaguacuccgaggaaagcaaacucaaccgggagaagauugauggcgucaaacuggagucuauggggguguaucagaucuuagcuaucuacucaacagucgccaguagccuggugcuacucguuucccugggagcaauuucuuucuggaugugcucgaauggcagccuucagugucguaucugcauuuga

SEQ ID NO: 122313 - RNA, 1698 nt, Artificial Sequence; identical to SEQ ID NO: 122312
  derived and/or modified sequence opt3 from hemagglutinin__InfluenzaA__ABA08486

SEQ ID NO: 122314 - RNA, 1698 nt, Artificial Sequence
  derived and/or modified sequence opt3 from hemagglutinin__InfluenzaA__ABA08508
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuaccggaauuuacuguggcuuaccggaaagaacggcuuguaucccaaucugagcaagucuuacgccaacaauaaaaagaaagaagugcuaauacucuggggcguacaucacccuccaaacaucgggguucagcgcacgcuguacuauacugagaacgcuuacguguccgucgugucaagccacuauagucgacguuucacccccgaaauuacaaagagaccuaaggugagggaucaggagggacggaucaauuacuauuggacucuucuggaaccaggugacaccauuaucuuugaggcaaacggcaauuugauagccccgugguacgcuuucgcccucucucgcggguuuggauccggcauuaucacaagcaacgcgcccauggaugagugugacgcaaaaugccagaccccucaaggugccauuaauucgucucugccauuccagaacguccaucccguuacgaucggggaauguccuaaguaugugagauccgcuaaauuaaggaugguaacuggacugcggaauaucccaucaauucagagucgcggccucuuuggcgccauagcaggguucaucgagggagguuggacaggcaugguggaugggugguacggauaccaccaucagaacgaacaaggcagcgguuaugcugccgaccagaaguccacccagaaugcgauuaacgggaucacuaauaaagucaacucugugauagagaagaugaauacacaguuuaccgccguuggcaaagaguucaacaaacuugaacgaagaauggagaaucugaacaagaaaguggaugacggauucuuggauauuuggacguacaacgcagaacuacugguccuccuggagaaugaaaggacccuugacuuucacgacagcaacgugaagaaucuguaugagaaaguaaagucacaauugaaaaacaaugcuaaggaaaucggcaacgggugcuucgaguuuuaccacaaguguaauaacgagugcauggaaaguguuaaaaauggaacauaugauuaccccaaguauuccgaggaaagcaaacucaaccgggagaagaucgacggugugaaacuggauucuaugggcgucuaccagauuuuagccaucuacucaacuguggcuaguagccugguccuacucgugucccugggggccauuucuuucuggaugugcucgaauggaagccuucagugucguauaugcaucuga

SEQ ID NO: 122315 - RNA, 1698 nt, Artificial Sequence
  derived and/or modified sequence opt3 from hemagglutinin__InfluenzaA__ABA12707
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuaugccuucgcgcucucuagaggguuuggauccggcaucauaaccagcaacgcacccauggacgaaugugaugccaagugccagacaccucaaggugcuauuaauucgucucugccauuccagaacguucaccccgugaccaucggggaguguccuaaauacguaagguccgccaaguuacggauggugacgggacugcgcaauauuccaucaauccagagucgaggccucuuuggcgcaaucgcuggguucauugaaggagguuggacuggcauggucgacgggugguauggauaccaucaccagaacgagcaaggcagcgguuacgccgcggaucagaaauccacacagaaugccauaaacgggaucaccaauaaggugaacucuguuauugaaaagaugaauacucaguuuacagcagugggcaaagaguucaacaaacuugagagaaggauggaaaaucugaacaagaaggucgacgauggauucuuggacaucuggaccuauaacgcugagcuacuggugcuccuggaaaaugagcggacgcuugacuuucacgauagcaacguuaaaaaucuguacgaaaagguaaaaucacaauugaagaacaaugccaaagagauaggcaacgggugcuucgaguuuuaucauaaguguaaugacgaaugcauggagagugugaagaacggaaccuacgauuaucccaaauacuccgaagagagcaagcucaaucgugagaaaauugacggugucaagcuggaaucuaugggcguguaucagaucuuagcuaucuacucaacagucgccaguagccuggugcuacucguuucccugggggcaauuucuuucuggaugugcucgaacggaagccuucagugucgcaucugcauuuga

SEQ ID NO: 122316 - RNA, 1698 nt, Artificial Sequence
  derived and/or modified sequence opt3 from hemagglutinin__InfluenzaA__ABA12715
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuauuacuggacacuucuggaaccaggcgauacuauuaucuuugaggccaacgggaauuugauugcuccgugguaugccuucgcgcucucucgcggauuuggcuccgguaucauaaccagcaacgcacccauggacgagugugaugccaagugccagacaccucaaggggcuauuaauucgucucugccauuccagaacguucaccccgugaccaucggagaauguccuaaguacguaagauccacgaaauuaaggauggugacuggccugcggaauauuccaucaauccagagucgcggccucuuuggggccaucgcaggauucauugaggguggcuggacagggauggucgacggaugguauggcuaccaucaccagaacgaacaagguagcggguacgcugccgaucagaaguccacccagaaugcgauaaacggcaucacuaauaaagugaacucuguuauugagaagaugaauacacaguuuaccgccgugggaaaagaguucaacaagcuagaacgaagaauggagaaucugaacaaaaaggucgacgauggcuucuuggacaucuggacguauaacgcagaacuacuggugcuccuggagaaugaaaggacccuugacuuucacgauagcaacguaaagaaucuguacgagaaaguuaagucacaauugaaaaacaaugcuaaggaaauagggaacggaugcuucgaguuuuaucauaaaugugacaaugagugcauggaaagugugaagaacgguacauacgauuaucccaaguacuccgaggaaagcaaacucaaucgggagaagauugacggcgucaaacuggagucuauggggguguaucagaucuuagccaucuacucaacugucgcuaguagccugguguuccuaguuucccucggagccauuucuuuuuggaugugcucgaacggcagccugcagugucguaucugcauuuga

SEQ ID NO: 122317 - RNA, 1698 nt, Artificial Sequence
  derived and/or modified sequence opt3 from hemagglutinin__InfluenzaA__ABA12729
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuauauauccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuaugccuucgcgcucucuagaggguuuggauccggcauaauuaccagcaacgcacccauggacgaaugugaugccaagugccagacaccucaaggugcuaucaauucgucucugccauuccagaacguccaccccguuaccauuggggaguguccuaaauacgugagguccgccaaguuacggaugguaacgggacugcgcaauaucccaucaauccagagucgaggccucuuuggcgcaauugcuggguucauagaaggagguuggacuggcaugguggacgggugguauggauaccaucaccagaacgagcaaggcagcgguuacgccgcggaucagaaauccacacagaaugccaucaacgggauuaccaauaaggucaacucugugaucgaaaagaugaauacucaguuuacagcaguuggcaaagaguucaacaaacuugagagaaggauggaaaaucugaacaagaagguggacgauggauucuuggacauauggaccuauaacgcugagcuacugguccuccuggaaaaugagcggacgcuugacuuucacgauagcaacgugaaaaaucuguacgaaaagguaaaaucacaauugaagaacaaugccaaagagauuggcaacgggugcuucgaguuuuaucauaaguguaaugacgaaugcauggagaguguuaagaacggaaccuacgauuauccccguuacuccgaagagagcaaacucaaucgcgagaagaucgacggugugaaacuggaaucuaugggcgucuaucagaucuuagcuauuuacucaacaguggccaguagccugguccuacucgugucccugggggcaaucucuuucuggaugugcucgaacggaagccuucaguguagaauuugcauauga

SEQ ID NO: 122318 - RNA, 1701 nt, Artificial Sequence; identical to SEQ ID NO: 122302
  derived and/or modified sequence opt3 from hemagglutinin__InfluenzaA__ABA12740

SEQ ID NO: 122319 - RNA, 1701 nt, Artificial Sequence; identical to SEQ ID NO: 122271
  derived and/or modified sequence opt3 from hemagglutinin__InfluenzaA__ABA12751

SEQ ID NO: 122320 - RNA, 1701 nt, Artificial Sequence
  derived and/or modified sequence opt3 from hemagglutinin__InfluenzaA__ABA12762
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacagguggcauuugcgacagcccacaccagauccuggauggggagaauuguacccuaauagacgcucuccugggagauccgcagugcgacggcuuccaaaacaaaaagugggaucuuuuuguggaaagauccaaagccuauucuaauuguuaccccuaugacgucccugauuacgcaucgcugaggucauugguggccagcagugguacucucgaguucaacaaugaauccuuuaacuggacagggguuacccagaauggaacgucuagcgcuugcaagcggcgcuccaacaauucauucuuuagucgacugaacuggcugacucaucucaaguucaaauauccagcauuaaaugugaccaugcccaacaacgagaaguuugacaaacuguacaucuggggcguccaccauccuggcacagauaaugaccagauuagccuuuaugcccaggcuucugggcguaucacuguguccaccaagagaucacaacagacaguaauuccaaacaucggaagcaggccccggguucgcgauauaccuaguagaauuucuaucuacuggaccauugugaaaccaggugacaucuugcugaucaauuccacgggcaaccuaauugccccgaggggguacuucaagauacggagcggaaagucgucuaucaugcgcuccgacgcgcccauuggcaaauguaauucagagugcaucacuccuaacgguaguauaccaaaugauaagcccuuucagaacgucaaucgaauuacauauggggcauguccuagauacgugaaacagaacacccucaagcuggccacuggaaugaggaaugugccagaaaaacaaacacggggcaucuucggcgcuaucgccggguuuauugagaacggaugggaagguauggucgacggcugguauggguuccgucaccagaauagcgagggaaucggccaggcagcugaucuuaaguccacccaagccgcgauuaaccagauaaaugguaaacugaaccgcuugaucgggaagacgaacgagaaguuccaccagauugaaaaagaguuuucugaaguugagggcagaauccaggaccucgaaaaguacguggaggauaccaaaaucgaccuguggagcuauaaugccgaguuacugguagcacucgaaaaccaacauacaauugaucuuacugacucagagaugaauaagcuguucgaaaggaccaaaaagcaguugcgggagaacgcugaagauaugggaaauggcugcuuuaagauauaccacaaaugugacaacgccugcaucgggaguauucgaaauggaacauaugaucaugacguguaccgcgacgaggcucuaaacaauagauuccagaucaagggugucgagcugaaauccggcuacaaggauuggauucucuggaucagcuuugccauaucuugcuuccugcuuugugugguucuguugggguuuaucaugugggcaugccagaaaggaaacauuagguguaauaucugcauuuga

SEQ ID NO: 122321 - RNA, 1701 nt, Artificial Sequence
  derived and/or modified sequence opt3 from hemagglutinin__InfluenzaA__ABA12773
augaagaccaucauugcccugagcuacauauucugccucgugcuuggccaggacuuucccgggaacgauaauuccacagcuacucuguguuugggacaccaugcagucccuaacgguacguuaguuaaaaccaucacaaaugaccaaauugaggugacuaacgccaccgaacugguacagucuucaaguacaggcaagaucugcaauaacccacacaggauucuagaugggaucgacuguacccucauagaugcgcugcuuggagacccgcauugcgauggcuuccagaaugagacuugggaccuguuuguggaaagaagcaaggcuuucuccaacuguuaucccuacgaugucccugacuaugccucuuugcggucgcucguggcaucaagcgguacacuggaguuuaucaaugaaggguucaccuggacgggaguuacucagaacggcggcaguaaugccugcaaacgcgggccagauuccggauuuuucucucgacugaacuggcucuacaaaagcgguuccaccuaucccguguuaaaugucacaaugccuaacaaugacaacuuugauaagcuguacauuuggggcgugcaccauccaucaacugaccaagagcagaccagucuuuauguacaggcuagcgggcguguuacagugucuaccaagagaucccagcaaacgaucauucccaacaucggaucaaggccuuggguccggggcuugagcagucgcauaucuauuuacuggacuaucgugaaaccaggugacauucuggugaucaauuccaacgggaaucuaaucgcaccgagaggauacuucaagaugaggacaggcaaaagcucgauuaugcggucugaugcccccauaggcaccuguaucuccgagugcauuacuccuaacgggucaaucccaaaugacaagcccuuucagaacgucaauaaaauaacauauggagcuuguccuaaguacguuaagcagaacacccucaaacuggccacggguaugcgcaaugugccagaaaagcagacccgaggccuuuucggggcgauugcaggauuuaucgagaacggcugggaagguaugaucgaugggugguauggcuucagacaccaaaauagugagggaacaggccaggccgcugaccugaaaagcacucaggccgcaauugaucaaaucaacgggaaguugaauaggguaauugagaaaaccaacgaaaaguuccaccagauagagaaagaauuuuccgagguggaaggacggauccaggaccucgagaaguacgucgaggauacaaagauugaccuguggucuuauaaugcugaauuacugguggcccucgagaaccagcauacuaucgaucuuaccgacagcgaaaugaacaaacuguucgagaagacacgucgccaauugagagaaaaugcggaggauauggguaacggcugcuuuaaaaucuaccacaagugugacaaugccugcauugggucaauaaggaacggaaccuaugaccaugauguuuaccgggacgaggcacuaaauaaccgauuccagaucaaaggcguggaacugaagagugguuacaaggauuggauucucuggaucuccuuugcuauuagcugcuuccugcuuugugucgugcuguugggguuuaucaugugggccugccagaaaggcaauauacgcuguaacaucugcauuuga

SEQ ID NO: 122322 - RNA, 1701 nt, Artificial Sequence
  derived and/or modified sequence opt3 from hemagglutinin__InfluenzaA__ABA12780
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacaaauaacgaucagauuagcuuguaugcccaggcuucugggcguaucacuguguccaccaagagaucacaacagacaguaauuccaaauaucgagagcaggccccggguucgcgacauaccuaguagaauuucuaucuacuggaccauugugaaaccaggagauauccugcuaaucaacuccacggguaaucucauugccccgaggggcuacuuuaagauacggagcgggaagucgucuaucaugcgcuccgacgcgcccauuggaaaauguaacucagaaugcaucacuccuaauggcaguauaccaaacgacaagcccuuccagaaugucaaccgaauuacauauggugcauguccuagauacgugaaacagaauacccugaaacuugccacugggaugaggaacgugccagagaagcaaacacggggaaucuuuggcgcuaucgccggcuucauugaaaaugggugggagggaauggucgaugguugguauggcuuucgucaccagaacagcgaggggaucggacaggcagcugaccugaaguccacccaagccgcgauuaaucagauaaacggcaaauugaaccgccucaucgguaagacgaaugaaaaguuccaccagauugagaaagaguucucugaaguugaagggagaauccaggaucuggagaaguacguggaggacaccaaaaucgauuuauggagcuauaacgccgaacugcucguagcacuugagaaucaacauacaauugaccugacugauucagaaaugaacaaguuguuugagaggaccaaaaagcagcuacgggaaaaugcugaggacaugggcaacggaugcuucaagauauaccacaaaugugauaaugccugcaucggcaguauucgaaacgggacauaugaccaugauguguaccgcgacgaggcucugaauaacagauuucagaucaagggagucgaacucaaauccgguuacaaggacuggauucuguggaucagcuucgccauaucuugcuuucuucuguguguggcauugcucggcuucaucaugugggccugccagaaagggaauauuagguguaacaucugcauuuga

SEQ ID NO: 122323 - RNA, 1701 nt, Artificial Sequence
  derived and/or modified sequence opt3 from hemagglutinin__InfluenzaA__ABA16214
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcaaaaauuguacccucaucgacgcucugcuuggggauccgcauugcgacggauuucagaacgagaagugggaucuguucguggaacggucuaaagccuuuucgaauuguuaucccuacgacgucccugauuaugcaucauugcgcagccucguggccaguuccggcacucuggaguucauaaacgaagguuuuaauuggacagggguuacccagucuggaggcagcuacgcuugcaagcgaggcuccgugaagucauucuuuagucgucugaacuggcucuaugagagcgagucuaaauacccagcauuaaaugucacgaugcccaacaaugggaaguucgacaaacuguauaucuggggagugcaccauccuuccacugauaaggaacaaaccaaccuuuacguaagagccucagguaggguuacagugagcacuaaacggagucagcagaccgucauuccaaauaucggcccccgcccuugggugagaggguugucuuccaggauuagcaucuacuggacaauagugaagccaggagacauucugcuaaucaacucgaccggcaaccucauugcuccgcgggguuauuuuaagauccgcacggggaaaucuuccaucaugcgaucagaugcccccauuggaacuuguaguagcggcugcauaacaccuaauggcuccaucccaaacgacaagcccuuccagaaugucaacaaaauuaccuacggggcguguccuagauauguuaagcaaaauacucugaaacuugcaacaggaaugaggaacgugccagagaagcagacccgggguaucuuuggcgccauagcuggguucauugaaaauggaugggagggcaugguagacgguugguacggguuucgucaccagaacucugagggcacgggacaggccgcagaucugaaaagcacccaagcugccaucgaccagaucaauggcaaguugaaccgccucauugaaaagacaaaugagaaauuccaccagaucgaaaaggaguucucagaaguggaggggaggauucaagaucuggagaaauaugucgaagacacuaagauagauuuauggaguuacaacgcggagcugcucguggcccuugaaaaucagcauaccaucgacaugacagauuccgagaugaacaaacuguuugaaaagacuagaaagcaguugcgggagaaugcagaggacaugggaaacgguugcuucaaaauuuaucacaagugugauaacgcuugcaucggcagcauccgaaaugggaccuacgaccaugauguuuaccgcgacgaagcccuaaacaauagauuucagauuaaaggaguggagcugaagucuggcuauaaagacuggauacucuggaucucauucgcuauuaguugcuuucugcuuugugucgugcuguuggguuucaucaugugggccugccaaaaggggaacauuagguguaauaucugcauauga

SEQ ID NO: 122324 - RNA, 1701 nt, Artificial Sequence; identical to SEQ ID NO: 122272
  derived and/or modified sequence opt3 from hemagglutinin__InfluenzaA__ABA18026

SEQ ID NO: 122325 - RNA, 1698 nt, Artificial Sequence
  derived and/or modified sequence opt3 from hemagglutinin__InfluenzaA__ABA18037
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugaaggagcaacucucuucgguuagcucauucgaaagauuugagauuuucccuaaggguaguuccuggccaaaucauacagugaccggggucucugcaagcugcucccacaacggaaaaucaaguuuuuacaggaauuuacuguggcuuacgggcaagaacggcuuguaucccaaucugagcaugucuuacgugaacaauaaagagaaggaaguucuaguacucuggggagugcaucacccuccaaacaucggggaucagcgggcccuguaccacacugagaacgcuuaugucuccguggugucaagccauuacagucgccgauucacccccgaaauagcaaaacguccuaaggucagagaccaggaggguaggaucaauuauuacuggacacuucuggaaccaggcgauacuauuaucuuugaggccaacgggaauuugauugcuccgugguaugccuucgcgcucucucggggauuuggcuccgguaucauaaccagcaacgcacccauggacgagugugaugccaagugccagacaccucaaggggcuauuaauucgucucugccauuccagaacguucaccccgugaccaucggagaauguccuaaauacguacgcuccgccaaguuaagaauggugacgggccugaggaauauuccaucaauccagagucggggccucuuuggggcaaucgcuggauucauugaggguggcuggacugggauggucgacggaugguauggcuaccaucaccagaacgaacaagguagcggguacgccgcggaucagaaauccacacagaaugccauaaacggcaucaccaauaaggugaacucuguuauugagaaaaugaauacucaguuuacagcagugggaaaggaguucaacaaacuugaacgccgaauggagaaucugaacaagaaggucgacgauggcuucuuggacaucuggaccuauaacgcugaacuacuggugcuccuggagaaugaaagaacgcuugacuuucacgauagcaacguuaaaaaucuguacgagaagguaaaaucacaauugaagaacaaugccaaagaaauagggaacggaugcuucgaguuuuaucauaaguguaauaacgagugcauggaaagugugaagaaugguaccuacgacuaucccaaauacuccgaggaaagcaagcucaacagggagaaaauugauggcgucaagcuggagucuauggggguguaucagaucuuagcuaucuacucaacagucgccaguagccuggugcuacucguuucccugggagcaauuucuuucuggaugugcucgaauggcagccuucagugucggaucugcauuuga

SEQ ID NO: 122326 - RNA, 1701 nt, Artificial Sequence; identical to SEQ ID NO: 122271
  derived and/or modified sequence opt3 from hemagglutinin__InfluenzaA__ABA18048

SEQ ID NO: 122327 - RNA, 1701 nt, Artificial Sequence
  derived and/or modified sequence opt3 from hemagglutinin__InfluenzaA__ABA18123
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccaacaagucauuuuucagucgucucaauugguuacaccagcugaaguauaaauacccagcacuuaacgucacgaugcccaauaacgagaaguuugacaaauuguauauauggggagugcaucacccuggcacugauagcgaccagaucucucuguacgcccaggcuuccggcagaguaaccguuucaacaaagaggagccaacagacugugauuccaaacaucgggaguggacccuggguccggggugugucuucccgcauuagcaucuacuggaccauagugaaaccuggcgauauucuacucaucaauucgacagggaaccugauugccccaagaggauauuucaagaucaggucuggcaaguccucaaucaugcggagugacgcgccgauugguaaauguaauagcgaaugcauaacccccaacggguccaucccuaaugacaagccauuucagaacgucaaucgcauuacguacggagcauguccccgauauguuaaacagaacacucuuaagcuggccacaggcaugagaaaugugccugagaaacaaaccaggggcaucuucggggcuauagccggauuuauugaaaacgguugggagggcaugauggaugggugguacggauuccggcaccagaauagcgagggcacuggucaggcagcugacuugaagucuacacaagccgcgaucaaccagaucaaugggaaacucaaccgucugauugaaaagaccaaugagaaguuucaucagaucgaaaaagaguucucagaaguagagggccgcauucaggauuuagagaaguauguggaagacacgaaaauagaucuguggaguuacaacgccgagcuccuugucgcacuggaaaaccaacacaccaucgacuugacagauuccgagaugaauaagcuauucgaaagaacuaaaaagcagcugagggagaacgcugaggacaugggaaauggcugcuuuaagauuuaucauaaaugugauaacgccugcaucgggagcauccggaauggaaccuacgaccacgauguguaccgagacgaagcucucaacaaucgcuuccagauuaaggguguugagcugaaaucuggcuauaaggacuggauacuuuggaucucauuugccauuaguugcuuccuguuguguaucgugcuccugggguuuauuaugugggcaugccagaaaggaaacaucagauguaauauaugcaucuga

SEQ ID NO: 122328 - RNA, 1701 nt, Artificial Sequence; identical to SEQ ID NO: 122271
  derived and/or modified sequence opt3 from hemagglutinin__InfluenzaA__ABA18134

SEQ ID NO: 122329 - RNA, 1698 nt, Artificial Sequence; identical to SEQ ID NO: 122315
  derived and/or modified sequence opt3 from hemagglutinin__InfluenzaA__ABA18145

SEQ ID NO: 122330 - RNA, 1701 nt, Artificial Sequence; identical to SEQ ID NO: 122272
  derived and/or modified sequence opt3 from hemagglutinin__InfluenzaA__ABA18156

SEQ ID NO: 122331 - RNA, 1701 nt, Artificial Sequence
  derived and/or modified sequence opt3 from hemagglutinin__InfluenzaA__ABA26700
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcaauagcccacaccagauccuagacggggagaacuguacccucauagaugcucugcuuggagacccgcagugcgauggcuuucaaaauaaaaagugggaccuguucguggaaagauccaaagccuauucuaacuguuaccccuaugaugucccugacuacgcaucguugaggucacucguggccagcagugguacucuggaguuuaauaacgaauccuucaauuggacagggguuacccagaacggaacgucuagcgcuugcaagcggcgcuccaauaacucauuuuucagucgacugaauuggcucacucauuuaaaguuuaaauauccagcacugaacgugaccaugcccaacaaugagaaguucgauaaacuuuacaucuggggcguccaccauccuggcacagacaacgaucagauuagcuuguaugcccaggcuccagggcguaucacugugucuaccaagagaucccaacagacaguaauucccaauaucggaucaaggccucggguucgcgacauaccaagcagaauuaguaucuacuggaccauugugaaaccgggugauauccugcuaaucaacucuacgggcaaucucauugcccccaggggguacuuuaagauacgguccggaaagagcucgaucaugcgcucugacgcgccuauuggcaaauguaacuccgagugcaucacuccaaaugguucaauacccaacgacaagccuuuccagaaugucaaccgaauuacauauggggcauguccaagauacgugaaacagaauacccugaagcuggccacuggaaugaggaacgugcccgaaaaacaaacacggggcaucuuuggcgcuaucgccggguucauugagaauggaugggaagguauggucgauggcugguauggguuucgucaccagaacagugagggaaucggccaggcagcugaccuuaagagcacccaagccgcgauuaaucagauaaacgguaaauugaaccgccucaucgggaagacgaaugagaaguuccaccagauugaaaaagaguucuccgaaguugagggcagaauccaggaucuggaaaaguacguggaggacaccaaaaucgauuuauggucuuauaacgccgagcugcucguagcacuugaaaaucaacauacaauugaccugacugauagcgagaugaacaaguuguuugaaaggaccaaaaagcagcuacgggagaaugcugaagacaugggaaacggcugcuucaagauauaccacaaaugugauaaugccugcaucgggucaauucgaaacggaacauaugaccaugauguguaccgcgacgaggcucugaauaacagauuucagaucaagggugucgagcucaaaaguggcuacaaggacuggauucuguggaucuccuucgccauaagcugcuuucuucuguguguggcauugcucggguucaucaugugggccugccagaaaggaaauauuagguguaacaucugcauuuga

SEQ ID NO: 122332 - RNA, 1701 nt, Artificial Sequence
  derived and/or modified sequence opt3 from hemagglutinin__InfluenzaA__ABA26711
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaagucagagugcaucacuccuaaugguaguauaccaaacgauaaacccuuccagaaugucaaccgaauuacauauggggcauguccuagauacgugaagcagaauacccugaaacuugccacuggaaugaggaacgugccagaaaagcaaacacggggcaucuuuggcgcuaucgccggguucauugagaauggaugggaagguauggucgacggcugguauggguuucgucaccagaacagcgagggaaucggccaggcagcugaucugaaauccacccaagccgcgauuaaucagauaaacgguaaguugaaucgccucaucgggaagacgaacgagaaauuccaccagauugaaaaggaguucucugaaguugagggcagaauccaggaccuggaaaaauacguggaggauaccaagaucgacuuauggagcuauaacgccgagcugcucguagcacuugaaaaucaacauacaauugaucugacugacucagagaugaacaaauuguuugaaaggaccaagaagcagcuacgggagaaugcugaagauaugggaaacggcugcuucaaaauauaccacaagugugacaaugccugcaucgggaguauucgaaacggaacauaugaucaugacguguaccgcgacgaggcucugaauaacagauuucagaucaaaggugucgagcucaaguccggcuacaaagauuggauucuguggaucagcuucgccauaucuugcuuucuucuguguguggcauugcucggguucaucaugugggccugccagaagggaaauauuagguguaacaucugcauuuga

SEQ ID NO: 122333 - RNA, 1701 nt, Artificial Sequence
  derived and/or modified sequence opt3 from hemagglutinin__InfluenzaA__ABA26722
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaccaacagguggcauuugcgacaguccgcaccagauccuagauggggagaauuguacccucauagacgcucugcuuggagauccccagugcgacggcuuucaaaacaaaaagugggaucuguucguggaaagaagcaaagcccauuccaauuguuauccuuacgacgucccagauuaugcaucuuugaggucgcucguggccucaagcgguacucuggaguuuaacaaugaaaguuucaacuggacagggguuacccagaauggaacguccucugcuugcaagcggcgcagcaacaaguccuuuuucucacgacugaauuggcucacucacuuaaaauuuaaguaccccgcacugaacgugaccaugccuaauaacgagaaauucgacaaacuuuauaucuggggcguccaucacccaggcacagauaacgaccagauuaguuuguacgcccaggcuagcgggcguaucacugugucuaccaagagaucccaacagacaguaauucccaauaucggaucaaggccucggguucgcgaugugccaagcagaauaaguauuuauuggaccaucgucaagccgggugacauucugcuaaucaacucuacgggcaaucucaucgcccccaggggguacuuuaagauucgguccggaaaaagcucgauaaugcgcucugacgcgccuaucggcaaguguaacuccgguugcauuacuccaaaugggucaauccccaacgauaaaccuuuccagaaugugaaccgaauaacauacggagcauguccaagauaugugaagcagaauacccugaaacuugccacuggcaugaggaacguccccgagaagcaaacacggggcauuuuuggggcuaucgccggauucaucgaaaaugguugggagggcaugguugacgggugguacggauuucgucaccagaacagugaaggcaccggucaggcagcugaucugaaaagcacgcaagccgcgauuaaucagaucaacgggaaguugaaucgccucauuggcaagaccaacgagaaauuccaucagauagagaaggaguucuccgaaguggaaggaagaauccaggaccuggagaaauauguagaagauacaaagauugacuuauggucuuacaacgccgagcugcucguggcacuugagaaucaacacacuaucgaucugaccgacagcgaaaugaacaaauuguuugagaggacaaagaagcagcuacgggaaaaugcugaggauaugggcaacgggugcuucaaaaucuaucauaagugugacaaugccugcauuggaucaauacgaaacgguacuuacgaucacgacgucuaucgcgacgaagcucugaauaacagauuucagaucaaaggcguggagcucaagaguggguacaaagauuggauucuguggaucuccuucgccauuagcugcuuucuucuguguguugcauugcucggauucaucaugugggccugccagaagggcaauauaagguguaacaucugcauuuga

SEQ ID NO: 122334 - RNA, 1701 nt, Artificial Sequence; identical to SEQ ID NO: 122259
  derived and/or modified sequence opt3 from hemagglutinin__InfluenzaA__ABA26733

SEQ ID NO: 122335 - RNA, 1701 nt, Artificial Sequence; identical to SEQ ID NO: 122259
  derived and/or modified sequence opt3 from hemagglutinin__InfluenzaA__ABA26755

SEQ ID NO: 122336 - RNA, 1701 nt, Artificial Sequence; identical to SEQ ID NO: 122298
  derived and/or modified sequence opt3 from hemagglutinin__InfluenzaA__ABA26766

SEQ ID NO: 122337 - RNA, 1701 nt, Artificial Sequence; identical to SEQ ID NO: 122298
  derived and/or modified sequence opt3 from hemagglutinin__InfluenzaA__ABA26788

SEQ ID NO: 122338 - RNA, 1701 nt, Artificial Sequence; identical to SEQ ID NO: 122298
  derived and/or modified sequence opt3 from hemagglutinin__InfluenzaA__ABA26799

SEQ ID NO: 122339 - RNA, 1698 nt, Artificial Sequence
  derived and/or modified sequence opt3 from hemagglutinin__InfluenzaA__ABA42247
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuacaaaaauuuacuguggcuuacgggaaagaacggcuuguaucccaaucugagcaaaucuuacgcaaacaauaaggaaaaagagguacuuguucucuggggcgugcaucacccuccaaacaucggggaucagcgggcccuguaccacacugaaaacgcuuaugucuccguggugucaagccauuacagucgccgauucacccccgagauagcaaagcguccuaaggucagagaccaggaaggaaggaucaauuauuacuggacacuucuggagccaggugauacuauuaucuuugaggccaacggcaauuugauugcuccgcgguaugccuucgcgcucucucgcggguuuggauccggcaucauaaccagcaacgcacccauggacgaaugugaugccaaaugccagacaccucaaggugcuauuaauucgucucugccauuccagaacguucaccccgugaccaucggggaguguccuaaguacguaagauccgccaaauuaaggauggugacgggacugcggaauauuccaucaauccagagucgcggccucuuuggcgcaaucgcuggguucauugaaggagguuggacuggcauggucgacgggugguauggauaccaucaccagaacgagcaaggcagcgguuacgccgcggaucagaaguccacacagaaugccauaaacgggaucaccaauaaagugaacucuguuauugaaaagaugaauacucaguuuacagcagugggcaaagaguucaacaagcuagagcgaagaauggaaaaucugaacaagaaagucgacgauggauucuuggacaucuggaccuauaacgcugagcuacuggugcuccuggaaaaugagaggacgcuugacuuucacgauagcaacguaaagaaucuguacgaaaaaguuaagucacaauugaaaaacaaugccaaggagauaggcaacgggugcuucgaguuuuaucauaaguguaaugacgaaugcauggagagugugaaaaacggaaccuacgauuaucccaaguacuccgaagagagcaaacucaaucgggagaagauugacggugucaaacuggaaucuaugggcguguaucagaucuuagcuaucuacucaacagucgccaguagccuggugcuacucguuucccugggggcaauuucuuucuggaugugcucgaacggaagccuucagugucguaucugcauuuga

SEQ ID NO: 122340 - RNA, 1698 nt, Artificial Sequence; identical to SEQ ID NO: 122312
  derived and/or modified sequence opt3 from hemagglutinin__InfluenzaA__ABA42258

SEQ ID NO: 122341 - RNA, 1701 nt, Artificial Sequence; identical to SEQ ID NO: 122271
  derived and/or modified sequence opt3 from hemagglutinin__InfluenzaA__ABA42269

SEQ ID NO: 122342 - RNA, 1698 nt, Artificial Sequence
  derived and/or modified sequence opt3 from hemagglutinin__InfluenzaA__ABA42280
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuaccggaauuuacuguggcuuaccggcaaaaacggauuguaucccaaucugagcaagucuuacgccaacaauaaagaaaaggaggugcuaauacucuggggcguacaucacccuccaaacaucggggaucagcgcacgcuguaccacacugaaaacgcuuauguuuccguggucucaagccauuacagucgacguuucacccccgagauuacaaaaagaccuaaggugagggaccaggaaggacggaucaauuauuacuggacucuucuggagccaggugauaccauuaucuuugaggcaaacggcaauuugauagccccgugguaugcuuucgcccucucucgcggguuuggauccggcauuaucacaagcaacgcgcccauggacgaaugugaugcaaagugccagaccccucaaggugccauuaauucgucucugccauuccagaacgugcaccccgucacgaucggggaguguccuaaauacguuagauccgcuaaguuaaggauggugacuggacugcggaauaucccaucaauucagagucgcggccucuuuggcgccauagcaggguucaucgaaggagguuggacaggcaugguagacgggugguauggauaccaucaccagaacgagcaaggcagcgguuacgcugccgaucagaaauccacccagaaugcgauuaacgggaucacuaauaaggugaacucugucauagaaaagaugaauacacaguuuaccgccgugggcaaagaguucaacaaacuugagcgaagaauggaaaaucugaacaagaagguugacgauggauucuuggacauuuggacguauaacgcagagcuacuggugcuccuggaaaaugagaggacccuugacuuucacgauagcaacgucaaaaaucuguacgaaaaggugaaaucacaauugaagaacaaugcuaaagagaucggcaacgggugcuucgaguuuuaucauaaguguaauaacgaaugcauggagaguguaaagaauggaacauacgacuaucccaaauacuccgaagagagcaagcucaaccgggagaaaaucgaugguguuaagcuggacucuaugggcguguaucagauuuuagccaucuacucaacugucgcuaguagccuggugcuacucgucucccugggggccauuucuuucuggaugugcucgaauggaagccuucagugucguauaugcaucuga

SEQ ID NO: 122343 - RNA, 1701 nt, Artificial Sequence
  derived and/or modified sequence opt3 from hemagglutinin__InfluenzaA__ABA42291
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaagucagagugcaucacuccuaaugguaguauaccaaacgauaaacccuuccagaaugucaaccgaauuacauauggggcauguccuagauacgugaagcagaauacccugaaacuugccacuggaaugaggaacgugccagaaaagcaaacacggggcaucuuuggcgcuaucgccggguucauugagaauggaugggaagguauggucgacggcugguauggguuucgucaccagaacagcgagggaaucggccaggcagcugaucugaaauccacccaagccgcgauuaaucagauaaacgguaaguugaaucgccucaucgggaagacgaacgagaaauuccaccagauugaaaaggaguucucugaaguugagggcagaauccaggaccuggaaaaauacguggaggauaccaagacagacuuauggagcuauaacgccgagcugcucguagcacuugaaaaucaacauacuaucgaucugaccgacucagagaugaacaaauuguuugaaaggacaaagaagcagcuacgggagaaugcugaagauaugggaaacggcugcuucaaaauuuaccacaagugugacaaugccugcauagggaguauccgaaacggaacuuaugaucaugacguguaccgcgacgaggcucugaauaacagauuucagauuaaaggugucgagcucaaguccggcuacaaagauuggauccuguggauuagcuucgccaucucuugcuuucuucuguguguggcauugcucggguucauaaugugggccugccagaagggaaauaucagguguaacauuugcaucuga

SEQ ID NO: 122344 - RNA, 1701 nt, Artificial Sequence; identical to SEQ ID NO: 122067
  derived and/or modified sequence opt3 from hemagglutinin__InfluenzaA__ABA42302

SEQ ID NO: 122345 - RNA, 1701 nt, Artificial Sequence; identical to SEQ ID NO: 122121
  derived and/or modified sequence opt3 from hemagglutinin__InfluenzaA__ABA42313

SEQ ID NO: 122346 - RNA, 1701 nt, Artificial Sequence; identical to SEQ ID NO: 122067
  derived and/or modified sequence opt3 from hemagglutinin__InfluenzaA__ABA42346

SEQ ID NO: 122347 - RNA, 1701 nt, Artificial Sequence; identical to SEQ ID NO: 122121
  derived and/or modified sequence opt3 from hemagglutinin__InfluenzaA__ABA42357

SEQ ID NO: 122348 - RNA, 1701 nt, Artificial Sequence
  derived and/or modified sequence opt3 from hemagglutinin__InfluenzaA__ABA42379
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccaaaauuagcaucuacuggaccauagugaagccuggugacauucuacucaucaacucgacaggcaaucugauugccccaagaggguauuucaagaucaggucuggaaaauccucaaucaugcggagugacgcgccgauuggcaaguguaacagcgaaugcauaacccccaaugguuccaucccuaacgauaaaccauuucagaaugucaaccgcauuacguacgggcccuguccucgauauguuaagcagaauacucuuaaacuggcaacaggaaugagaaacgugccagagaagcaaaccaggggcaucuucggcgccauagcuggguuuauugaaaauggaugggaggguaugauggacggcugguacggguuccggcaccagaacucugagggaacuggccaggccgcagauuugaaaagcacacaagcugccaucaaucagaucaacgguaagcucaaucgucugauugaaaagaccaacgagaaauuucaucagaucgaaaaggaguucucagaaguagaggggcgcauucaggacuuagagaaauauguggaagauacgaagauagaccuguggaguuacaaugcggagcuccuugucgcccuggaaaaccaacacaccaucgauuugacagacuccgagaugaacaaacuauucgaaagaacuaagaagcagcugagggagaaugcagaggauaugggcaacggaugcuuuaaaauuuaucauaagugugacaaugcuugcaucggcagcauccggaacgggaccuacgaucacgacguguaccgagacgaagcccucaauaaccgcuuccagauuaaaggaguugagcugaagucugguuauaaagauuggauacuuuggaucucauuugcuauuaguugcuucgugcuguguaucgucuugcucggcuuuauuaugugggccugccagaaggggaauaucagauguaacauaugcaucuga

SEQ ID NO: 122349 - RNA, 1701 nt, Artificial Sequence; identical to SEQ ID NO: 122096
  derived and/or modified sequence opt3 from hemagglutinin__InfluenzaA__ABA42390

SEQ ID NO: 122350 - RNA, 1701 nt, Artificial Sequence
  derived and/or modified sequence opt3 from hemagglutinin__InfluenzaA__ABA42401
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagaguuucuucagccgucucaacugguuacaccagcugaaguauaaauacccagcacuuaaugucacgaugcccaacaaugagaaguuugauaaauuguauauauggggagugcaucacccugggacugacucugaucagaucucccuguacgcccagucaagcggcagaguaaccguuaguacaaagaggucucaacagacugugauuccaaacaucggcuccgggcccuggguccggggagugagcucgcgcauuucuaucuacuggaccauagugaaaccuggugacauucuacucaucaacuccacaggcaaucugauugcuccaagaggguauuucaagaucaggucaggaaagaguagcaucaugcgguccgacgccccgauuggcaaauguaacucuaagugcauaacccccaaugguagcaucccuaacgauaaaccauuucagaaugucaaccgcauuacguacggggcguguccccgauauguuaagcagaauacucuuaaacuggcaacaggaaugagaaacgugccugaaaagcaaaccaggggcaucuucggcgccauagcuggguuuauugagaauggaugggaagguaugauggacggcugguacggguuccggcaccagaacucagagggaacuggccaggccgcagauuugaaaaguacacaagcugccaucaaucagaucaacgguaagcucaaucgucugauugagaagaccaacgaaaaauuucaucagaucgagaaggaauuuuccgagguagaagggcgcauucaggacuuagagaaauauguggaggauacgaagauagaccuguggagcuacaaugcggaacuccuugucgcccuggagaaccaacacaccaucgauuugacagacucugaaaugaacaaacuauucgagagaacuaagaagcagcugagggaaaaugcagaggauaugggcaacggaugcuuuaaaauuuaucauaagugugacaaugcuugcaucggcucaauccggaacgggaccuacgaucacgacguguaccgagacgaggcccucaauaaccgcuuccagauuaaaggaguugaacugaagagugguuauaaagauuggauacuuuggaucagcuuugcuauuuccugcuuccuguuguguaucgugcuccugggcuuuauuaugugggccugccagaaggggaauaucagauguaacauaugcaucuga

SEQ ID NO: 122351 - RNA, 1701 nt, Artificial Sequence
  derived and/or modified sequence opt3 from hemagglutinin__InfluenzaA__ABA42412
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccaaaauuagcaucuacuggaccauagugaagccuggugacauucuacucaucaacucgacaggcaaucugauugccccaagaggguauuucaagaucaggucuggaaaauccucaaucaugcggagugacgcgccgauuggcaaguguaacagcgaaugcauaacccccuccgguucuaucccuaaugauaaaccauuucagaacgucaaucgcauuacguacgggcccuguccucgauauguuaagcagaacacucuuaaacuggcaacaggaaugagaaaugugccagagaagcaaaccaggggcaucuucggcgccauagcuggguuuauugaaaacggaugggaggguaugauggacggcugguacggguuccggcaccagaauagcgagggaacuggccaggccgcagauuugaaaucaacacaagcugccaucaaccagaucaaugguaagcucaaccgucugauugaaaagaccaaugagaaauuucaucagaucgaaaaggaguucagugaaguagaggggcgcauucaggacuuagagaaauauguggaagauacgaagauagaccugugguccuacaacgcggagcuccuugucgcccuggaaaaucaacacaccaucgauuugacagacagcgagaugaacaaacuauucgaaagaacuaagaagcagcugagggagaacgcagaggauaugggcaauggaugcuuuaaaauuuaucauaagugugacaacgcuugcaucggcucuauccggaaugggaccuacgaucacgacguguaccgagacgaagcccucaacaaucgcuuccagauuaaaggaguugagcugaagucagguuauaaagauuggauacuuuggaucaguuuugcuauuagcugcuuccuguuguguaucgugcuccugggcuuuauuaugugggccugccagaaggggaacaucagauguaauauaugcaucuga

SEQ ID NO: 122352 - RNA, 1701 nt, Artificial Sequence; identical to SEQ ID NO: 122063
  derived and/or modified sequence opt3 from hemagglutinin__InfluenzaA__ABA42443

SEQ ID NO: 122353 - RNA, 1701 nt, Artificial Sequence; identical to SEQ ID NO: 122067
  derived and/or modified sequence opt3 from hemagglutinin__InfluenzaA__ABA42454

SEQ ID NO: 122354 - RNA, 1701 nt, Artificial Sequence
  derived and/or modified sequence opt3 from hemagglutinin__InfluenzaA__ABA42465
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaguaaccguuagcacaaagaggagucaacagacugugauuccaaacaucggcucucggcccugggggcgcggagucuccagcagaauuucgaucuacuggaccauagugaaaccuggugacauucuacucaucaacucuacaggcaaucugauugccccaaggggguauuucaagauccgguccggaaagucaaguaucaugcgcagcgacgcgccgauuggcaaauguaacuccgaaugcauaacccccaaugguucuaucccuaacgauaagccauuucagaaugugaaccgaauuacguacggggcaugucccagauaugucaaacagaauacucuuaagcuggccacaggaaugaggaacguuccugagaaacaaacccggggcaucuucggcgcuauagccggguuuauugaaaauggaugggaggguaugauggacggcugguacggguuccgucaccagaacagcgagggaacuggccaggcagcugauuugaagucaacacaagccgcgaucaaucagaucaacgguaaacucaaucgccugauugaaaagaccaacgagaaguuucaucagaucgaaaaagaguucagugaaguggaggggaggauucaggacuuagagaaguauguagaagauacgaaaauagaccugugguccuacaaugccgagcuccuuguggcacuggaaaaccaacacaccaucgauuugacagacagcgagaugaacaagcuauucgaaagaacuaaaaagcagcugcgggagaaugcugaggauaugggcaacggaugcuuuaagauuuaucauaaaugugacaaugccugcaucggcucuauccgaaacgggaccuacgaucacgacgucuaccgcgacgaagcucucaauaacagauuccagauuaagggaguggagcugaaaucagguuauaaggauuggauacuuuggaucaguuuugccauuagcugcuuccuguuguguaucguucuccugggcuuuauuaugugggcaugccagaaagggaauaucagguguaacauaugcaucuga

SEQ ID NO: 122355 - RNA, 1701 nt, Artificial Sequence
  derived and/or modified sequence opt3 from hemagglutinin__InfluenzaA__ABA42476
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacgggcccuguccuagauauguuaaacagaauacucuuaagcuggcaacaggaaugaggaacgugccagagaaacaaacccggggcaucuucggcgccauagcuggguuuauugaaaauggaugggaggguaugauggacggcugguacggguuccgucaccagaacucugagggaacuggccaggccgcagaucuaaagagcacacaagcugccaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugcggagcuccuugucgcccuggaaaaccaacacaccaucgauuugacagacuccgagaugaacaagcuauucgaaagaacuaaaaagcagcugcgggagaaugcagaggauaugggcaacggaugcuuuaagauuuaucauaaaugugacaaugcuugcaucggcagcauccgaaacgggaccuacgaucacgacguguaccgcaaugaagcccucaacaauagauuccagauuaagggaguugagcugaaaucugguuauaaggacuggauacuuuggaucucauuugcuauuaguugcuuccuguuguguaucgugcuccugggcuuuauuaugugggccugccagaaagggaacaucagguguaauauaugcaucuga

SEQ ID NO: 122356 - RNA, 1701 nt, Artificial Sequence
  derived and/or modified sequence opt3 from hemagglutinin__InfluenzaA__ABA42498
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaguaaccguuagcacaaagaggagucaacagacugugauuccaaacaucggcucucggcccuggguccgcgggguguccagcauuaucucgauauacuggaccauugugaaaccuggagacauccuacucauuaacucuacagguaaucugaucgccccaagaggcuauuucaagaucagguccgggaagucaaguauuaugcggagcgacgcgccgauaggaaaauguaacuccgaaugcaucacccccaauggcucuauuccuaacgauaagccauuucagaaugucaaccgcaucacguacggugcauguccccgauauguuaaacagaauacucuuaagcuggccacagggaugagaaacgugccugagaaacaaaccaggggaauauucggcgcuauugccggcuuuaucgaaaaugggugggagggaaugauggacgguugguacggcuuccggcaccagaacagcgaggggacuggacaggcagcugauuugaagucaacacaagccgcgaucaaucagauuaacggcaaacucaaucgucugaucgaaaagaccaacgagaaguuucaucagauugaaaaagaguucagugaaguagagggucgcauacaggacuuagagaaguauguggaagauacgaaaaucgaccugugguccuacaaugccgagcuccuugucgcacuggaaaaccaacacaccauugauuugacagacagcgagaugaacaagcuauucgaaagaacuaaaaagcagcugagggagaaugcugaggauauggggaacggcugcuuuaagaucuaucauaaaugugacaaugccugcaucggaucuauucggaacggcaccuacgaucacgacguguaccgagacgaagcucucaauaaccgcuuccagauaaaggggguugagcugaaaucaggauauaaggauuggauccuuuggauuaguuuugccaucagcugcuuccuguuguguauugugcuccuggguuuuaucaugugggcaugccagaaaggcaauauaagauguaacaucugcauuuga

SEQ ID NO: 122357 - RNA, 1701 nt, Artificial Sequence; identical to SEQ ID NO: 122088
  derived and/or modified sequence opt3 from hemagglutinin__InfluenzaA__ABA42509

SEQ ID NO: 122358 - RNA, 1701 nt, Artificial Sequence
  derived and/or modified sequence opt3 from hemagglutinin__InfluenzaA__ABA42520
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugauuauauugagguaacuaacgcgaccgaacuugugcaaucuucaaguacaggaagaaucugcgacagcccacaccagauucucgauggugagaauuguacccugaucgacgcucuacugggcgauccgcauugcgacggguuucagaacaaagaaugggauuuguucgucgagagguccacugccuacucuaauuguuaucccuacgacgugccugauuaugcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaccaacugaaguacaaguauccagcccuuaaugucacuaugcccaacaaugagaaauuugacaaguuguacaucuggggagugcaucacccuagcaccgauucugaccagauuucccuguacgcucaggccucagggagaguaacaguuagcacuaaaaggagucagcaaaccgugaucccaaacauuggcucucggcccuggguccgcggcguguccagcaucauaucgauuuauuggacaaucgugaagccuggggauauucuacucaucaacucuaccggaaaucugaucgcgccaagagguuacuucaaaauuagguccggcaagucaaguauaaugcggagcaacgcaccgaucgggaaguguaauuccgaaugcauuacgcccaacggaucuaucccuaaugacaaaccauuucagaacgucaaucgcauaacuuauggcgccuguccccgauacguuaagcagaacacacuuaaacuggcuaccgguaugagaaaugugccugagaagcagacuagggggauuuucggagccaucgcaggcuuuaucgaaaacggcugggaggggaugguagacggaugguaugguuuccggcaccaaaauagcgagggcacagggcaggcugccgauuugaaaucaacccaggcggccauuaaccaaaucaauggaaagcucaaccgucugauugagaaaacgaaugaaaaguuucaucagauagaaaaggaguucagugaaguggagggccgcauccaggacuuagagaaauacgucgaagauaccaagauugaccugugguccuauaacgcagagcuccuuguggcucuggaaaaccagcacacaaucgauuugacugacagcgagaugaauaaacuauucgaaagaaccaggaagcaacugcgggagaacgccgaggauauggguaaugggugcuuuaaaaucuaccauaagugugacaacgcuugcauuggcucuauacgaaauggaacauacgaucacgacguuuaucgcgaugaagcccucaacaauagauuccagaucaagggcguggagcugaaaucaggguacaaggacuggauucuuuggaucaguuuugcaauuagcugcuuccuguugugugucgugcuccugggauuuaucaugugggccugccagaaagguaacauaagguguaauaucugcauuuga

SEQ ID NO: 122359 - RNA, 1701 nt, Artificial Sequence
  derived and/or modified sequence opt3 from hemagglutinin__InfluenzaA__ABA42531
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccucuaugacgugcccgauuacgcaucgcugcggucacugguugccagcaguggaacacucgaauuuaacaaugaguccuucaacuggaccggcguggcucagaaugguacgucuagcgcaugcaagcgccgauccauaaaaucauuuuucagucguuuaaacuggcugcaucaacuuaaguauaaguacccugccuugaaugucacuaugccaaacaaugagaaauuugacaagcuguauaucuggggagugcaccaccccagcaccgauucugaccagauuucccuauacgcucaggccucagggagaguaacaguuagcacuaaaaggagucagcaaaccgugaucccuaacauuggcucucggccauggguccgcggcguguccagcagaaucucgauauacuggacaauugugaagcccggggauauccuccugauuaacucuaccggaaaucuuaucgcgccuagggguuauuucaaaauccgguccggcaagucaaguauuaugcgcagcaacgcaccaauagggaaguguaauuccgaaugcaucacgccgaacggaucuauucccaaugacaaaccuuuucagaacgucaaucgaaucacuuacggcgccuguccaagauauguuaagcagaacacacugaaauuggcuaccgguaugaggaaugugcccgagaagcagacucgggggauauucggagccauugcaggcuuuaucgaaaacggcugggaggggaugguagacggaugguacgguuuccgucaucaaaauagcgagggcacagggcaggcugccgaucucaaaucaacccaggcggccaucaaccaaauuaauggaaagcugaaccgcuuaaucgagaaaacgaaugaaaaguuucaccagauugaaaaggaguucagugaaguggagggcagaauacaggaccuggagaaauaugucgaagauaccaagaucgaccucugguccuacaacgcagagcuucugguggcuuuggaaaaccagcauacaauugaucuaacugacagcgagaugaauaaacuguucgaaaggacccggaagcaacuccgagagaacgccgaggauauggguaaugggugcuuuaaaaucuaucacaagugugacaacgcuugcaucggcucuauucgcaauggaacauacgaucacgacguuuacagagaugaagcccugaacaauagguuccagauaaagggcguggagcuuaaaucaggguauaaggacuggauccuguggauuaguuuugcaaucagcugcuucuugcucugugucgugcuguuaggauuuauuaugugggccugccagaaagguaacauccgguguaauauaugcaucuga

SEQ ID NO: 122360 - RNA, 1701 nt, Artificial Sequence; identical to SEQ ID NO: 122088
  derived and/or modified sequence opt3 from hemagglutinin__InfluenzaA__ABA42542

SEQ ID NO: 122361 - RNA, 1701 nt, Artificial Sequence
  derived and/or modified sequence opt3 from hemagglutinin__InfluenzaA__ABA42553
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugcccauucuaauuguuaucccuacgacgugccugauuaugcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaccaacugaaguacaaguauccagcccuuaaugucacuaugcccaacaaugagaaauuugacaaguuguacaucuggggagugcaccauccuagcaccgauucugaccagauuucccuguaugcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuacuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuauggcgccugucccagauacguuaagcagaacacacuuaaacuggcuaccgguaugaggaaugugccugagaagcagacucgggggauauucggagccauugcaggcuuuaucgaaaacggcugggaggggaugguagacggaugguaugguuuccgucaccaaaauagcgagggcacagggcaggcugccgauuugaaaucaacccaggcggccaucaaccaaauuaauggaaagcucaaccgccugaucgagaaaacgaaugaaaaguuucaucagauugaaaaggaguucagugaaguggagggcagaauacaggacuuagagaaauacgucgaagauaccaagaucgaccugugguccuauaacgcagagcuccuuguggcucuggaaaaccagcacacaauugauuugacugacagcgagaugaauaaacuauucgaaaggacccggaagcaacugcgagagaacgccgaggauauggguaaugggugcuuuaaaaucuaccacaagugugacaacgcuugcaucggcucuauucgcaauggaacauaugaucaugacguuuacagagaugaagcccucaacaauagguuccagauaaagggcguggagcugaaaucaggguacaaggacuggauccuuuggauuaguuuugcaaucagcugcuuccuguugugugucgugcuccugggauuuauuaugugggccugccagaaagguaacauccgguguaauauaugcaucuga

SEQ ID NO: 122362 - RNA, 1701 nt, Artificial Sequence; identical to SEQ ID NO: 122088
  derived and/or modified sequence opt3 from hemagglutinin__InfluenzaA__ABA42564

SEQ ID NO: 122363 - RNA, 1701 nt, Artificial Sequence
  derived and/or modified sequence opt3 from hemagglutinin__InfluenzaA__ABA42928
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcaagaucucgauauacuggacaauugugaaaccuggggauauccuacucauuaacucuaccggaaaucugaucgcgccaagagguuauuucaagaucagguccggcaagucaaguauuaugcggagcaacgcaccgauagggaaauguaauuccgaaugcaucacgcccaacggaucuauuccuaaugacaagccauuucagaacgucaaucgcaucacuuacggcgccuguccccgauauguuaaacagaacacacuuaagcuggcuaccgguaugagaaaugugccugagaaacagacuagggggauauucggagccauugcaggcuuuaucgaaaacggcugggaggggaugguaaauggaugguacgguuuccggcaucaaaacagcgagggcacagggcaggcugccgacuugaagucaacccaggcggccaucaaucaaauuaacggaaaacucaaucgucugaucgaaaagacgaacgagaaguuucaccagauugaaaaagaguucagugaaguggagggccgcauacaggauuuagagaaguaugucgaagacaccaaaaucgaucugugguccuacaacgcagagcuccuuguggcucuggaaaaucagcauacaauugacuugacugauagcgagaugaacaagcuauucgaaagaaccaggaaacaacugcgggagaaugccgaggacauggguaacgggugcuuuaagaucuaucacaagugugauaaugcuugcaucggcucuauucgaaacggaacauacgaccacgauguuuaccgcgacgaagcccucaauaacagauuccagauaaaaggcguggagcugaagucaggguauaaagauuggauccuuuggauuaguuuugcaaucagcugcuuccuguugugugucgugcuccugggauuuauuaugugggccugccagaaggguaauaucagguguaacauaugcaucuga

SEQ ID NO: 122364 - RNA, 1701 nt, Artificial Sequence; identical to SEQ ID NO: 122088
  derived and/or modified sequence opt3 from hemagglutinin__InfluenzaA__ABA42939

SEQ ID NO: 122365 - RNA, 1701 nt, Artificial Sequence
  derived and/or modified sequence opt3 from hemagglutinin__InfluenzaA__ABA42978
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuauccccaacaaugagaaauuugacaaguuguauauuuggggagugcaccacccuagcaccgauucugaccagaucucccuguacgcucaggccucagggagaguaacaguuagcacuaaaaggagucagcaaaccgugauuccaaacaucggcucucggcccuggguccgcggcguguccagcagaauaucgauuuacuggacaaucgugaagccuggggauauucuacucaucaacucuaccggaaaucugaucgcgccaagggguuauuucaaaauucgguccggcaagucaaguauaaugcgcagcaacgcaccgaucgggaaguguaauuccgaaugcauuacgcccaacggaucuaucccuaaugacaaaccauuucagaacgucaaucgaauaacuuacggcgccugucccagauauguuaagcagaacacacuuaaacuggcuaccgguaugaggaaugugccugagaagcagacucgggggauuuucggagccaucgcaggcuuuaucgaaaacggcugggaggggaugguagacggaugguacgguuuccgucaucaaaauagcgagggcacagggcaggcugccgauuugaaaucaacccaggcggccauuaaccaaaucaauggaaagcucaaccgccugauugagaaaacgaaugaaaaguuucaccagauagaaaaggaguucagugaaguggagggcagaauccaggacuuagagaaauaugucgaagauaccaagauugaccugugguccuacaacgcagagcuccuuguggcucuggaaaaccagcauacaaucgauuugacugacagcgagaugaauaaacuauucgaaaggacccggaagcaacugcgagagaacgccgaggauauggguaaugggugcuuuaaaaucuaucacaagugugacaacgcuugcauuggcucuauacgcaauggaacauacgaucacgacguuuacagagaugaagcccucaacaauagguuccagaucaagggcguggagcugaaaucaggguauaaggacuggauucuuuggaucaguuuugcaauuagcugcuuccuguugugugucgugcuccugggauuuaucaugugggccugccagaaagguaacauacgguguaauaucugcauuuga

SEQ ID NO: 122366 - RNA, 1701 nt, Artificial Sequence; identical to SEQ ID NO: 122259
  derived and/or modified sequence opt3 from hemagglutinin__InfluenzaA__ABA43167

SEQ ID NO: 122367 - RNA, 1701 nt, Artificial Sequence
  derived and/or modified sequence opt3 from hemagglutinin__InfluenzaA__ABA43178
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucgacggcugguauggguuucgucaccagaauagcgagggaaucggccaggcagcugaucugaaguccacccaagccgcgauuaaccagauaaaugguaaauugaaccgccucaucgggaagacgaacgagaaguuccaccagauugaaaaagaguucucugaaguugagggcagaauccaggaccuggaaaaguacguggaggauaccaaaaucgacuuauggagcuauaaugccgagcugcucguagcacuugaaaaccaacauacaauugaucugacugacucagagaugaauaaguuguuugaaaggaccaaaaagcagcuacgggagaacgcugaagauaugggaaauggcugcuucaagauauaccacaaaugugacaacgccugcaucgggaguauucgaaauggaacauaugaucaugacguguaccgcgacgaggcucugaacaauagauuucagaucaagggugucgagcucaaauccggcuacaaggauuggauucuguggaucagcuucgccauaucuugcuuucuucuguguaucgcauugcucggguucauuaugugggccugccagaaaggaaacaucagguguaauauuugcaucuga

SEQ ID NO: 122368 - RNA, 1698 nt, Artificial Sequence
  derived and/or modified sequence opt3 from hemagglutinin__InfluenzaA__ABA43189
augaaggccaaacugcucgugcuucugugcaccuucacagcuacuuacgcagacacgaucugugucggcuaucacgccaacaauagcaccgauacaguugacacuguguuggagaagaacguaaccgugacacauuccgucaauuuacuggaagauucucacaacgggaaacuaugccuccugaagggaauugcgccccuucagcuggguaauuguucaguggcuggcuggauauuggggaacccugagugcgaacuccugaucaguaaagagagcugguccuacauuguugaaaccccaaauccggagaacggaacuuguuaucccggcuacuuugccgacuaugaggaacugagagagcaacucucuucggugagcucauucgaaagguuugagaucuucccuaaggguaguuccuggccaaaucauacagucaccggggugucugcaagcugcucccacaacggaaagucaaguuuuuaccggaauuuacuguggcuuacgggcaaaaacggcuuguaucccaaucugagcaugucuuacguaaacaauaaggagaaagaaguucuagugcucuggggaguccaucacccuccaaacauuggggaucagcgcgcccuguaccacacugagaacgcuuauguguccguggucucaagccauuacagucgacguuucacccccgaaaucgcaaagagaccuaaaguuagggaccaggagggucggauaaauuauuacuggacacuucuggaaccaggcgauacuaucauuuuugaggccaacgggaauuugaucgcuccgugguaugccuucgcgcucucucgcggauuuggcuccgguauuaucaccagcaacgcacccauggacgagugugaugccaagugccagacaccucaaggggcuauaaauucgucucugccauuccagaacgugcaccccguaaccauuggagaauguccuaaguacgugagauccgccaaauuaaggauggucacgggccugcggaauaucccaucaauucagagucgcggccucuuuggggcaaucgcuggauucaucgaggguggcuggacugggaugguggacggaugguauggcuaccaucaccagaacgaacaagguagcggguacgccgcggaucagaaguccacacagaaugccauuaacggcauaaccaauaaaguuaacucugugaucgagaagaugaauacucaguuuacagcagucggaaaagaguucaacaaacuugaacgaagaauggagaaucugaacaagaagguggacgauggcuucuuggacauuuggaccuauaacgcugaacuacugguacuccuggagaaugaaaggacgcuugacuuucacgauagcaacguuaagaaucuguacgagaaagugaagucacaauugaaaaacaaugccaaggaaaucgggaacggaugcuucgaguuuuaucauaaauguaauaacgagugcauggaaagugucaagaaugguaccuacgacuaucccaaguacuccgaggaaagcaaacucaaccgggagaagauagauggcgugaaacuggagucuaugggggucuaucagauuuuagcuaucuacucaacaguggccaguagccugguucuacucgugucccugggagcaaucucuuucuggaugugcucgaauggcagccuucagugucguauuugcaucuga

SEQ ID NO: 122369 - RNA, 1701 nt, Artificial Sequence
  derived and/or modified sequence opt3 from hemagglutinin__InfluenzaA__ABA43200
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucgacggcugguauggguuucgucaccagaauagcgagggaaucggccaggcagcugaucugaaguccacccaagccgcgauuaaccagauaaaugguaaauugaaccgccucaucgggaagacgaacgagaaguuccaccagauugaaaaagaguucucugaaguugagggcagaauccaggaccuggaaaaguacguggaggauaccaaaaucgacuuauggagcuauaaugccgagcugcucguagugcuugaaaaccaacauacaauugaucugacugacucagagaugaauaaguuguuugaaaggaccaaaaagcagcuacgggagaacgcagaagauaugggaaauggcugcuucaagauauaccacaaaugugacaacgcuugcaucgggaguauucgaaauggaacauaugaucaugacgucuaccgcgacgaggcccugaacaauagauuucagaucaaggguguggagcucaaauccggcuacaaggauuggauucuguggaucagcuucgcuauaucuugcuuucuucuguguguuguguugcucggguucaucaugugggccugccagaaaggaaacauuagguguaauaucugcauuuga

SEQ ID NO: 122370 - RNA, 1701 nt, Artificial Sequence
  derived and/or modified sequence opt3 from hemagglutinin__InfluenzaA__ABA43336
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacaaaauucuucaacagguagaaucugcgacaguccacacaggauucuagauggcaaaaacuguacccucaucgacgcucugcuuggggauccgcauugcgacggauuccagaauaaggagugggaucuguuuguggaacggagcaaagccuauuccaacuguuaccccuaugacgucccugauuacgcaucuuugcgcucgcucguggccucaagcggcacucuggaguucauaaaugaagacuuuaacuggacagguguugcucagagugggggauccuaugcaugcaagcgaggcucugugaauagcuucuuuucccgucugaacuggcuccacgagucagaguacaaguauccagccuuaaaugucaccaugcccaacaauggcaaauucgauaagcuguacguguggggaguacaucacccuaucacggacagagaacagacuaaacuuuacguuagggcuagugggcgggugaccgucagcacaaagcgcucucagcagacugugauuccaaacaucgguuccagacccugggugaggggcuugucaagccggauuaguaucuauuggaccauagucaaaccuggggauauucugcuaaucaacucuacaggaaaucucauugccccacgcggcuacuuuaagauccgaaccgguaaguccagcaucaugagaucggacgcgccgauugggacguguucuuccgagugcauaacucccaacggaucaaucccuaaugacaaaccauuccagaacguuaauaggauuacauauggcgcauguccccgguacgugaagcaaaacacccugaaacuugccacuggcaugcguaauguaccugaaaagcagacacgcgggaucuuuggagcuauagccgguuucauugagaacggcugggaggggaugguggauggaugguauggcuuuagacaccagaauagugaagguaccgggcaggcagcugaccugaaaagcacgcaagccgcgaucgaucagaucaacggcaaguugaauaggcucauugagaaaaccaacgaaaaguuccaucagaucgagaaggaguucuccgaagucgagggacggauucaagaccuggaaaaauacguggaggauacaaagauagacuuauggucuuauaaugccgaacugcucguugcacuugagaaccagcacacuaucgaucugaccgacagcgaaaugaauaaauuguuugagaagacacgaaaacagcuacgcgagaacgcugaagauaugggcaacgggugcuucaagauuuaccauaagugugacaaugccugcaucggaucaaucagaaacgguacuuacgaucacgacguguauagggacgaggcucugaauaaccgguuucagauuaaaggcgucgaacucaagaguggguacaaagauuggauacuguggaucuccuucgccauuagcugcuuucuucugugugugguauugcucggauucaucaugugggcaugccaaaagggcaauauucgcuguaacaucugcauauga

SEQ ID NO: 122371 - RNA, 1707 nt, Artificial Sequence
  derived and/or modified sequence opt3 from hemagglutinin__InfluenzaA__ABA54915
auggagaaggugguccugcuccuugccaccgcuagccugguuaaauccgaccagaucugcauuggcuaccacgcaaacaauucuacagaacaaguggauacuauaauggagaagaacguaacggugacccaugcccaggacaucuuggaaaagacacacaaugggaaguuaugugaucuggacggagucaaaccccuaauucucagagauugcucaguggcggguuggcugcuuggcaacccuaugugugacgaguucaucaauguuccagaauggaguuauauuguggagaaggcuagcccggccaacgaucugugcuaccccggggacuuuaaugauuaugaggaauugaagcaucuccuguccaggaucaaccacuucgagaaaauacagaucauuccuaagucuucguggucaaaucaugaagcaagcaguggagucuccgccgcuuguccauaccacggcaaacccagcuuuuuccggaacgugguauggcugaucaagaaaaauucugcauauccuacuauuaagcgcuccuacaacaauaccaaccaggaggaccucuuaguucugugggguauccaccauccaaaugaugccgcugagcaaacaaaacuuuaucagaaccccaccacuuacauaucaguggggacaaguaccuugaaccagcgacuggucccuaaaauugccacgcguagcaaggugaauggacagucuggcagaauggaauuuuucuggacuauccuaaaaccaaacgacgcgauuaauuuugaguccaacggcaauuucaucgcaccggaauacgccuauaagaucgugaaaaagggggauucagcuauuaugaaaagcgagcucgaauacggaaacugcaauaccaagugucaaacacccaugggugccauaaacaguucuaugccuuuucacaauauccauccacugacuauuggcgagugccccaaguaugucaaauccaacaggcuuguucuggcaaccggguugcggaauacaccucagcgcgagagaaggcggaagaaacgcggacucuucggcgcuaucgccgguuuuauagaagggggauggcagggcaugguggacggcugguacggguaucaccacagcaacgagcagggaucggguuacgcggccgacaaggaaucuacccaaaaagcaauugauggcguaacgaauaaggugaacuccaucaucgacaagaugaauacucaguucgaggcugucgggcgagaauuuaacaaccuggagagaaggauugagaauuuaaacaaaaagauggaagauggauuccuggacguguggacauauaaugccgagcuccuuguucugauggaaaacgagcggaccuuggauuuccaugacucaaaugugaaaaaccuauacaauaagguccgucugcagcuccgcgauaacgcuaaagaacugggcaaugguuguuuugaguucuaccacaagugcgacaacgaguguauggaaagugugaagaaugggacuuaugauuacccacaauauagcgaggaagccagacuuaacagggaggagaucuccggcguaaaacuggaaucuaugggaacauaccagauuuugagcauauauucaaccguugcaaguucccucgcccuggcuaucaugguggcgggcuuaagccuguggaugugcucuaaugggucacuacagugccggauuuguaucuga

SEQ ID NO: 122372 - RNA, 1698 nt, Artificial Sequence
  derived and/or modified sequence opt3 from hemagglutinin__InfluenzaA__ABA87080
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucauugaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacaugggggaucagcgcgcccuguaccacacugaaaacgcuuauguguccgucgugucaagccauuacagucgacguuucacccccgagauagcaaaaagaccuaaggugagggaccaggaaggacggaucaauuauuacuggacacuucuggagccaggugauacuauuaucuuugaggccaacggcaauuugauugcuccgcgcuaugccuucgcgcucucuagaggguuuggauccggcaucauaaccagcaacgcacccauggacgaaugugaugccaagugccagacaccucaaggugcuauuaauucgucucugccauuccagaacguccaccccguuaccaucggggaguguccuaaauacgugagguccgccaaguuacggaugguaacgggacugcgcaauauuccaucaauccagagucgaggccucuuuggcgcaaucgcuggguucauugaaggagguuggacuggcaugguggacgggugguauggauaccaucaccagaacgagcaaggcagcgguuacgccgcggaucagaaauccacacagaaugccauaaacgggaucaccaauaaggucaacucugugauugaaaagaugaauacucaguuuacagcaguuggcaaagaguucaacaaacuugagagaaggauggaaaaucugaacaagaagguggacgauggauucuuggacaucuggaccuauaacgcugagcuacugguccuccuggaaaaugagcggacgcuugacuuucacgauagcaacgugaaaaaucuguacgaaaagguaaaaucacaauugaagaacaaugccaaagagauaggcaacgggugcuucgaguuuuaucauaaguguaaugacgaaugcauggagaguguuaagaacggaaccuacgauuaucccaaauacuccgaagagagcaagcucaaucgugagaaaauugacggugugaagcuggaaucuaugggcgucuaucagaucuuagcuaucuacucaacaguggccaguagccugguccuacucgugucccugggggcaauuucuuucuggaugugcucgaacggaagccuucagugucgcaucugcauuuga

SEQ ID NO: 122373 - RNA, 1698 nt, Artificial Sequence; identical to SEQ ID NO: 122312
  derived and/or modified sequence opt3 from hemagglutinin__InfluenzaA__ABA87091

SEQ ID NO: 122374 - RNA, 1698 nt, Artificial Sequence; identical to SEQ ID NO: 122312
  derived and/or modified sequence opt3 from hemagglutinin__InfluenzaA__ABA87231

SEQ ID NO: 122375 - RNA, 1701 nt, Artificial Sequence; identical to SEQ ID NO: 122271
  derived and/or modified sequence opt3 from hemagglutinin__InfluenzaA__ABA87242

SEQ ID NO: 122376 - RNA, 1701 nt, Artificial Sequence; identical to SEQ ID NO: 122272
  derived and/or modified sequence opt3 from hemagglutinin__InfluenzaA__ABA87253

SEQ ID NO: 122377 - RNA, 1698 nt, Artificial Sequence
  derived and/or modified sequence opt3 from hemagglutinin__InfluenzaA__ABB02781
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuaccggaauuuacuguggcuuaccggcaaaaacggauuguaucccaaucugagcaagucuuacgccaacaauaaagaaaaggaggugcuaauacucuggggcguacaucacccuccaaacaucggggaucagcgcacgcuguaccacacugaaaacgcuuauguuuccguggucucaagccauuacagucgacguuucacccccgagauuacaaaaagaccuaaggugagggaccaggaaggacggaucaauuauuacuggacucuucuggagccaggugauaccauuaucuuugaggcaaacggcaauuugauagccccgugguaugcuuucgcccucucucgcggguuuggauccggcauuaucacaagcaacgcgcccauggacgaaugugaugcaaagugccagaccccucaaggugccauuaauucgucucugccauuccagaacgugcaccccgucacgaucggggaguguccuaaauacguuagauccgcuaaguuaaggauggugacuggacugcggaauaucccaucaauucagagucgcggccucuuuggcgccauagcaggguucaucgaaggagguuggacaggcaugguagacgggugguauggauaccaucaccagaacgagcaaggcagcgguuacgcugccgaucagaaauccacccagaaugcgauuaacgggaucacuaauaaggugaacucugucauagaaaagaugaauacacaguuuaccgccgugggcaaagaguucaacaaacuugagcgaagaauggaaaaucugaacaagaagguugacgauggauucuuggacauuuggacguauaacgcagagcuacuggugcuccuggaaaaugagaggacccuugacuuucacgauagcaacgucaaaaaucuguacgaaaaggugaaaucacaauugaagaacaaugcuaaagagaucggcaacgggugcuucgaguuuuaucauaaguguaauaacgaaugcauggagaguguaaagaauggaacauacgacuaucccaaauacuccgaagagagcaagcucaaccgggagaaaaucgaugguguuaagcuggacucuaugggcguguaucagauuuuagccaucuacucaacugucgcuaguagccuggugcuacucgucucccugggggccauuucuuucuggaugugcucgaauggaagccuucagugucgugugugcauauga

SEQ ID NO: 122378 - RNA, 1698 nt, Artificial Sequence; identical to SEQ ID NO: 122317
  derived and/or modified sequence opt3 from hemagglutinin__InfluenzaA__ABB02792

SEQ ID NO: 122379 - RNA, 1698 nt, Artificial Sequence; identical to SEQ ID NO: 122315
  derived and/or modified sequence opt3 from hemagglutinin__InfluenzaA__ABB02803

SEQ ID NO: 122380 - RNA, 1698 nt, Artificial Sequence
  derived and/or modified sequence opt3 from hemagglutinin__InfluenzaA__ABB02814
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuauuacuggacacuucuggaaccaggcgauacuauuaucuuugaggccaacgggaauuugauugcuccgugguaugccuucgcgcucucucgcggauuuggcuccgguaucauaaccagcaacgcacccauggacgagugugaugccaagugccagacaccucaaggggcuauuaauucgucucugccauuccagaacguucaccccgugaccaucggagaauguccuaaguacguaagauccgccaaauuaaggauggugacgggccugcggaauauuccaucaauccagagucgcggccucuuuggggcaaucgcuggauucauugaggguggcuggacugggauggucgacggaugguauggcuaccaucaccagaacgaacaagguagcggguacgccgcggaucagaaguccacacagaaugccauaaacggcaucaccaauaaagugaacucuguuauugagaagaugaauacucaguuuacagcagugggaaaagaguucaacaagcuagaacgaagaauggagaaucugaacaaaaaggucgacgauggcuucuuggacaucuggaccuauaacgcugaacuacuggugcuccuggagaaugaaaggacgcuugacuuucacgauagcaacguaaagaaucuguacgagaaaguuaagucacaauugaaaaacaaugccaaggaaauagggaacggaugcuucgaguuuuaucauaaaugugacaaugagugcauggaaagugugaagaacgguaccuacgauuaucccaaguacuccgaggaaagcaaacucaaucgggagaagauugacggcgucaaacuggagucuauggggguguaucagaucuuagcuaucuacucaacagucgccaguagccuggugcuacucguuucccugggagcaauuucuuucuggaugugcucgaacggcagccuucagugucguaucugcauuuga

SEQ ID NO: 122381 - RNA, 1698 nt, Artificial Sequence
  derived and/or modified sequence opt3 from hemagglutinin__InfluenzaA__ABB02825
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuauuacuggacacuucuggaaccaggcgauacuauuaucuuugaggccaacgggaauuugauugcuccgugguaugccuucgcgcucucucgcggauuuggcuccgguaucauaaccagcaacgcacccauggacgagugugaugccaagugccagacaccucaaggggcuauuaauucgucucugccauuccagaacguucaccccgugaccaucggagaauguccuaaguacguaagauccgccaaauuaaggauggugacgggccugcggaauauuccaucaauccagagucgcggccucuuuggggcaaucgcuggauucauugaggguggcuggacugggauggucgacggaugguauggcuaccaucaccagaacgaacaagguagcggguacgccgcggaucagaaguccacacagaaugccauaaacggcaucaccaauaaagugaacucuguuauugagaagaugaauacucaguuuacagcagugggaaaagaguucaacaagcuagaacgaagaauggagaaucugaacaaaaaggucgacgauggcuucuuggacaucuggaccuauaacgcugaacuacuggugcuccuggagaaugaaaggacgcuugacuuucacgauagcaacguaaagaaucuguacgagaaaguuaagucacaauugaaaaacaaugccaaggaaauagggaacggaugcuucgaguuuuaucauaaaugugacaaugagugcauggaaagugugaagaacgguaccuacgauuaucccaaguacuccgaggaaagcaaacucaaucgggagcguauugacggcgucaagcuggagucuauggggguguaucagaucuuagcuaucuacucaacagucgccaguagccuggugcuacucguuucccugggagcaauuucuuucuggaugugcucgaacggcagccuucagugucgcaucugcauuuga

SEQ ID NO: 122382 - RNA, 1701 nt, Artificial Sequence
  derived and/or modified sequence opt3 from hemagglutinin__InfluenzaA__ABB02836
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaaaccaacagacaguaauuccaaauaucggaucaaggccccggguucgcgauauaccuagcagaauuaguaucuacuggaccauugugaaaccaggugacauccugcuaaucaacucuacgggcaaucucauugccccgaggggguacuuuaagauacgguccggaaagagcucgaucaugcgcucugacgcgcccauuggcaaauguaaguccgagugcaucacuccuaacgguucaauaccaaaugauaaacccuuccagaacgucaaucgaauuacauauggggcauguccuagauacgugaagcagaacacccugaaacuugccacuggaaugaggaaugugccagaaaagcaaacacggggcaucuuuggcgcuaucgccggguucauugagaacggaugggaagguauggucgacggcugguauggguuucgucaccagaauagugagggaaucggccaggcagcugaucugaaaagcacccaagccgcgauuaaccagauaaaugguaaguugaaccgccucaucgggaagacgaacgagaaauuccaccagauugaaaaggaguucuccgaaguugagggcagaauccaggaccuggaaaaauacguggaggauaccaagaucgacuuauggucuuauaaugccgagcugcucguagcacuugaaaaccaacauacaauugaucugacugacagcgagaugaauaaauuguuugaaaggaccaagaagcagcuacgggagaacgcugaagauaugggaaauggcugcuucaaaauauaccacaagugugacaacgccugcaucgggucaauucgaaauggaacauaugaucaugacguguaccgcgacgaggcucugaacaauagauuucagaucaaaggugucgagcucaagaguggcuacaaagauuggauucuguggaucuccuucgccauaagcugcuuucuucuguguguggcauugcucggguucaucaugugggccugccagaagggaaacauuagguguaauaucugcauuuga

SEQ ID NO: 122383 - RNA, 1701 nt, Artificial Sequence
  derived and/or modified sequence opt3 from hemagglutinin__InfluenzaA__ABB02847
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggaucgggguuacacagaauggaaccucuagcgcuugcaagcggcgcuccaacaauucauuuuucagucgacugaacuggcucacgcauuuaaaguuuaaauauccagcacugaaugugacuaugcccaacaacgagaaguucgacaaacuuuacauuuggggcguccaccauccuggcaccgauaaugaccagaucagcuuguaugcccaggcuucugggcguauuacaguguccacuaagagaucacaacagaccguaaucccaaacauaggaagcaggccccggguucgcgauauuccuaguagaaucucuauuuacuggacaaucgugaaaccaggugacauccugcuaauuaauuccaccggcaaccucauagccccgaggggguacuuuaagauccggagcggaaagucgucuauuaugcgcuccgacgcgcccaucggcaaauguaauucagagugcauaacgccuaacgguaguauuccaaaugauaagcccuuccagaacgucaaucgaaucacuuauggggcauguccuagauacgugaaacagaacacacugaaacuugccaccggaaugaggaaugugccagaaaagcaaacucggggcaucuuuggcgcuauugccggguucaucgagaacggaugggaagguauggucgacggcugguauggguuucgucaccagaauagcgagggaauuggccaggcagcugaucugaaguccacacaagccgcgauaaaccagaucaaugguaaauugaaccgccucauugggaagaccaacgagaaguuccaccagaucgaaaaagaguucucugaaguugagggcagaauccaggaccuggaaaaguacguggaggauacgaaaauugacuuauggagcuauaaugccgagcugcucguagcacuugaaaaccaacauaccauagaucugacagacucagagaugaauaaguuguuugaaaggacuaaaaagcagcuacgggagaacgcugaagauaugggaaauggcugcuucaagaucuaccacaaaugugacaacgccugcauugggaguauccgaaauggaaccuaugaucaugacguguaccgcgacgaggcucugaacaauagauuucagauuaagggugucgagcucaaauccggcuacaaggauuggauccuguggaucagcuucgccauaucuugcuuucuucugugugugguuuugcucggguucauuaugugggcaugccagaaaggaaacaucagguguaauauuugcaucuga

SEQ ID NO: 122384 - RNA, 1701 nt, Artificial Sequence; identical to SEQ ID NO: 122063
  derived and/or modified sequence opt3 from hemagglutinin__InfluenzaA__ABB02858

SEQ ID NO: 122385 - RNA, 1701 nt, Artificial Sequence
  derived and/or modified sequence opt3 from hemagglutinin__InfluenzaA__ABB02869
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacuuaaacuggcuaccgguaugaggaaugugccugagaagcagacucgggggauauucggagccauugcaggcuuuguagaaaacggcugggaggggaugguggacggaugguacgguuuccgucaucaaaauagcgagggcacagggcaggcugccgauuugaaaucaacccaggcggccaucaaccaaaucaauggaaagcucaaccgccugauugagaaaacgaaugaaaaguuucaccagaucgaaaaggaguucagugaagucgagggcaggauucaggacuuagagaaauauguggaagauaccaagauagaccugugguccuacaacgcagagcuccuuguugcucuggaaaaccagcauacaaucgauuugacugacagcgagaugaauaaacuauucgaaagaacccggaagcaacugcgagagaacgccgaggauauggguaaugggugcuuuaaaauuuaucacaagugugacaacgcuugcaucggcucuauccgcaauggaacauacgaucacgacguguacagagaugaagcccucaacaauagguuccagauuaagggcgucgagcugaaaucaggguauaaggacuggauacuuuggaucaguuuugcaauuagcugcuuccuguugugugugguacuccugggauuuaucaugugggccugccagaaagguaacauucgguguaauaucugcauauga

SEQ ID NO: 122386 - RNA, 1701 nt, Artificial Sequence
  derived and/or modified sequence opt3 from hemagglutinin__InfluenzaA__ABB02880
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacuuaaacuggcuaccgguaugaggaaugugccugagaagcagacucgggggauauucggagccauugcaggcuuuaucgaaaacggcugggaggggaugguagacggaugguacgguuuccgucaucaaaauagcgagggcacagggcaggcugccgauuugaaaucaacccaggcggccaucaaccaaauuaaucgcaagcucaacagacugaucgagaaaacgaaugaaaaguuucaccagauugaaaaggaguucagugaaguggagggaaggauacaggacuuagagaaauaugucgaagauaccaagaucgaccugugguccuacaacgcagagcuccuuguggcucuggaaaaccagcauacaauugauuugacugacagcgagaugaauaaacuauucgaacggacccgaaagcaacugcgcgagaacgccgaggauaugggcaaugguugcuuuaaaaucuaucacaagugugacaacgcuugcaucgggucuauuagaaauggcacauacgaucacgacguuuacagggaugaagcccucaacaaucgguuccagauaaagggaguggagcugaaaucaggcuauaaggacuggauccuuuggauuaguuuugcaaucagcugcuuccuguugugugucgugcuccugggguuuauuaugugggccugccagaaaggaaacauccgcuguaauauaugcaucuga

SEQ ID NO: 122387 - RNA, 1701 nt, Artificial Sequence
  derived and/or modified sequence opt3 from hemagglutinin__InfluenzaA__ABB02891
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcaucauaucgauuuacuggacaaucgugaagccuggggauauucuacucaucaacucuaccggaaaucugaucgcgccaagagguuauuucaaaauuagguccggcaagucaaguauaaugcggagcaacgcaccgaucggggaauguaauuccgagugcauuacgcccaacggaucuaucccuaaugacaagccauuucagaacgucaaucgcauaacuuacggcgccuguccccgauauguuaaacagaacacacuuaagcuggcuaccgguaugagaaaugugccugaaaaacagacuagggggauuuucggagccaucgcaggcuuuaucgagaacggcugggaggggaugguagacggaugguacgguuuccggcaucaaaauagcgaaggcacagggcaggcugccgauuugaagucaacccaggcggccauuaaccaaaucaauggaaaacucaaccgucugauugagaagacgaaugaaaaauuucaccagauagagaaggaguucagugaaguggagggccgcauccaggacuuagaaaaguaugucgaggauaccaaaauugaccugugguccuacaacgcagaacuccuuguggcucuggagaaccagcauacaaucgauuugacugacagcgaaaugaauaagcuauucgagagaaccaggaaacaacugcgggagaacgccgaagauauggguaaugggugcuuuaagaucuaucacaaaugugacaacgcuugcauuggcucuauacgaaauggaacauacgaucacgacguuuaccgcgaugaggcccucaacaauagauuccagaucaagggcguggaacugaagucaggguauaaagacuggauucuuuggaucaguuuugcaauuagcugcuuccuguugugugucgugcuccugggauuuaucaugugggccugccagaaggguaacauaagguguaauaucugcauuuga

SEQ ID NO: 122388 - RNA, 1701 nt, Artificial Sequence
  derived and/or modified sequence opt3 from hemagglutinin__InfluenzaA__ABB02902
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacuuaaacuggcuaccgguaugaggaaugugccugagaagcagacucgggggauauucggagccauugcaggcuuuaucgaaaacggcugggaggggaugauggacggaugguacgguuuccgucaucaaaauagcgagggcacagggcaggcugccgauuugaaaucaacccaggcggccaucaaccaaauuaauggaaagcucaaccgccugaucgagaaaacgaaugaaaaguuucaccagauugaaaaggaguucagugaaguagagggcagaauacaggacuuagagaaauauguggaagauaccaagaucgaccugugguccuacaacgcagagcuccuugucgcucuggaaaaccagcauacaauugauuugacugacagcgagaugaauaaacuauucgaaaggacccggaagcaacugcgagagaacgccgaggauauggguaaugggugcuuuaaaaucuaucacaagugugacaacgcuugcaucggcucuauucgcaauggaacauacgaucacgacguguacagagaugaagcccucaacaauagguuccagauaaagggcguugagcugaaaucaggguauaaggacuggauccuuuggauuaguuuugcaaucagcugcuuccuguugugugugguccuccugggauuuauuaugugggccugccagaaagguaacauccgguguaauauaugcaucuga

SEQ ID NO: 122389 - RNA, 1698 nt, Artificial Sequence
  derived and/or modified sequence opt3 from hemagglutinin__InfluenzaA__ABB02913
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucgcccuccaaacaucggggaucagcgagcccuguaccacacugagaacgcuuaugucuccguggugucaagccacuacagucguagauucacccccgaaauagcaaagaggccuaaaguccgggaccaggagggucgcaucaauuauuacuggacacuucuggaaccaggcgauacuauuaucuuugaggccaacgggaauuugauugcuccgugguaugccuucgcgcucucuagaggauuuggcuccgguaucauaaccagcaacgcacccauggacgagugugaugccaagugccagacaccucaaggggcuauuaauucgucucugccauuccagaacguucaucccgugaccaucggagaauguccuaaguacguaagguccgccaaauuacggauggugacgggccugcgcaauauuccaucaauccagagucgaggccucuuuggggcaaucgcuggauucauugaggguggcuggacugggauggucgacggaugguauggcuaccaccaucagaacgaacaagguagcggguacgccgcggaucagaaguccacacagaaugccauaaacagaaucaccaauaaagugaacucuguuauugagaagaugaauacucaguuuacagcagugggcaaagaguucaacaagcuagaaaggcggauggagaaucugaacaaaaaggucgacgauggauucuuggacaucuggaccuauaacgcugaacuacuggugcuccuggagaaugaacguacgcuugacuuucacgauagcaacguaaagaaucuguacgagaaaguuaagucacaauugaaaaacaaugccaaggaaauaggcaacgggugcuucgaguuuuaucacaaauguaauaacgagugcauggaaagugugaagaauggaaccuacgacuaucccaaguacuccgaggaaagcaaacucaaccgcgagaagauugauggugucaaacuggagucuaugggcguguaucagaucuuagcuaucuacucaacagucgccaguagccuggugcuacucguuucccugggggcaauuucuuucuggaugugcucgaauggaagccuucaguguagaaucugcauuuga

SEQ ID NO: 122390 - RNA, 1698 nt, Artificial Sequence
  derived and/or modified sequence opt3 from hemagglutinin__InfluenzaA__ABB02924
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuaugccuucgcgcucucuagaggguuuggauccggcaucauaaccagcaacgcacccauggacgaaugugaugccaagugccagacaccucaaggugcuauuaauucgucucugccauuccagaacguucaccccgugaccaucggggaguguccuaaauacguaagguccgccaaguuacggauggugacgggacugcgcaauauuccaucaauccagagucgaggccucuuuggcgcaaucgcuggguucauugaaggagguuggacuggcauggucgacgggugguauggauaccaucaccagaacgagcaaggcagcgguuacgccgcggaucagaaauccacacagaaugccauaaacgggaucaccaauaaggugaacgcaguuauugaaaagaugaauacucaguuuacagcugugggcaaagaguucaacaaacuugagagaaggauggaaaaucugaacaagaaggucgacgauggauucuuggacaucuggaccuauaacgccgagcuacuggugcuccuggaaaaugagcggacgcuugacuuucacgauucuaacguuaaaaaucuguacgaaaagguaaaaagccaauugaagaacaaugcuaaagagauaggcaacgggugcuucgaguuuuaucauaaguguaaugacgaaugcauggagucagugaagaacggaaccuacgauuaucccaaauacagugaagaguccaagcucaaucgugagaaaauugacggugucaagcuggaaagcaugggcguguaucagaucuuagccaucuacucuacagucgcaucaagucuggugcuacucguuagccugggggccauuuccuucuggaugugcucuaacggaucgcuucagugucgcaucugcauuuga

SEQ ID NO: 122391 - RNA, 1698 nt, Artificial Sequence
  derived and/or modified sequence opt3 from hemagglutinin__InfluenzaA__ABB02936
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggccauuuugccgacuacgaggaacugagagagcaacucucuucgguuagcucauucgaaagguuugagauuuucccuaaggguaguuccuggccaaaucacacagugaccggggucucugcaagcugcucccauaacggaaagucaaguuuuuaucggaauuuacuguggcuuacgggcaaaaacggcuuguaccccaaucugagcaugucuuaugugaacaauaaggagaaagaaguacuuguucucuggggagugcaccacccuccaaacaucggggaucagcgcgcccuguaccauacugagaacgcuuacgucuccguggugucaagccacuauagucgacguuucacccccgaaauagcaaagagaccuaaagucagggaccaggagggucggaucaauuacuauuggacacuucuggaaccaggcgauacuauuaucuuugaggccaacgggaauuugauugcuccgugguacgccuucgcgcucucucgcggauuuggcuccgguaucauaaccagcaacgcacccauggacgagugugaugccaagugccagacaccucaaggggcuauuaauucgucucugccauuccagaacguucaucccgugaccaucggagaauguccuaaguauguaagauccgccaaauuaaggauggugacgggccugcggaauauuccaucaauccagagucgcggccucuuuggggcaaucgcuggauucauugaggguggcuggacugggauggucgacggaugguacggcuaucaccaccagaacgaacaagguagcggguacgccgcggaucagaaguccacacagaaugccauaaacggcaucaccaauaaagugaacucuguuauugagaagaugaauacucaguuuacagcagugggaaaagaguucaacaagcuagaacgaagaauggagaaucugaacaaaaaggucgacgauggcuucuuggacaucuggaccuacaacgcugaacuacuggugcuccuggagaaugaaaggacgcuugacuuucaugauagcaacguaaagaaucuguaugagaaaguuaagucacaauugaaaaacaaugccaaggaaauagggaacggaugcuucgaguuuuaccacaaauguaauaacgagugcauggaaagugugaagaaugguaccuaugacuaccccaaguauuccgaggaaagcaaacucaaccgggagaagauugauggcgucaaacuggagucuauggggguguaccagaucuuagcuaucuauucaacagucgccaguagccuggugcuacucguuucccugggagcaauuucuuucuggaugugcucgaauggcagccuucagugucguaucugcauuuga

SEQ ID NO: 122392 - RNA, 1701 nt, Artificial Sequence
  derived and/or modified sequence opt3 from hemagglutinin__InfluenzaA__ABB02947
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguagaauuugcgacagcccacacaggauccuagauggcgagaauuguacccucauagacgcucugcuuggggauccgcauugcgacggauuucagaacaaagaaugggaucuguucguggagcgguccaaggccuauucuaauuguuaccccuaugacguccaggauuacgcaucguugcgcucacucguggccagcaguggcacucuggaauuuaacaaugaguccuucaacuggacagguguugcucaaaaugggaccucuuaugcaugcaaacgacguagcaucaaguccuuuuucucaagacugaacuggcuccaccaguuaaaguacaaauauccugcccugaaugugacgaugccaaacaaugacaaguuugauaaacuuuacauuuggggaguccaucaccccaguacugacagcgaucagaccucuuuguacgcucaggccuccggcagggugacaguaucaacuaagcggagccaacagaccguuaucccuaacauuggcagucgcccaugggugagaggggucucuuccaggaucagcauauauuggacaauugugaaacccggagacauccugcuaauuaacucgaccgguaaucucaucgcgccucggggcuacuucaagauccgcucugggaaguccucaauuaugcgaagugacgcaccaauaggaaaauguaacagcgagugcaucacgccgaauggcuccauucccaacgauaagccuuuucagaaugugaacagaaucacuuauggugccuguccaagguacgucaaacagaauacacugaagcuggcuaccgggaugcggaacguucccgaaaaacaaacucguggaauauucggcgccauugcaggcuuuaucgagaaugggugggaaggaaugguggacgguugguauggcuuccgccaccagaacucugaggggacaggacaggcugccgaucuuaagagcacccaagcggccaucaaucagauuaacggcaaauugaauagacucaucgagaagacgaacgaaaaguuucaucagauugagaaagaguucucagaaguagaagguaggauacaggaccuggagaaguacguggaggauaccaaaaucgacuuauggaguuauaaugcagaacugcucgucgcucuugagaaccaacacacaauugaucugacugacuccgaaaugaacaaguuguucgagcggacccgaaaacagcuacgcgaaaaugccgaggauauggggaacggcugcuuuaagaucuaccauaagugugacaaugcuugcaucggaagcauuagaaacggcacauacgaucacgacguguauagggacgaggcccugaauaaccgguuccagauaaaagggguugaacucaagucuggauacaaagauuggauccuguggauuucauuugcaaucaguugcuuccuucuguguguggucuugcucgguuuuauuaugugggccugccagaagggcaauauccgcuguaacauaugcaucuga

SEQ ID NO: 122393 - RNA, 1701 nt, Artificial Sequence; identical to SEQ ID NO: 122202
  derived and/or modified sequence opt3 from hemagglutinin__InfluenzaA__ABB02958

SEQ ID NO: 122394 - RNA, 1701 nt, Artificial Sequence; identical to SEQ ID NO: 122202
  derived and/or modified sequence opt3 from hemagglutinin__InfluenzaA__ABB02969

SEQ ID NO: 122395 - RNA, 1701 nt, Artificial Sequence
  derived and/or modified sequence opt3 from hemagglutinin__InfluenzaA__ABB02980
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcauuaucucgauauacuggaccauugugaaaccuggagauauccuacucauuaauucuacagguaaccugaucgcgccaagaggcuauuucaagaucagguccgggaagucaaguauuaugcggagcgacgcaccgauaggaaaauguaauuccgaaugcaucacccccaacggcucuauuccuaaugacaagccauuucagaacgugaaucgcaucacguacggugccuguccccgauaugucaaacagaacacucuuaagcuggcuacagggaugagaaauguuccugagaaacaaaccaggggaauauucggcgccauugcaggcuuuaucgaaaacgggugggagggaaugguggaugguugguacggcuuccggcaccagaauagcgaggggacuggacaggcugccgacuugaagucaacacaagcggccaucaaccagauuaauggcaaacucaaccgucugaucgaaaagaccaaugagaaguuucaucagauugaaaaagaguucagugaaguagagggucgcauacaggauuuagagaaguauguggaagacacgaaaaucgaucugugguccuacaacgcagagcuccuugucgcucuggaaaaccaacacaccauugacuugacagauagcgagaugaauaagcuauucgaaagaacuaaaaagcagcugagggagaacgccgaggacauggggaauggcugcuuuaagaucuaucauaaaugugauaacgcuugcaucggaucuauucggaauggcaccuacgaccacgauguguaccgagacgaagcccucaacaaucgcuuccagauaaaggggguugagcugaaaucaggauauaaggacuggauccuuuggauuaguuuugcaaucagcugcuuccuguugugugugguccuccuggguuuuauuaugugggccugccagaaaggcaacaucagauguaauauaugcaucuga

SEQ ID NO: 122396 - RNA, 1701 nt, Artificial Sequence
  derived and/or modified sequence opt3 from hemagglutinin__InfluenzaA__ABB02991
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacaauccacaccagauucucgauggcgagaacuguacccugaucgacgcccuucugggggauccgcauugcgacggauuucagaauaaagaaugggauuuguucguggagaggagcaaggcuuauuccaacuguuaccccuaugacgucccugauuacgcaucucuccggucgcugguggccucaagcggcacucuggaauuuaauaacgagaguuucaauuggacagguguugcucaaaacgggaccuccucugcaugcaaacgccgaagcaauaaguccuuuuucucacgucucaacugguuacaccagcugaaguauaaauacccagcccuuaaugugacgaugcccaacaacgagaaguuugacaaauuguauauauggggaguccaucacccuaguacugauagcgaccagaucucucuguacgcucaggccuccggcagagugaccguaucaacaaagaggagccaacagacuguuauuccaaauaucggcagucggcccugggugcgcggggucucuuccauuaucagcauauacuggaccauugugaaaccuggagauauccuacucauuaacucgacagguaaucugaucgcgccaagaggcuauuucaagaucaggucugggaaguccucaauuaugcggagugacgcaccgauaggaaaauguaacagcgaaugcaucacccccaauggcuccauuccuaacgacaagccauuucagaaugugaaccgcaucacguacggugccuguccccgauaugucaaacagaauacucuuaagcuggcuacagggaugagaaacguuccugagaaacaaaccaggggaauauucggcgccauugcaggcuuuaucgaaaaugggugggagggaaugguggaugguugguacggcuuccggcaccagaacucugaggggacuggacaggcugccgaccuaaagagcacacaagcggccaucaaucagauuaacggcaaacucaaucgucugaucgaaaagaccaacgagaaguuucaucagauugaaaaagaguucucagaaguagagggucgcauacaggauuuagagaaguauguggaagacacgaaaaucgaucuguggaguuacaacgcagagcuccuugucgcucuggaaaaucaacacaccauugacuugacagauuccgagaugaacaagcuauucgaaagaacuaaaaagcagcugagggagaaugccgaggacauggggaacggcugcuuuaagaucuaucauaaaugugauaaugcuugcaucggaagcauucggaacggcaccuacgaccacgauguguaccgagacgaagcccucaauaaccgcuuccagauaaaggggguugagcugaaaucuggauauaaggacuggauccuuuggauuucauuugcaaucaguugcuuccuguugugugugguccuccuggguuuuauuaugugggccugccagaaaggcaauaucagauguaacauaugcaucuga

SEQ ID NO: 122397 - RNA, 1701 nt, Artificial Sequence
  derived and/or modified sequence opt3 from hemagglutinin__InfluenzaA__ABB03002
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcaauagcccacaccagauucucgacggcgagaacuguacccugaucgaugcucuacugggggacccgcauugcgauggauuucagaauaaagaaugggacuuguucguggagagguccaaggccuauucuaacuguuaccccuaugaugucccugacuacgcaucgcuccggucacugguggccagcaguggcacucuggaauuuaauaacgaguccuucaauuggacagguguugcucaaaacgggaccucuagcgcaugcaaacgccgauccaauaagucauuuuucagucgucucaacugguuacaccagcugaaguauaaauacccagcccuuaaugugacgaugcccaacaacgagaaguuugauaaauuguauauauggggaguccaucacccuagcacugacucugaucagaucucccuguacgcucaggccucaggcagagugaccguaagcacaaagaggagucaacagacuguuauuccaaauaucggcucugggcccugggugcggggagucuccagccgcauuucgaucuacuggaccauagugaaaccuggugacauucuacucaucaacucuacaggcaaucugauugcgccaagaggguauuucaagaucagguccggaaagucaaguaucaugcggagcgaugcaccgauuggcaaauguaacuccgaaugcauaacccccaaugguucuaucccuaacgacaagccauuucagaaugugaaccgcauuacguacggggccuguccccgauaugucaaacagaauacucuuaagcuggcuacaggaaugagaaacguuccugagaaacaaaccaggggcaucuucggcgccauagcaggguuuauugaaaauggaugggaggguaugguggacggcugguacggguuccggcaccagaacagcgagggaacuggccaggcugccgauuugaagucaacacaagcggccaucaaucagaucaacgguaaacucaaucgucugauugaaaagaccaacgagaaguuucaucagaucgaaaaagaguucagugaaguagaggggcgcauucaggacuuagagaaguauguggaagauacgaaaauagaccugugguccuacaacgcagagcuccuugucgcucuggaaaaucaacacaccaucgauuugacagacagcgagaugaacaagcuauucgaaagaacuaaaaagcagcugagggagaaugccgaggauaugggcaacggaugcuuuaagauuuaucauaaaugugacaaugcuugcaucggcucuauccggaacgggaccuacgaucacgacguguaccgagaugaagcccucaauaaccgcuuccagauuaagggaguugagcugaaaucagguuauaaggacuggauacuuuggaucaguuuugcaauuagcugcuuccuguugugugugguccuccugggcuuuaucaugugggccugccagaaagggaauauuagauguaacaucugcauauga

SEQ ID NO: 122398 - RNA, 1701 nt, Artificial Sequence
  derived and/or modified sequence opt3 from hemagglutinin__InfluenzaA__ABB03013
augaagaccaucauugcccugagcuacauacucugccuuguguucgcucagaaacugcccggcaacgacaauuccacagcaacuuuguguuuagggcaccaugccgucccuaacggaacgcugguuaagaccaucacaucugaucaaauugaggugacuaaugcgaccgaacugguacagucaaguagcacagguagaaucugcgacuccccacacaggauucucgauggcgagaacuguacccugaucgacgcuuugcugggggauccgcauugcgacggauuucagaauaaagaaugggauuuguucguggagcggucuaaggccuauucgaacuguuaccccuaugacgucccugauuacgcaucacuccgcagccugguggccaguuccggcacucuggaauuuaauaacgagucuuucaauuggacagguguugcucagaacgggaccagcuuugcaugcaaacgacguuccauaaagucauucuuuaguagacucaauugguuacaccaacugaaguauaaauacccagcccuuaacgugacgaugcccaauaacgacaaguucgauaaauuguauaucuggggaguccaucacccuggcacugacagcgaucagaccucucuguacgcucaggccuccggcagggugacaguaucaacuaagcggagccagcaaaccguuauuccaaauaucgggaguggacccugggugcgcggugucucuuccagaauuagcaucuacuggacaauagugaaaccuggcgacauucuacucaucaacucgaccgggaaccugauugcgccaaggggauauuuuaagauccggucuggcaaguccucaaucaugcgcagugacgcaccgauugguaaauguaauagcgagugcauaacgcccaacggguccaucccuaaugauaagccauuccagaacgugaaucgaauuacuuacggagccugucccagauaugucaaacagaacacacuuaagcuggcuaccggcaugaggaauguuccugaaaaacagacucggggcaucuuuggggccauagcaggauucauugagaacgguugggaaggcaugguggacgggugguacggauuucgucaccaaaauucugagggcacaggucaggcugccgaucuuaagagcacccaggcggccaucaaccaaaucaaugggaaacucaaccgccugauugagaagacgaaugaaaaguuccaucagaucgagaaagaguucaccgaaguagaaggcaggauucaggacuuagagaaguauguggaggauacaaaaauagaccuguggucauacaacgcagaacuccuugucgcucuggagaaucagcacacuaucgauuugaccgacagugaaaugaacaagcuauuugagagaacacggaaacaacugcgagaaaacgccgaggauaugggaaauggcugcuucaagauuuaucauaagugugacaacgcuugcaucggguccauccgcaauggaacuuacgaucacgacguguacagagacgaggcccucaacaauagguuucagauuaaagguguugaacuaaagagcggcuauaaagauuggauacuuuggaucucuuucgcaaccucaugcuuucuguugugugugguccuccugggguucauuaugugggccugccagaagggaaacauccgguguaauauuugcaucuga

SEQ ID NO: 122399 - RNA, 1701 nt, Artificial Sequence
  derived and/or modified sequence opt3 from hemagglutinin__InfluenzaA__ABB03024
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccuggauucgcgggguguccagcagaaucucgauauacuggaccauugucaaaccuggagauauccuacucauuaauucuacagguaaccugaucgcgccaaggggcuauuucaagauccgguccgggaagucaaguauuaugcgcagcgacgcaccgauaggaaaauguaauuccgaaugcaucacccccaacggcucuauuccuaaugacaagccauuucagaacgugaaucgaaucacguacggugccugucccagauaugugaaacagaacacucuuaagcuggcuacagggaugaggaaugucccugagaaacaaacccggggaauauucggcgccauugcaggcuuuaucgaaaacgggugggagggaaugguugaugguugguacggcuuccgucaccagaauagcgaggggacuggacaggcugccgacuugaagucaacacaagcggccaucaaccagauuaauggcaaacucaaccgccugaucgaaaagaccaaugagaaguuucaucagauugaaaaagaguucagugaaguggaggguagaauacaggauuuagagaaguauguagaagacacgaaaaucgaucugugguccuacaacgcagagcuccuuguggcucuggaaaaccaacacaccauugacuugacagauagcgagaugaauaagcuauucgaaaggacuaaaaagcagcugcgggagaacgccgaggacauggggaauggcugcuuuaagaucuaucauaaaugugauaacgcuugcaucggaucuauucgaaauggcaccuacgaccacgaugucuaccgcgacgaagcccucaacaauagauuccagauaaaggggguggagcugaaaucaggauauaaggacuggauccuuuggauuaguuuugcaaucagcugcuuccuguuguguguugugcuccuggguuuuauuaugugggccugccagaaaggcaacaucagguguaauauaugcaucuga

SEQ ID NO: 122400 - RNA, 1701 nt, Artificial Sequence
  derived and/or modified sequence opt3 from hemagglutinin__InfluenzaA__ABB03035
augaagaccaucauugcccugagcuacauacucugccuuguguucgcucagaaacugcccggcaacgacaauuccacagcaacuuuguguuuagggcaccaugccgucccuaacggaacgcugguuaagaccaucacaucugaucaaauugaggugacuaaugcgaccgaacugguacagucaaguagcacagguagaaucugcgacuccccacacaggauucucgauggcgagaacuguacccugaucgacgcuuugcugggggauccgcauugcgacggauuucagaauaaagaaugggauuuguucguggagcggucuaaggccuauucgaacuguuaccccuaugacgucccugauuacgcaucacuccgcagccugguggccaguuccggcacucuggaauuuaauaacgagucuuucaauuggacagguguugcucagaacgggaccagcuuugcaugcaaacgacguuccauaaagucauucuuuaguagacucaauugguuacaccaacugaaguauaaauacccagcccuuaacguggcuaugcccaauaacgacaaguucgauaaauuguauaucuggggaguccaucacccuggcacggacagcgaucagacuucucuguacgcccaggcguccggcagggugaccguaucaacaaagcggagccagcaaacuguuauuccaaauaucgggagucgccccugggugagaggagucucuuccaggauuagcaucuacuggaccauagugaaaccuggugacauucuacucaucaacucgacaggcaaccugauugcaccacggggguauuuuaagauccgcucuggaaaguccucaaucaugcgaagugacgccccgauuggcaaauguaauagcgagugcauaacccccaacgguuccaucccuaaugauaagccauuccagaacgugaauagaauuacguacggggcuugucccagguaugucaaacagaacacucuuaagcuggccacaggaaugcggaauguuccugaaaaacagacccguggcaucuuuggcgcaauagcuggguucauugagaacggaugggaagguaugguggacggcugguacggguuucgccaccaaaauucugagggaacuggccaggccgcggaucuuaagagcacacaggccgcaaucaaccaaaucaaugguaaacucaacagacugauugagaagaccaaugaaaaguuccaucagaucgagaaagaguucacggaaguagaagggaggauucaggacuuagagaaguauguggaggauaccaaaauagaccuguggucauacaacgcugaacuccuugucgcccuggagaaucagcacacaaucgauuugacugacagugaaaugaacaagcuauuugagcggacccgaaaacaacugcgcgaaaacgcugaggauaugggcaauggaugcuucaagauuuaucauaagugugacaacgccugcaucggcuccaucagaaaugggacauacgaucacgacguguacagggacgaggcacucaacaaucgguuucagauuaaaggaguugaacuaaagagcgguuauaaagauuggauacuuuggaucucuuucgccacuucaugcuuucuguugugugugguccuccugggcuucauuaugugggcuugccagaaggggaacauccgcuguaauauuugcaucuga

SEQ ID NO: 122401 - RNA, 1701 nt, Artificial Sequence
  derived and/or modified sequence opt3 from hemagglutinin__InfluenzaA__ABB03046
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcggaauuucgaucuacuggaccauagugaaaccuggugauauucuacucaucaauucuacaggcaaccugauugcgccaagaggguauuucaagaucagguccggaaagucaaguaucaugcggagcgacgcaccgauuggcaaauguaauuccgaaugcauaacccccaacgguucuaucccuaaugacaagccauuucagaacgugaaucgcauuacguacggggccuguccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucaacacaagcggccaucaaccagaucaaugguaaacucaaccgucugauugaaaagaccaaugagaaguuucaucagaucgaaaaagaguucagugaaguagaggggcgcauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugagggagaacgccgaggacaugggcaauggaugcuuuaagauuuaucauaaaugugauaacgcuugcaucggcucuauccggaaugggaccuacgaccacgauguguaccgagacgaagcccucaacaaucgcuuccagauuaagggaguugagcugaaaucagguuauaaggacuggauacuuuggaucaguuuugcaauuagcugcuuccuguuguguguggcccuccugggcuuuaucaugugggcuugccagaaagggaacauuagauguaauaucugcauauga

SEQ ID NO: 122402 - RNA, 1701 nt, Artificial Sequence
  derived and/or modified sequence opt3 from hemagglutinin__InfluenzaA__ABB03057
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacagguggcauuugcgacagcccacaccagauccuagauggggaaaauuguacccucauagacgcucugcuuggagauccgcagugcgacggcuuucaaaacaagaaaugggaucuguucguggagagauccaaggccuauucuaauuguuaccccuaugacgucccugauuacgcaucguugaggucacucguggccagcagugguacucuggaauuuaacaaugaguccuucaacuggacagggguuacccagaauggaacgucuagcgcuugcaaacggcgcuccaacaauucauuuuucagucgacugaacuggcucacucauuuaaaguuuaaguauccagcacugaaugugaccaugcccaacaacgagaaauucgacaaacuuuacaucuggggcguccaccauccuggcacagauaaugaccagacuagcuuguaugcccaggcuucugggcguauuaccguguccacaaagagaucacaacagaccguaaucccaaacauuggaagcaggccccggguucgcgauaucccuaguagaauaucuauuuacuggacgaucgugaagccaggugacauucugcuaaucaauuccacuggcaaccucaucgccccgaggggguacuuuaaaauucggagcggaaagucgucuauaaugcgcuccgacgcgcccaucggcaaguguaauucagaaugcauuacaccuaacgguaguaucccaaaugauaaacccuuccagaacgucaaucgaauaaccuauggggcauguccuagauacgugaagcagaacacucugaaacuugccacaggaaugaggaaugugccagagaagcaaacccggggcauuuuuggcgcuaucgccggguucaucgaaaacggaugggaggguauggucgacggcugguauggguuucgucaccagaauagcgagggaauuggccaggcagcugaucugaaauccacgcaagccgcgaucaaccagauuaaugguaaguugaaccgccucauagggaaaaccaacgaaaaguuccaccagaucgagaaggaguucucugaaguugaaggcaggauucaggaccuggagaaauacguggaggauacaaagaucgacuuauggagcuauaaugccgaacugcucguagcacuugagaaccaacauacuaucgaucugaccgacucagaaaugaauaaauuguuugagagaacaaagaaacagcuacgggaaaacgcugaggauaugggaaauggcugcuucaagauuuaccacaagugugacaacgccugcauagggaguauccgaaauggaacuuaugaucaugacguguaccgcgacgaggcucugaacaauagauuucagauuaaaggugucgaacucaagcugggcuacaaagauuggauccuuuggauuuccuucgccaucagcugcuuucuguuguguguggcacuccugggguucauaaugugggccugccagaagggaaacaucagguguaauauuugcaucuga

SEQ ID NO: 122403 - RNA, 1701 nt, Artificial Sequence; identical to SEQ ID NO: 122302
  derived and/or modified sequence opt3 from hemagglutinin__InfluenzaA__ABB03068

SEQ ID NO: 122404 - RNA, 1701 nt, Artificial Sequence; identical to SEQ ID NO: 122259
  derived and/or modified sequence opt3 from hemagglutinin__InfluenzaA__ABB03079

SEQ ID NO: 122405 - RNA, 1701 nt, Artificial Sequence; identical to SEQ ID NO: 122259
  derived and/or modified sequence opt3 from hemagglutinin__InfluenzaA__ABB03090

SEQ ID NO: 122406 - RNA, 1698 nt, Artificial Sequence
  derived and/or modified sequence opt3 from hemagglutinin__InfluenzaA__ABB03101
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaagaagaguuccuggccaaaucauacugugacaggugucucugcaagcugcucccacaacgggaaaucaaguuuuuaccggaauuuacuguggcuuaccggaaagaacggcuuguaucccaaucugagcaaaucuuacgccaacaauaaggagaaagaagugcuaauacucuggggcguacaucacccuccaaacaucggggaucagcgcacgcuguaccacacugagaacgcuuauguuuccguggucucaagccauuacagucgacguuucacccccgaaauuacaaagagaccuaaggugagggaccaggagggacggaucaauuauuacuggacucuucuggaaccaggugauaccauuaucuuugagacaaacggcaauuugauagcaccgugguaugccuucgcucucucucgcggguuuggauccggcauuaucaccagcaacgcccccauggacgagugugaugcgaaaugccagacgccucaaggugcaauuaauucgucucugccauuccagaacgugcaccccgucacuaucggggaauguccuaaguacguuagauccgccaaauuaaggauggugacaggacugcggaauaucccaucaauucagagucgcggccucuuuggcgcuauagccggguucaucgagggagguuggaccggcaugguagacgggugguauggauaccaucaccagaacgaacaaggcagcgguuacgcagcugaucagaaguccacucagaaugccauuaacgggaucacaaauaaagugaacucugucauagagaagaugaauacccaguuuacggcggugggcaaagaguucaacaaacuugaacgaagaauggagaaucugaacaagaaaguugacgauggauucuuggacauuuggaccuauaacgccgaacuacuggugcuccuggagaaugaaaggacacuugacuuucacgauagcaacgucaagaaucuguacgagaaagugaagucacaauugaaaaacaaugcaaaggaaaucggcaacgggugcuucgaguuuuaucauaaguguaauaacgagugcauggaaaguguaaagaauggaacuuacgacuaucccaaguacuccgaggaaagcaaacucaaccgggagaagaucgaugguguuaaacuggacucuaugggcguguaucagauuuuagcuaucuacucaaccgucgccaguagccuggugcuacucgucucccugggggcuauuucuuucuggaugugcucgaauggaagccuucagugucguauaugcaucuga

SEQ ID NO: 122407 - RNA, 1701 nt, Artificial Sequence
  derived and/or modified sequence opt3 from hemagglutinin__InfluenzaA__ABB03112
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauauaaguacccagcacugaacgugaccaugcccaauaacgagaaauuugacaagcuguauaucuggggcguccaccauccuggcacagauagcgaccagauuucuuuguacgcccaggcuuccgggcguaucacugugucaaccaaaagaagccaacagacaguaauuccaaacaucggaaguaggccccggguucgcgaugugucuuccagaauaagcauuuacuggaccaucgucaagccuggugacauucugcuaaucaauucgacgggcaaccucaucgccccaaggggguauuucaagauucggucuggaaaauccucaauaaugcgcagugacgcgccgaucggcaaguguaauagcgagugcauuacucccaacgguuccaucccuaaugauaaaccauuucagaacgugaauaagauaacauacggggcauguccccgauaugugaaacagaacacccugaaacuugccacuggaaugagaaaugucccugaaaagcaaacaaggggcauuuucggcgcuaucgccggguuuaucgagaacggaugggaagguaugguugacggcugguacggguuccggcaccaaaauucugagggaaccggccaggcagcugaucuuaagagcacgcaggccgcgauuaaccagaucaaugguaaguugaaccgucucauugggaaaaccaaugagaaguuucaccagauagaaaaagaguucucagaaguggagggccgcauccaggaccuggaaaaguauguagaggauacaaaaauugacuuauggaguuacaacgccgagcugcucguggcacuugaaaaccaacauacuaucgaucugaccgacuccgagaugaauaaguuguucgaaagaacaaagaaacagcuaagggagaacgcugaagauaugggaaauggcugcuuuaagaucuaucacaaaugugacaacacuugcauugagagcauacggaaugggaccuacgaucaugacgucuaccgagacgaggcccugaacaaucgcuuccagaucaagggaguggaacucaaaucugguuauaaggauuggauucuguggaucucauuugcuauuaguugcuuccuucuguguguugccuugcucggcuuuaucaugugggcaugccagaaggggaacauaagauguaauaucugcauuuga

SEQ ID NO: 122408 - RNA, 1698 nt, Artificial Sequence
  derived and/or modified sequence opt3 from hemagglutinin__InfluenzaA__ABB03123
augaaggugaaacugcucguccuucugugcaccuucacagccacuuacgcugacacgaucuguauuggcuaucacgcaaacaauagcaccgauacaguugacacuguguuggagaagaacguaaccgugacacauuuugucaauuuacuggaagauucccacaacgggaaacuaugccuccugaagggaauagcgccccuucagcuggguaauuguucuguggccggcuggaucuuggggaacccugagugcgaacuccugauuucaaaagagaguuggagcuacaucguugaaaccccaaauccggagaacggaacuuguuaucccggcuacuucgcugacuaugaggaacugagagagcaacucuccucugugucgucauuugaaagguucgagauuuuuccuaaggagagcaguuggccaaaucauacagucaccgguguguccgccucuugcagccacaacgggaaguccucauucuaccggaauuuacuguggcuuacgggcaaaaacggauuguaucccaaucugaguaagagcuacgcaaacaauaaagaaaaggagguucuaguacucuggggcgugcaucacccuccaaacaucggggaucagcgcgcccuguaccacacugaaaacgcuuaugucucugugguguccucacauuacagccgacguuuuacccccgagauagcaaaaagaccuaaggucagggaccaggaaggacggaucaauuauuacuggacacuucuggagccaggugauacuauuaucuucgaggccaacggcaauuugauugcuccgcgcuaugccuuugcgcucaguagaggguucggaucuggcaucauaaccuccaacgcacccauggacgaaugugaugccaagugccagacaccucaaggugcuauuaauagcucgcugccauuucagaacguucaccccgugaccaucggggaguguccuaaauacguaaggucugccaaguuacggauggugacgggacugcgcaauauuccauccauccagucacgaggccucuucggcgcaaucgcuggguuuauugaaggagguuggacuggcauggucgacgggugguauggauaccaucaccagaacgagcaaggcagugguuacgccgcggaucagaaaagcacacagaaugccauaaacgggaucaccaauaaggugaacuccguuauugaaaagaugaauacucaguucacagcagugggcaaagaguucaacaaacuugagagaaggauggaaaaucugaacaagaaggucgacgauggauuuuuggacaucuggaccuauaacgcugagcuacuggugcuccuggaaaaugagcggacgcuugacuuccacgauucuaacguuaaaaaucuguacgaaaagguaaaaagccaauugaagaacaaugccaaagagauaggcaacgggugcuuugaguucuaucauaaguguaaugacgaaugcauggagucagugaagaacggaaccuacgauuaucccaaauacagugaagaguccaagcucaaucgugagaaaauugacggugucaagcuggaaagcaugggcguguaucagaucuuagcuaucuacucuacagucgccucaagucuggugcuacucguuagccugggggcaauuuccuuuuggaugugcucuaacggaucgcuucagugucgcaucugcauuuga

SEQ ID NO: 122409 - RNA, 1698 nt, Artificial Sequence
  derived and/or modified sequence opt3 from hemagglutinin__InfluenzaA__ABB03134
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuucaucuuucgaaagguuugagaucuucccuaaggagaguuccuggccaaaucauacagugaccggugucucugccagcugcucccacaacgggaagucaaguuuuuaccggaauuuacuguggcuuacggagaaaaacggauuguaucccacucugagcaagucuuacgcaaauaacaaagagaaggaagugcuaauacucuggggcguacaucacccuccaaauaucggcgaucagcgcacccuguaccacacagagaacgccuauguuuccguggucucaagccauuacagucgacguuucacucccgaaauuaccaaaagaccuaaggugagggaccaggaggggcggaucaacuauuacuggacacuucuggagccaggagauaccauuaucuuugaagcuaaugguaacuugauagcaccgugguaugccuucgcucucucucgcggcuuuggguccggaauuaucacgagcaaugcccccauggacgagugugaugcgaagugccagacuccucaaggcgcaauuaacucgucucugccauuccagaaugugcaccccgucacaaucggugaauguccuaaauacguuagauccgccaaguuaaggauggugaccgggcugcggaacaucccaucaauucagagucgcggacucuuuggcgcuauagccggcuucaucgaagggggauggacugguaugguagacggcugguauggguaccaucaccagaaugaacaaggaagcggcuacgcagcugaucagaaauccacacagaacgccauuaaugguaucaccaacaaggugaauagcgucauagagaaaaugaacacgcaguuuaccgcgguggggaaggaguucaauaaacuugaacgaagaauggagaaccugaauaagaagguugacgauggcuucuuggacauuuggacauauaacgccgaacuacuggugcuccuggagaacgaaaggacucuugacuuucacgauagcaaugucaaaaaccuguacgagaaggugaaaucacaauugaagaauaacgcaaaagagaucggaaauggcugcuucgaauuuuaucauaaguguaacaaugagugcauggaaaguguaaagaacgggaccuacgacuaucccaaauacuccgaggagagcaagcucaaucgggagaaaaucgauggaguuaagcuggaaucuauggguguguaucagauuuuagcuaucuacucaacagucgccaguagccuggugcuacucgucucccugggcgcuauuucuuucuggaugugcucgaacgggagccuucagugucguauaugcaucuga

SEQ ID NO: 122410 - RNA, 1698 nt, Artificial Sequence; identical to SEQ ID NO: 122315
  derived and/or modified sequence opt3 from hemagglutinin__InfluenzaA__ABB03145

SEQ ID NO: 122411 - RNA, 1701 nt, Artificial Sequence
  derived and/or modified sequence opt3 from hemagglutinin__InfluenzaA__ABB04283
augaagaccaucauugcccugagcuacauauucugccucguguuugcucagaaccuucccggcaaugacaacuccacagcaacucuguguuuggggcaccaugccgucccuaauggaacguuaguuaaaaccaucacaaacgaucaaauugaggugacuaaugcgaccgaacugguacagucuucaaguacagguagaaucugcgacagcccacacaggauucuagauggcaagaacuguacccucaucgacgcucugcuuggggauccgcauugcgacggauuccagaaugagaaaugggaucuguuuguggaacgguccaaggccuucucuaacuguuaucccuacgacgucccugauuaugcaucguugcgcucacucguggccagcaguggcacucuggaguuuauaaaugaagguuucaacuggacagggguuacccaguccggaggcucuuacgcuugcaaacgaggcagcgacaaguccuuuuucucacgucugaauuggcucuaugagagugagagcaaguacccagcauuaaacgugacgaugcccaauaacgggaauuuugauaaacuguauaucuggggaguccaccauccuucuacugacaaggaacaaaccaaccuuuacgugagagccuccgguaggguaacaguuucaacuaaacggagccagcagaccauuaucccaaacauuggcccccgcccuugggugagaggguugaguucuaggaucuccauauacuggacaauugucaagccaggagauauccugcuaauuaauagcucgggcaaccucaucgcuccgcgggguuauuucaaaauccgcaccgggaagucuuccauuaugcgaucagacgcccccauaggaacguguaguagcgagugcaucacuccuaauggcuccauuccaaacgacaagcccuuucagaaugugaacaaaaucacauacggcgcguguccuaaguaugugaaacaaaauacccugaagcuggcaacugggaugagaaacauaccagaaaaacagacaaggggaauuuucggugccaucgcuggcuuuaucgagaaugggugggagggaauggucgauggcugguacgguuuccggcaccagaacucugaagggaccggccaggccgcagaccuuaagagcacgcaagcugccauugaucagaucaauggaaaauugaaccguguuauugagaagaccaaugaaaaguuccaccagauagagaaagaauuuucagagguggagggccgcauccaagaccucgaaaaguauguagaggauacaaaaauugaccuguggaguuacaacgcggaauuacugguggcccucgagaaucagcauacuaucgaucuuaccgacuccgaaaugaacaagcuguucgagaaaacaagaaggcaguugcgggagaacgcagaagauauggggaauggaugcuuuaagaucuaucacaagugugacaacgcuugcauugguagcauacgaaauggcacuuacgaucaugacgucuaccgcgacgaggcccuaaacaauagauuccagaucaaagggguggaacugaagucuggauauaaagauuggauucucuggaucucauuugcuauuaguugcuuccugcuuuguguugugcuguugggcuuuaucaugugggccugccaaaaggguaacauaagguguaauaucugcauuuga

SEQ ID NO: 122412 - RNA, 1701 nt, Artificial Sequence
  derived and/or modified sequence opt3 from hemagglutinin__InfluenzaA__ABB04294
augaagaccaucauugcccugagcuacauauucugccucgugcuuggccaggaccugcccgggaacgauaauuccacagcuacuuuguguuuaggacaccaugcagucccuaacgguacgcugguuaaaaccaucacaaaugaccaaauugaggugacuaacgccaccgaacuuguacagucuucaaguacaggcaagaucugcaauaacccacacaggauucucgaugggaucaauuguacccugauagacgcgcuucugggagauccgcauugcgacggcuuucagaacgagaaaugggauuuguucguggaaagaagcaaggcuuuuuccaauuguuaucccuacgacgucccugauuaugccucucuccggucgcugguggcaucaagcgguacucuggaguucaucaacgaaggguuuaauuggacaggaguuacccagaacggcggcaguaaugccugcaaacgcgggccagacuccggauucuuuucucgacucaacugguuauacaagagcgguuccacguaucccgugcugaaugucacuaugccuaacaacgauaauuucgacaagcuauacauuuggggcgugcaccauccaucaaccgaucaagagcagacaaacuuguauguacaggcuagugggcguguuacugugagcaccaaaagaucucagcaaacaaucauucccaauaucggauccaggccuuggguccggggccugucaagccgcauaaguauuuacuggaccaucgugaagccaggugacauucuagugaucaacucuaaugggaaccucaucgcaccgagaggauacuuuaaaaugaggacgggcaaguccagcauuaugcggucggacgcccccauaggcacuuguaucucugagugcauuacaccuaauggguccaucccaaacgauaaacccuuccagaaugucaacaagauaaccuauggagcuuguccuaaguacguuaaacagaauacucugaaacuugccacagguaugcgcaacgugccagaaaagcagacccgaggcauuuuuggggcgaucgcaggauucaucgagaauggcugggaagguaugauugacgggugguauggcuuuagacaccaaaacucagagggaacgggccaggccgcugaucugaagaguacccaggccgcaaucgaccaaauuaaugggaaauugaacaggguaauagagaagacaaacgaaaaauuccaccagaucgagaaggaguucagcgaaguggaaggacggauucaggaucucgagaaguacgucgaggacacuaaaaucgaucugugguccuauaaugcugaauuacugguggcccucgagaaccagcauaccaucgaccuuacagauucugaaaugaauaagcuguuugagaaaacucgucgccaauugagagaaaacgcggaggacauggguaauggcugcuucaagauuuaccacaaaugugauaacgccugcauagggagcaucaggaauggaaccuaugaccaugacguuuaccgggaugaggcacuaaacaaucgauuucagauuaagggcguggaacugaagucagguuacaaagacuggauccucuggauuaguuucgcuaucuccugcuuucugcuuugugucgugcuguugggguucauaaugugggccugccagaagggcaacauccgcuguaauauuugcaucuga

SEQ ID NO: 122413 - RNA, 1701 nt, Artificial Sequence
  derived and/or modified sequence opt3 from hemagglutinin__InfluenzaA__ABB04305
augaagaccaucauugcccugagcuacauauucugccucguguuugcucagaaacuucccgagaacgacaauuccacagcaacucuguguuugggccaccaugccgucccuaacgggacguuaguuaagaccaucacaaaugaucaaauugaagugacuaacgcgaccgagcugguacagucuucaaguacaggaagaaucugcgacagcccacacaggauucuagaugguaaaaauuguacccucaucgacgcucugcuuggcgauccgcauugcgacggguuccagaacgaaaagugggaucuguuuguggagcgguccaaagccuucucuaauuguuaucccuacgacgucccugauuaugcaucguugcgcucacucguggccagcaguggaacucuggaauuuauaaacgagggcuucaauuggacagguguuacccaguccgggggaucuuacgcuugcaagcgaggcagcgugaacuccuuuuucucacgucugaauuggcucuauaagagugagagcaaauacccagucuuaaacgugacgaugcccaauaacggcaaguuugacaaacuguauaucuggggaguacaccauccuucuacugauaaggaacaaaccaaucuuuacguuagagcauccgggaaagugacagucucaacuaagaggagccagcagaccgugauuccaaacaucgguagucggcccugggugcgcggcuugucuuccagaauuagcaucuacuggacaauagucaagccuggggacauucugcuaaucaacucgaccggaaaucucauugccccaaggggcuauuucaaaauccggacggguaagucuuccaucaugcgcucagaugcuccgauugggacuuguaguagcgagugcauaacacccaacggauccaucccuaaugacaaaccauuucagaacguuaauaagauuaccuacggcgccuguccccgauaugugaaacaaaacacucugaagcuggcgacaggcaugagaaauguaccugaaaaacagaccagggggaucuucggagcaauagccgguuuuauugagaacggcugggaggggaugguggacggaugguacggcuuccggcaccaaaauucugaagguacggggcaggcugccgaucuuaagagcacccaggcagcuaucgaccagaucaacggcaaguugaaucgucucauugagaaaacaaacgaaaaguuccaccagaucgagaaagaauuuucagaggucgagggacgcauucaagaucuggaaaaguauguggaggacacuaaaauagauuuauggaguuacaaugccgaacugcucguugcgcuugagaaccagcauaccaucgaccugacagauuccgaaaugaauaaguuguucgagaagacuagaaaacagcuaagggagaacgccgaagacaugggcaacgggugcuuuaagauuuaucacaaaugugauaaugcaugcaucggaagcauccggaacgguaccuacgaccaugauguguaccgagacgaggcucugaauaaccgcuuccagauuaagggcgucgaacucaaaucuggguauaaggacuggauacuguggaucucauuugccauuaguugcuuccuucugugugugguauugcucggauuuaucaugugggcuugccaaaagggcaauauuagauguaacaucugcauauga

SEQ ID NO: 122414 - RNA, 1701 nt, Artificial Sequence
  derived and/or modified sequence opt3 from hemagglutinin__InfluenzaA__ABB04316
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucuuaugcuugcaagcgaggcagcgugaaguccuucuuuucacgucugaacuggcuccacgagagugaguacaaauauccagcauuaaaugucacgaugcccaacaauggcaaguucgauaaacuguacaucuggggagugcaucacccuagcacugacagagaacaaaccaaccuuuacguaagggccucugggcggguuacaguguccacuaagcgcucacagcagaccgucauuccaaauaucgguagcagacccugggugaggggcuugaguucucggauuuccaucuauuggacaauagugaaaccuggggauauucugcuaaucaacagcaccggaaaccucauugcuccacgcggcuacuuuaagauccgaacggguaagucgucuaucaugagauccgacgccccgauugggacuuguucaagugagugcauaacacccaauggaagcaucccuaacgacaaaccauuccagaaugucaacaagauuaccuauggcgcgugucccagguacguuaaacaaaauacucugaaacuugcaacaggcaugcggaacgugccugaaaagcagacccgugggaucuuuggagccauagcugguuucauugagaauggcugggaggggaugguagauggaugguauggcuuucgccaccagaacuccgaagguacggggcaggccgcagaccugaagucuacccaagcugccaucgaucagaucaauggcaaauugaacagacucauugagaagacaaaugaaaaguuccaucagaucgagaaagaguucagcgaaguggagggaaggauucaagaccuggaaaaguacgucgaggauacuaaaauagacuuauggucauauaacgcggaacugcucguggcccuugagaaucagcacaccaucgaucugacagacagugaaaugaacaaguuguuugagaaaacucggaagcagcuacgagagaaugcagaagauaugggcaacgggugcuucaagauuuaccauaaaugugacaacgcuugcaucggauccauccgcaaugguaccuacgaucacgacguuuauagagacgaggcccugaacaauagguuucagauuaagggcguggaacucaaaagcggguacaagaacuggauacuguggaucucuuucgcuauuucaugcuuucuucugugugucguguugcucggauucaucaugugggccugccaaaaaggcaauauucgguguaacaucugcauauga

SEQ ID NO: 122415 - RNA, 1701 nt, Artificial Sequence
  derived and/or modified sequence opt3 from hemagglutinin__InfluenzaA__ABB04327
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacgcuugcaagcgaggcagcgugaacuccuuuuucucacgucugaauuggcucuauaagagugaguacaaauauccagcauuaaacgucacgaugcccaauaacgggaaguuugacaaacuguacaucuggggagugcaccauccuagcacugagaaggaacaaaccaaucuuuacguaagagccucugguaggguuacaguguccacuaaacggucacagcagaccgucauuccaaacaucggcagcauucccugggugcgcggguugaguucuagaaucuccauauauuggacaauugugaagccuggagauauccugcuaauuaacagcaccggcaaucucaucgcuccaagggguuacuucaagauccggacggggaaaucgucuauuaugcgcuccgacgccccgauaggaacuuguucaagugagugcaucacacccaacggcagcauuccuaaugauaagccauuucagaacgucaauaaaaucaccuauggcgcguguccccgauacguuaagcaaaacacucugaaacuugcaacagggaugagaaaugugccugaaaagcagaccaggggaauauucggugccauugcuggcuuuaucgagaacgggugggagggaaugguagacggcugguaugguuuccggcaccaaaauuccgaagggacgggccaggccgcagaccugaaaucuacccaggcugccaucgaucagauuaacggaaaguugaaucgucucaucgagaagacaaacgaaaaauuccaccagauugagaaggaauuuagcgagguggagggccgcauacaagaccuggaaaaauacgucgaggauacuaagaucgacuuauggucauauaaugcggaacugcucguggcccuugagaaccagcauaccauugaucugacagacagugaaaugaauaaauuguucgagaagacuagaaagcagcuaagggagaacgcagaagauauggggaacggaugcuuuaaaaucuaccacaagugugacaaugcuugcaucgguuccauucggaacggcaccuacgaucaugacguuuaucgagaugaggcccugaauaaccgcuuccagauaaaagggguggaacucaagagcggauacaaagacuggauccuguggauuucuuuugcuaucucaugcuuccuucugugugucguguugcucggcuuuauuaugugggccugccaaaaggguaauaucagauguaacauaugcaucuga

SEQ ID NO: 122416 - RNA, 1701 nt, Artificial Sequence
  derived and/or modified sequence opt3 from hemagglutinin__InfluenzaA__ABB04338
augaagaccaucauugcccugagcuacauauucugccucgugcuuggccaggacuuucccgggaacgauaauuccacagcuacucuguguuugggacaccaugcagucccuaacgguacguuaguuaaaaccaucacaaaugaccaaauugaggugacuaacgccaccgaacugguacagucuucaaguacaggcaagaucugcaauaacccacacaggauucuagaugggaucgacuguacccucauagaugcgcugcuuggagacccgcauugcgauggcuuccagaaugagacuugggaccuguuuguggaaagaagcaaggcuuucuccaacuguuaucccuacgaugucccugacuaugccucuuugcggucgcucguggcaucaagcgguacacuggaguuuaucaaugaaggguucaccuggacgggaguuacucagaacggcggcaguaaugccugcaaacgcgggccagauuccggauuuuucucucgacugaacuggcucuacaaaagcgguuccaccuaucccguguuaaaugucacaaugccuaacaaugacaacuuugauaagcuguacauuuggggcgugcaccauccaucaacugaccaagagcagaccagucuuuauguacaggcuagcgggcguguuacagugucuaccaagagaucccagcaaacgaucauucccaacaucggaucaaggccuuggguccggggcuugagcagucgcauaucuauuuacuggacuaucgugaaaccaggugacauucuggugcuaaauuccaacgggaaucucaucgcaccgagaggauacuucaagaugaggacaggcaaaagcucgaucaugcggucugaugcccccauuggcaccuguauauccgagugcaucacuccuaacgggucaauuccaaaugacaagcccuuucagaacgucaauaaaaucacauauggagcuuguccuaaguacguuaagcagaacacccugaaacuugccacggguaugcgcaaugugccagaaaagcagacccgaggccuguucggggcgauagcaggauuuauugagaacggcugggaagguaugaucgaugggugguauggcuucagacaccaaaauagugagggaacaggccaggccgcugacuugaaaagcacucaggccgcaaucgaucaaauuaacgggaagcucaauaggguaaucgagaaaaccaacgaaaaguuccaccagauugagaaagaauuuuccgagguggaaggacggauacaggaccuggagaaguacgucgaggauacaaagaucgacuuauggucuuauaaugcugaacugcucguggcccuugagaaccagcauacuauugaucugaccgacagcgaaaugaacaaauuguucgagaagacacgucgccaacuaagagaaaaugcggaggauauggguaacggcugcuuuaaaaucuaccacaagugugacaaugccugcaucgggucaauuaggaacggaaccuaugaccaugauguuuaccgggacgaggcacugaauaaccgauuccagauaaaaggcguggaacucaagagugguuacaaggauuggauccuguggauuuccuuugcuaucagcugcuuccuucugugugucguguugcucggguuuauuaugugggccugccagaaaggcaauauccgcuguaacauaugcaucuga

SEQ ID NO: 122417 - RNA, 1701 nt, Artificial Sequence
  derived and/or modified sequence opt3 from hemagglutinin__InfluenzaA__ABB04349
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacgcuugcaagcgaggcagcgugaacuccuuuuucucacgucugaauuggcucuauaagagugagagcaaauacccagucuuaaacgugacgaugcccaauaacgggaaguuugacaaacuguauaucuggggaguacaccauccuucuacugauaaggagcaaaccaaucuuuacguuagagcauccgguaaagugacagucucaacuaagaggagccagcagaccgugauuccaaacaucggcagucggcccugggugcgcggguugucuuccagaauuagcaucuacuggacaauagucaagccuggagacauucugcuaaucaacucgaccggcaaucucauugccccaagggguuauuucaaaauccggacggggaagucuuccaucaugcgcucagaugcuccgauuggaacuuguaacagugaaugcauaacacccaauggcagcaucccuaacgacaaaccauuucagaauguuaacaagauuaccuacggcgccuguccccgauaugugaaacaaaauacucugaaacuugcgacagggaugagaaacguaccugagaaacagaccaggggaaucuucggugcaauagccggcuuuauugaaaaugggugggagggaaugguggacggcugguacgguuuccggcaccagaacuccgaggggacgggccaggcugccgaucugaagucuacccaagcagcuaucgaccagaucaauggaaaguugaaccgucucauugaaaagacaaaugagaaguuccaccagaucgaaaaagaguuuagcgaagucgagggccgcauucaagaucuggagaaguauguggaagacacuaaaauagauuuauggucauacaacgccgagcugcucguugcgcuugaaaaucagcauaccaucgaccugacagauagugagaugaacaaguuguucgaaaagacuagaaaacagcuaagggagaacgccgaggacauggggaauggaugcuuuaagauuuaucacaaaugugauaacgcaugcaucgguuccauccggaauggcaccuacgaccaugauguguaccgagacgaagcucugaacaaucgcuuccagauuaagggggucgagcucaaaagcggauauaaggacuggauacuguggaucucuuuugccauuucaugcuuccuucugugugugguauugcucggcuuuaucaugugggcuugccaaaaggguaacauuagauguaauaucugcauauga

SEQ ID NO: 122418 - RNA, 1701 nt, Artificial Sequence
  derived and/or modified sequence opt3 from hemagglutinin__InfluenzaA__ABB04360
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucuuaugcuugcaagcgaggcagcgugaacuccuucuuuucacgucugaauuggcuccacaagagugaguacaaauauccagcauuaaacgucacgaugcccaauaacggcaaguucgauaaacuguacaucuggggagugcaucacccuagcacugacagagagcaaaccaaucuuuacguaagggccucugggcggguuacaguguccacuaagcgcucacagcagaccgucauuccaaacaucgguagcagacccugggugaggggcuugaguucucggauuuccaucuauuggacaauagugaaaccuggggauauucugcuaaucaacagcaccggaaaucucauugcuccacgcggcuacuuuaagauccgaacggguaagucgucuaucaugagauccgacgccccgauugggacuuguucaagugaaugcauaacacccaacggaagcaucccuaaugacaaaccauuccagaacgucaauaagauuaccuauggcgcgugucccagguacguuaaacaaaacacucugaaacuugcaacaggcaugcggaaugugccugagaaacagacccgugggaucuuuggagccauagcugguuucauugaaaacggcugggaggggaugguagauggaugguauggcuuucgccaccaaaauuccgaggguacggggcaggccgcagaccugaagucuacccaggcugccaucgaucagaucaacggcaaauugaauagacucauugaaaagacaaacgagaaguuccaucagaucgaaaaagaguucagcgaaguggagggaaggauucaagaccuggagaaguacgucgaagauacuaaaauagacuuauggucauauaaugcggagcugcucguggcccuugaaaaccagcacaccaucgaucugacagacagugagaugaauaaguuguuugaaaagacucggaagcagcuacgagagaacgcagaggauaugggcaacgggugcuucaagauuuaccauaaaugugacaaugcuugcaucggauccauccgcaacgguaccuacgaucacgacguuuauagagacgaagcccugaauaacagguuucagauuaagggcguggagcucaaaagcggguacaaggauuggauacuguggaucucuuucgcuauuucaugcuuucuucugugugucguguugcucggauucaucaugugggccugccaaaaaggcaauauucgguguaacaucugcauauga

SEQ ID NO: 122419 - RNA, 1701 nt, Artificial Sequence
  derived and/or modified sequence opt3 from hemagglutinin__InfluenzaA__ABB04371
augaagaccaucauugcccugagcuacauauucuaucucgcucuuggccaggaccugcccgggaacgauaauuccaaagcaacauugugcuuaggacaccaugccgugccuaacgguacucuggucaagacgaucaccgacgaucaaacagagguuacuaaugcgaccgaacuugugcagucuucaaguacaggcaaaauuuguaacaauccacacagaauccucgacgggauggauugcacccugauugacgcucuacugggagauccgcauugugacguauuucagaacgagacuugggauuuguucguggaaaggagcaaggccuuuuccaauugcuaccccuaugacgucccugauuacgcaucucuccggucgcugguggccucaagcggcacaauggaguucaucaccgaagguuuuacguggacugagguuacccagaacgggggaaguaaugcuuguaaacgcggcccagacuccggcuucuuuucucgacugaacuggcucacaaagagcgggcguacuuaucccguguuaaaugucaccaugccuaacaaugauaacuucgacaagcuguacauauggggagugcaccauccauccacagaccaagagcagaccaaucuuuauguacagacgucagguagaguuacugugaguacaaggcggagccagcaaaccaucauucccaacaucggcucucgcccuugggucagaggguuguccucaaggauuagcaucuacuggacuauagugaaaccaggagaugugcuggucauuaacaguaauggcaaccuaaucgcaccgcgggguuacuuuaagaugcgcacagggaaaucuuccauuaugcgaagcgacgcccccaucgauaccugcaucucggaauguauuacgccuaauggaucuauaccaaacgacaagcccuuccagaauguuaacaaaaucaccuauggcgcuugcccuaaguacgugaagcagaauacacucaaacuggccacuggcaugagaaacguaccagagaagcagaccagggggcuuuuuggagcgauugcagguuucaucgaaaauggcugggaggggaugauagauggaugguauggcuuucggcaccaaaacuccgaggguacagggcaggccgcugaccugaaaucaacucaggccgcaauugaucaaaucaauggcaaguugaaccguaucauugaaaagaccaaugagaaguuccaccagaucgaaaaagaguucagugaaguggagggacgcauucaggaccucgagaaguacgucgaagauacaaagauagaccuguggagcuauaacgcugaguuacugguggcccucgaaaaucagcauaccaucgaucuuacugacuccgagaugaacaaacuguuugaaaagacgagaaggcaauugcgggagaacgcggaggacaugggcaauggguguuucaaaauuuaccacaagugcgauaacgccuguaucgaaucuauccgaaauggaacauaugaccaugauguuuaccgcgacgaggcacuaaacaauagauuucagauuaaagguguggaacugaaaagcggcuacaaggauuggauacucuggaucucauucgcuauuaguugcuuucugcuuugcgucgugcuguugggguucaucaugugggccugucagaggggaaacauucggugcaauaucuguauauga

SEQ ID NO: 122420 - RNA, 1701 nt, Artificial Sequence
  derived and/or modified sequence opt3 from hemagglutinin__InfluenzaA__ABB04906
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucagaacggggauuccuaugcaugcaagcgaggaucugucaagagcuuuuucucccgucucaauugguuacacaaaucagaguacaaguauccagcccugaacgugaccaugcccaauaacgacaaauuugauaaacuuuacaucuggggcgugcaucacccuaguacggacagagagcaaacuagcuuguacauuagggcuucuggcaagguaaccguuuccacaaagcggucacagcagacugugaucccaaauauugggagccgccccugggucagaggacugaguucuaggaucuccauauauuggaccauugugaagccuggugacauccuacucauuaacagcacaggcaaccugaucgccccacggggguacuucaaaauccgcaccggaaagucgucuauuaugcgauccgaugcgccgauaggcacguguucaagugaaugcaucacucccaaugguagcauuccuaacgacaaaccauuucagaaugugaacagaaucacauauggggcaugucccagguacgucaagcaaaauacccuuaaacuggccacuggaaugcggaacguuccugagaagcagacacguggcauauucggcgcuauugccggguuuaucgaaaauggaugggaggguaugguggauggcugguauggguuccgccaccagaacuccgagggaaccggccaggcagcugacuugaaaucuacgcaagccgcgaucgaucagauuaaugguaagcucaacagacugaucgaaaagaccaaugagaaauuucaucagauugaaaaggaguucagcgaaguagaggggaggauacaagacuuagagaaauacguggaagauacaaagaucgaccuguggucauauaacgccgagcuccuugucgcacuggaaaaucagcacacuauugauuugaccgacagugagaugaacaaacuauucgaaaagacacggaagcagcugcgagagaaugcugaggauaugggcaacggaugcuuuaaaaucuaccauaagugugacaacgccugcaucggcuccauucgcaaugggacuuacgaccacgauguguauagagacgaagcucucaacaauagguuccagauaaaaggaguugagcuuaagagcgguuacaaagauuggauccuuuggauuucuuuugccaucucaugcuuccuguugugugugguccuccugggcuuuauuaugugggcaugccaaaaggggaacauccgguguaauauaugcaucuga

SEQ ID NO: 122421 - RNA, 1701 nt, Artificial Sequence
  derived and/or modified sequence opt3 from hemagglutinin__InfluenzaA__ABB04917
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagaucucuucaacagguagaauuugcgacaguccacacaggauccuagauggcaaaaauuguacccucauagacgcucugcuuggggauccgcauugcgacggauuccagaacgagaagugggaucuguuuguggaacggagcaaagccuucuccaauuguuaucccuacgacgucccugauuaugcaucuuugcgcucgcucguggccucaagcggcacucuggaguuuaucaacgaagguuucaauuggacagggguuacccagaguggaggcuccuacacgugcaagcgaggcucugugaacagcuuuuucucccgucugaauuggcucuaugagucagagaguaaguacccagucuuaaacgugacuaugcccaauaacgggaaauuugacaagcuguauauuuggggaguacaccauccuagcaccgauaaagaacaaacaaaucuuuacguuagagcuucugguagggugacugucuccaccaagcggucacagcagacagugaucccaaacauuggcagccgccccugggugagaggguugaguucuaggaucuccauauacuggaccauugucaaaccuggagacauccugcuaauuaacagcacgggcaaucucaucgcaccacgggguuauuucaagauccgcacugggaagucgucuauuaugcgauccgaugccccgauaggaacauguucaagugagugcaucacccccaacggcagcauuccuaaugacaaaccauuucagaacguuaauaagaucacuuacggcgcuugucccagauaugugaaacaaaacacacugaaacuugccaccgggaugaggaauguaccugaaaagcagacgcggggaauauucggugcgauugcaggcuuuaucgagaacgggugggagggaaugguggacggcugguacgguuuccgucaccaaaauuccgaagggaccggccaggccgcugaucugaagucuacacaggccgcaaucgaccagauuaacggaaaauugaaucgccucaucgagaagacuaacgaaaaguuccaccagauugagaaagaauuuagcgaggucgagggcagaauacaagaucuggaaaaguauguggaggacaccaaaaucgauuuauggucauacaaugcugaacugcucguugcccuugagaaccagcauacaauugaccugacugauagugaaaugaauaaguuguucgagaaaaccaggaagcagcuacgggagaacgcggaagacauggggaacggaugcuuuaagaucuaucacaaaugugauaaugccugcaucgguuccauucgaaacggcacauacgaccaugauguguaccgcgacgaggcacugaauaacagauuccagauaaagggggucgaacucaaaagcggauauaaggacuggauccuguggauuucuuuugcuaucucaugcuuccuucugugugugguauugcucggcuuuauuaugugggccugccaaaaagguaauaucagguguaacauaugcaucuga

SEQ ID NO: 122422 - RNA, 1701 nt, Artificial Sequence
  derived and/or modified sequence opt3 from hemagglutinin__InfluenzaA__ABB04928
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcaauaacccacacaggauucuagauggcaucaauuguacccucauagacgcucugcuuggggauccgcauugcgacggauuccagaacgagaaaugggaucuguuuguggaaagaagcaaggccuucuccaauuguuaucccuacgacgucccugauuaugcaucuuugcggucgcucguggccucaagcggcacucuggaguuuaucaacgaagguuucaauuggauugggguuacacagaacggaggcaguaaugcuugcaaacgcggcaccgacuccggguuuuucucucgacugaacuggcucuacaagagcggauccacguauccagugcaaaaugucacuaugcccaacaacgauaauucagacaaguuauacaucuggggugugcaccauccuaguaccgauaaagagcagacagaccuguauguacaggcaagcggcaagguuacugugucuaccaaacguucccagcaaacaauuaucccaaacgucgggucaagacccugggugaggggacuuagcagucggauaucuauuuacuggaccaucgugaagccuggcgacauuuuggucaucaauuccaacgguaaucugaucgccccacgcggguacuuuaaaaugagaacgggaaagagcucgauuaugaggucugaugcuccgauaggcacuuguuccucagagugcaucacacccaacggcaguauuccuaaugacaagccauuccagaacguuaauaaaaucaccuauggggccugucccaaguacgugaaacagaacacucuaaagcucgcgacaggaaugcggaauguaccugaaaaacagacccgcgguauauuuggcgcaauugccggguucaucgagaacggaugggaaggcaugaucgaugguugguauggguuucgacaccaaaauagcgagggcacgggacaggcugccgaccugaaguccacccaggcagcuauugaucaaaucaacggcaaacuuaauagagugauugagaagacaaacgaaaaguuccaccagauagagaaagaguucucugaagucgaagggaggauccaggaccuggagaaguacguggaggauacuaaaauugacuuguggagcuauaacgccgaacuccugguugcguuagagaaucagcauaccaucgaucugacagacucagaaaugaacaagcucuuugagaaaacucggcgucaacuucgcgaaaaugccgaggauaugggaaacgguugcuucaagaucuaccacaagugugacaaugcaugcauuggcaguauaagaaacgggaccuaugaccaugauguguacagggacgaggcucugaauaaccgguuucagaucaaaggagucgaauugaaguccggcuacaaagauuggauucuauggaucagcuucgccauuucuugcuuucugcucugugugguacugcuugguuucaucaugugggcuugccagaaggggaauauacgauguaacaucugcauuuga

SEQ ID NO: 122423 - RNA, 1701 nt, Artificial Sequence
  derived and/or modified sequence opt3 from hemagglutinin__InfluenzaA__ABB04939
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacacgugcaagcgaggcagcgugaacuccuuuuucucacgucugaauuggcucuaugagagugagagcaaguacccagucuuaaacgugacuaugcccaauaacgggaaauuugacaagcuguauaucuggggaguacaccauccuucuaccgauaaagaacaaacaaaucuuuacguuagagcuuccgguagggugacugucucaaccaagcggagccagcagacagugauuccaaacaucggcagucgccccugggugagaggguugucuuccaggauuagcaucuacuggaccauagucaaaccuggagacauucugcuaaucaacucgauuggcaaucucaucgcaccacgggguuauuucaagauccgcacggggaagucuuccauuaugcgaucagaugccccgauaggaaucuguaguagcgagugcauuacucccaacggcuccaucccuaaugacaaaccauuucagaacguuaauaagauaacauacggcgcuugucccagauaugugaaacaaaacacccugaagcuggccacugggaugaggaauguaccugaaaaacagacacggggaauuuucggugcgaucgcaggcuuuaucgagaacgggugggagggaaugguggacggcugguacgguuuccgucaccaaaauucugaagggaccggccaggccgcugaucuuaagagcacgcaggccgcagucgaccagauuaacggaaaauugaaucgccucaucgagaagaccaacgaaaaguuccaccagauugagaaagaauuuucagagguggagggcagaauacaagaucuggaaaaguauguugaggacacaaaaaucgauuuauggaguuacaaugcugaacugcucguggcccuugagaaccagcauacuauugaccugaccgauuccgaaaugaauaaguuguucgagaaaacaaggaagcagcuacgggagaacgcggaagacauggggaacggaugcuuuaagaucuaucacaaaugugauaaugccugcaucgguagcauucgaaacggcacuuacgaccaugaugucuaccgcgacgaggcacugaauaacagauuccagauaaaggggguggaacucaaaucuggauauaaggacuggauccuguggauuucauuugcuaucaguugcuuccuucuguguguaguuuugcucggcuuuauuaugugggccugccaaaaagguaauaucagguguaacauaugcaucuga

SEQ ID NO: 122424 - RNA, 1701 nt, Artificial Sequence
  derived and/or modified sequence opt3 from hemagglutinin__InfluenzaA__ABB04950
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacacgugcaagcgaggcagcgugaacuccuuuuucucacgucugaauuggcucuaugagagugagagcaaguacccagucuuaaacgugacuaugcccaauaacgggaaauuugacaagcuguauaucuggggaguacaccauccuucuaccgauaaagaacaaacaaaucuuuacguuagagcuuccgguaaggugacugucucaaccaaaaggagccagcagacagugauuccaaacaucggcagucggcccugggugcgcggguugucuuccagaauuagcaucuacuggaccauagucaagccuggagacauucugcuaaucaacucgacgggcaaucucauugcaccaagggguuauuucaagauccggacugggaaaucuuccaucaugcgcucagaugccccgauuggaacauguaguagcgagugcauaacccccaacggcuccaucccuaaugacaagccauuucagaacguuaauaaaauuacuuacggcgcuuguccccgauaugugaagcaaaacacacugaaacuugccaccgggaugagaaauguaccugaaaagcagacgaggggaaucuucggugcgauagcaggcuuuauugagaacgggugggagggaaugguggacggcugguacgguuuccggcaccaaaauucugaagggaccggccaggccgcugaucugaaaagcacacaggccgcaaucgaccagaucaacggaaaguugaaucgucucauugagaagacuaacgaaaaauuccaccagaucgagaaggaauuuucagaggucgagggccgcauucaagaucuggaaaaauauguggaggacaccaagauagauuuauggaguuacaaugcugaacugcucguugcccuugagaaccagcauacaaucgaccugacugauuccgaaaugaauaaauuguucgagaagaccagaaagcagcuaagggagaacgcggaagacauggggaacggaugcuuuaaaauuuaucacaagugugauaaugccugcaucgguagcauccggaacggcacauacgaccaugauguguaccgagacgaggcacugaauaaccgcuuccagauuaaaggggucgaacucaagucuggauauaaagacuggauacuguggaucucauuugcuauuaguugcuuccuucugugugugguauugcucggcuuuaucaugugggccugccaaaaggguaauauuagauguaacaucugcauauga

SEQ ID NO: 122425 - RNA, 1701 nt, Artificial Sequence
  derived and/or modified sequence opt3 from hemagglutinin__InfluenzaA__ABB04983
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagacagaaucugcgauagcccacaccagauucucgacggugagaauuguacccugaucgaugcccuucugggcgacccgcauugcgauggguuucagaacaaagaaugggacuuguucguggagagguccaaggcuuauucuaauuguuaccccuaugaugucccugacuacgugucgcuccggucacugguugcaagcaguggaacucuggaauuuaacaaugaguccuucaacuggacaggcguggcccaaaaugguaccucuagcgcuugcaaacgccgauccgauaagucauuuuucagucgucucaacugguuacaccagcugaaguauaaauacccagcacuuaaugucacgaugcccaacaaugagaaguuugacaaauuguauauauggggagugcaucacccugggacugauagcgaccagaucucucuguacgcccaggcuuccggcagaguaaccguuucaacaaagaggagccaacagacugugauuccaaacaucggcagucggcccuggguccgcggggugucuuccagaauuagcaucuacuggaccauagugaaaccuggagacauucuacucaucaacucgacagguaaucugauugccccaaggggcuauuucaagauccggucugggaaguccucaaucaugcgcagugaugcgccgauuggaaaauguaacagcgaaugcauaacccccaauggcuccaucccuaacgacaagccauuucagaaugucaaccgaauuacguacggucccuguccuagauauguuaaacagaauacucuuaagcuggcaacagggaugaggaacgugccagagaaacaaacccggggaaucuucggcgccauagcuggcuuuauugaaaaugggugggagggaaugauggaugguugguacggcuuccgucaccagaacucugaggggacuggacaggccgcagaccuaaagagcacacaagcugccaucaaucagaucaacggcaaacucaaucgccugauugaaaagaccaacgagaaguuucaucagaucgaaaaagaguucucagaaguagaggguaggauucaggauuuagagaaguauguggaagacacgaaaauagaucuguggaguuacaaugcggagcuccuugucgcccuggaaaaccaacacaccaucgacuugacagauuccgagaugaacaagcuauucgaaagaacuaaaaagcagcugcgggagaaugcagaggacauggggaacggcugcuuuaagauuuaucauaaaugugauaaugcuugcaucggaagcauccgaaacggcaccuacgaccacgacguguaccgcgaugaagcccucaauaacagauuccagauuaaggggguugagcugaaaucuggauauaaggacuggauacuuuggaucucauuugcuauuaguugcuuccuguuguguaucgugcuccuggguuuuauuaugugggccugccagaaaggcaauaucagguguaacauaugcaucuga

SEQ ID NO: 122426 - RNA, 1701 nt, Artificial Sequence; identical to SEQ ID NO: 122188
  derived and/or modified sequence opt3 from hemagglutinin__InfluenzaA__ABB04994

SEQ ID NO: 122427 - RNA, 1701 nt, Artificial Sequence
  derived and/or modified sequence opt3 from hemagglutinin__InfluenzaA__ABB05005
augaagaccaucauugcccugagccacauacucugccuuguguucgcucagaaacugcccgucaacgacaauuccacagcaacuuuguguuuaggccaucacgccguuccuaacgggacgcuggugaagaccaucacaaaugaucauauugagguaacuaacgcgaccgaacuugugcaaucuucaaguacaggaagaaucugcgacagcccacaccagauucucgauggugagaauuguacccugaucgacgcucuacugggcgauccgcauugcgacggguuucagaacaaagaaugggauuuguucgucgagagguccacugccuacucuaauuguuaucccuacgacgugccugauuaugcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaccaacugaaguacaaguauccagcccuuaaugucacuaugcccaacaaugagaaauuugacaaguuguacaucuggggagugcaccauccuagcaccgauucugaccagauuucccuguaugcucaggccucagggagaguaacaguuagcacuaaaaggagucagcaaaccgugaucccagauauuggcucucggcccuggguccgcggcguguccagcagaaucucgauauacuggacaauugugaagccuggggacauccuacucauuaacucuaccggaaaccugaucgcgccaagggguuacuucaaaauccgguccggcaagucaaguauuaugcgcagcaaugcaccgauagggaaguguaacuccgaaugcaucacgcccaauggaucugucccuaacgacaaaccauuucagaauguuaaccgaauuacuuauggcgccugucccagauacgugaagcagaauacacuuaaacuggcuaccgguaugaggaacguaccugagaagcagacucgggggaucuucggagccauagcaggcuuuauugaaaauggcugggaggggaugguggauggaugguaugguuuccgucaccaaaacagcgagggcacagggcaggcugccgacuugaaaucaacccaggcggccaucaaucaaaucaacggaaagcucaaucgccugauugagaaaacgaacgaaaaguuucaucagaucgaaaaggaguucagugaagucgagggcaggauucaggauuuagagaaauacguggaagacaccaagauagaucugugguccuauaaugcagagcuccuuguugcucuggaaaaccagcacacaaucgacuugacugauagcgagaugaacaaacuauucgaaagaacccggaagcaacugcgagagaaugccgaggacauggguaacgggugcuuuaaaauuuaccacaagugugauaaugcuugcaucggcucuauccgcaacggaacauaugaccaugauguguacagagacgaagcccucaauaacagguuccagauuaagggcgucgagcugaaaucaggguacaaggacuggauacuuuggaucaguuuugcaauuagcugcuuccuguugugugugguacuccugggauuuaucaugugggccugccagaaagguaauauucgguguaacaucugcauauga

SEQ ID NO: 122428 - RNA, 1701 nt, Artificial Sequence
  derived and/or modified sequence opt3 from hemagglutinin__InfluenzaA__ABB05183
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugagcacauugaaguaacuaacgcgaccgagcuagugcaaucuucaaguacaggaagaaucugcgauagcccacaucagauucucgacggugaaaauuguacccugaucgaugcccuucugggcgacccgcacugcgauggguuucagaacaaagagugggacuuguucgucgaaagguccacugcuuauucuaauuguuaccccuaugaugugccugacuacgcaucgcuccggucacugguugccagcaguggaacacuggaguuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugaaaaauuugauaaguuguauaucuggggagugcaccacccuagcaccgacucugaucagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggacauccuacucauuaacucuaccggaaaucugaucgcgccaagggguuauuucaaaauccgguccggcaagucaaguauuaugcgcagcaacgcaccgauagggaaguguaauuccgagugcaucacgcccaacggaucuauuccuaaugauaaaccauuucagaacgucaaucgaaucacuuacggcgccugucccagauauguuaagcagaacacacuuaaacuggcuaccgguaugaggaaugugccugaaaagcagacucgggggauauucggagccauugcaggcuuuaucgagaacggcugggaggggaugguagacggaugguacgguuuccgucaucaaaauagcgaaggcacagggcaggcugccgacuugaaaucaacccaggcggccaucaaccaaauuaauggaaagcucaaccgccugaucgagaaaacgaaugaaaaguuucaccagauugagaaggaguucagugaaguggagggcagaauacaggauuuagaaaaauaugucgaggacaccaagaucgaucugugguccuacaacgcagaacuccuuguggcucuggagaaccagcauacaauugacuugacugauagcgaaaugaauaaacuauucgagaggacccggaagcaacugcgagagaacgccgaagacauggguaaugggugcuuuaaaguuuaucacaagugugauaacgcuugcaucggcucuauccgcaauggaacauacgaccacgauguguacagagacgaggcccucaacaauagguuccagauuaagggcgucgaacugaaaucaggguauaaggauuggauacuuuggaucaguuuugcaauuagcugcuuccuguugugugugguacuccugggauuuaucaugugggccugccagaaagguaacauucgguguaauaucugcauauga

SEQ ID NO: 122429 - RNA, 1701 nt, Artificial Sequence
  derived and/or modified sequence opt3 from hemagglutinin__InfluenzaA__ABB05194
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugauaaugcccaauaacgagaaguuugacaaauuguauaucuggggaguccaucacccuagcacggauucugaccagauuucccuguacgcucaggccucaggcagagugacuguaagcaccaagaggagucaacagacaguuaucccaaacauuggcucucggcccugggugcgcggggucuccagcagaaucucgauauacuggacuauugugaaaccuggagauauccuacucauuaauucuaccgguaaccugaucgcgccaaggggcuauuucaagauccgguccgggaagucaagugugaugcgcagcgacgcauccauuggaaaauguaauucugaaugcauaacaccgaacggcagcauccccaaugacaagccuuuucagaacgucaaucgaauuaccuacggugccuguccaagauauguuaaacagaacacgcuuaagcuggcuacugggaugaggaaugugcccgagaaacaaacacggggaaucuucggcgccauagcaggcuuuauugaaaacgggugggagggaaugguagaugguugguacggcuuccgucaccaaaauucagaggggaccggacaggcugccgacuugaagaguacucaggcggccaucaaccagaucaauggcaaacucaaccgccugauugaaaagacaaaugagaaguuucaucagaucgaaaaagaguucuccgaaguggaggguaggauucagaacuuagagaaguaugucgaagauaccaaaauagaccuguggagcuacaacgcagagcuccuuguggcucuggaaaaucaacacacgaucgauuugaccgacucugagaugaacaagcuauucgaaagaacuaaaaagcagcugcgggagaaugccgaggauauggggaacggcugcuuuaagauuuaucauaaaugugacaaugcuugcaucggaucaauccgaaacggcacauacgaucacgacguuuaccgcgaugaagcccucaauaacagauuccagauuaaggggguggagcugaaaaguggauauaaggacuggauacuuuggaucagcuuugcaauuuccugcuuccuguugugugucgugcuccuggguuuuaucaugugggccugccagaaaggcaauauuagguguaacaucugcauauga

SEQ ID NO: 122430 - RNA, 1701 nt, Artificial Sequence
  derived and/or modified sequence opt3 from hemagglutinin__InfluenzaA__ABB05205
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaugccuauucuaacuguuaccccuaugacgucccugauuacgcaucgcuccggucacugguggccagcaguggcacucuggaauuuaauuccgagucuuucaacuggacagguguugcucaaaaugggaccagcuccgcaugcaagcgccgaucaaacaaaaguuucuuuagccgucucaauugguuacaccagcugaaguauaaguacccagcccuuaacgugacgaugcccaauaacgagaaauuugacaaguuguauauauggggaguccaucacccuggcacugauucugaccagaucucccuguacgcucaggccucaggcagagugaccguaagcacaaaaaggagucaacagacuguuauuccaaacaucgggucucggcccugggugcgcggagucuccagcagaauuucgaucuacuggaccauagugaagccuggugauauucuacucaucaauucuacaggcaaccugauugcgccaaggggguauuucaaaauccgguccggaaagucaaguaucaugcgcagcgacgcaccgauuggcaaguguaauuccgaaugcauaacccccaacgguucuaucccuaauaacaaaccauuucagaaugugaaccgaauuacguacggggccugucccagauaugucaagcagaauacucuuaaacuggcuacaggaaugaggaacguuccugagaagcaaacccggggcaucuucggcgccauagcaggguuuauugaaaauggaugggaggguaugguggacggcugguacggguuccgucaccagaacagcgagggaacuggccaggcugccgauuugaaaucaacacaagcggccaucaaucagaucaacgguaagcucaaucgccugauugagaaaaccaacgaaaaguuucaucagaucgaaaaggaguucagugaaguagaggggaggauucaggacuuagagaaauauguggaagauacgaagauagaccugugguccuacaacgcagagcuccuugucgcucuggaaaaucaacacaccaucgauuugacagacagcgagaugaacaaacuauucgaaagaacuaagaaacagcugcgggagaaugccgaggauaugggcaacggaugcuuuaagauuuaucauaagugugacaaugcuugcaucggcucuauccgaaacgggaccuacgaucacgacguguaccgcgaugaagcccucaauaacagauuccagauuaaaggaguugagcugaagucagguuauaaagacuggauacuuuggaucaguuuugcaauuagcugcuuccuguugugugugguccuccugggcuuuaucaugugggccugccagaaggggaauauuagguguaacaucugcauauga

SEQ ID NO: 122431 - RNA, 1701 nt, Artificial Sequence; identical to SEQ ID NO: 122088
  derived and/or modified sequence opt3 from hemagglutinin__InfluenzaA__ABB05216

SEQ ID NO: 122432 - RNA, 1701 nt, Artificial Sequence
  derived and/or modified sequence opt3 from hemagglutinin__InfluenzaA__ABB46392
augaagaccaucauugcccugagcuacauauucugccucgcuuuugcacaggaccuucccggcaacgauaauuccacagccacucuguguuuggggcaccaugcggugccuaacggaacguuagucaaaaccaucacaaaugaccaaauugagguuacuaacgcuaccgaacuggugcagucuucaaguacagguaagaucugcgauaauccacacaggauucuagacggcaucaacuguacccucauagaugcccugcuuggggacccgcauugcgauggauuccagaaugagaaaugggaccuguuuguagaaagaagcaaggcauucuccaacuguuaucccuacgaugugccugacuaugccucuuugcggucgcucgucgcuucaagcggcacucuggaguuuaucaaugaagguuucaacuggacaggggugacccagaauggaggcaguuccgcaugcaaacgcggcccagauaacggguuuuucucucgacugaauuggcucuacaagagcggauccacguaucccguucaaaacgugacuaugccuaauaacgacaacucagauaaguuauacauuugggguguccaccauccaaauaccgacaaagagcagacagaccuguaugugcaggccaguggcaagguaacuguuagcaccaaacguucucagcaaacaaucauucccaacgugggguccagaccuugggucaggggacuuucaagccgggugaguaucuacuggaccauagugaagccaggcgauauuuuggucaucaauucuaacgguaaucugauugcuccgcgcggguacuuuaaaaugagaacgggaaaguccagcaucaugaggucggacgcccccaucggcacuuguucuuccgagugcauuacaccuaacggcucaauaccaaaugauaagcccuuccagaacguuaauaaaaucaccuauggggcguguccuaaguacgugaaacagaacacucuaaagcucgcaacaggaaugcggaauguaccagaaaaacagacccgcgguauuuuuggcgccaucgcuggguucauagagaacggaugggaaggcaugauugacgguugguauggguuucgacaccaaaauagugagggcacgggacaggccgcagaucuuaagagcacccagacagcuaucgaccaaaucaacggcaaacugaauagagugauugagaagacuaacgaaaaguuccaccagaucgagaaagaguucuccgaagucgaagggaggauucaggaucuggagaaguacguggaggacaccaaaauagauuuguggucuuauaacgccgaacuccugguugcguuagagaaucagcauacaaucgaccugacugauagcgaaaugaacaagcucuuugagaaaacccggcgucaacuucgcgaaaaugccgaggacaugggaaacgguugcuucaagauuuaccacaagugugacaaugcaugcaucggcucaaucagaaacgggacauaugaucaugacguguacagggaugaggcucugaauaaccgguuucagauuaaaggagucgaauugaagaguggcuacaaagacuggauacuauggaucuccuucgccauuagcugcuuucugcucugugugguacugcuugguuucaucaugugggcuugccagaaggggaauauucgauguaacaucugcauauga

SEQ ID NO: 122433 - RNA, 1701 nt, Artificial Sequence
  derived and/or modified sequence opt3 from hemagglutinin__InfluenzaA__ABB46414
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcgagaauuguacccugaucgacgcucuacugggggauccgcauugcgacggauuucagaacaaagaaugggauuuguucguggagcgguccaaggccuauucuaauuguuaccccuaugacgucccugauuacgcaucgcuccgcucacugguggccagcaguggcacucuggaauuuaacaaugaguccuucaacuggacagguguugcucagaaugggaccucuagcgcaugcaaacgacguuccauaaagucauuuuucaguagacucaacugguuacaccaacugaaguauaaauacccagcccuuaaugugacgaugcccaacaaugacaaguuugauaaauuguauaucuggggaguccaucacccuagcacugacucugaucagaccucccuguacgcucaggccucaggcagggugacaguaagcacuaagcggagucagcaaaccguuauuccaaacaucggcucucgccccugggugagaggggucuccagcaggauuucgaucuacuggacaauagugaaaccuggagacauucuacucaucaacucuaccgguaaucugauugcgccacggggcuauuucaagauccgcuccgggaagucaaguaucaugcgaagcgacgcaccgauuggaaaauguaacuccgagugcauaacgcccaauggcucuaucccuaacgauaagccauuucagaaugugaacagaauuacuuacggugccugucccagguaugucaaacagaauacacuuaagcuggcuaccgggaugcggaacguuccugaaaaacagacucguggaaucuucggcgccauagcaggcuuuauugagaaugggugggaaggaaugguggacgguugguacggcuuccgccaccaaaacagcgaggggacaggacaggcugccgauuugaagucaacccaggcggccaucaaucaaaucaacggcaaacucaauagacugauugagaagacgaacgaaaaguuucaucagaucgagaaagaguucagugaaguagaagguaggauucaggacuuagagaaguauguggaggauaccaaaauagaccugugguccuacaaugcagaacuccuugucgcucuggagaaccagcacacaaucgauuugacugacagcgaaaugaacaagcuauucgagcggacccgaaaacaacugcgcgaaaaugccgaggauauggggaacggcugcuuuaagauuuaucauaagugugacaaugcuugcaucggaucuaucagaaacggcacauacgaucacgacguguacagggacgaggcccucaauaaccgguuccagauuaaagggguugaacugaagucaggauauaaagauuggauacuuuggaucaguuuugcaauuagcugcuuccuguuuuguguggucuugcucgguuucaucaugugggccugccagaagggcaauauucgcuguaacaucugcauauga

SEQ ID NO: 122434 - RNA, 1701 nt, Artificial Sequence
  derived and/or modified sequence opt3 from hemagglutinin__InfluenzaA__ABB46425
augaagaccaucauugcccugagcuacauacucugccuuguguucgcucagaaacugcccggcaacgacaauuccacagcaacuuuguguuuagggcaccaugccgucccuaacggaacgcugguuaagaccaucacaucugaucaaauugaggugacuaaugcgaccgaacuuguacagucaaguagcacagguaaaaucugcgacuccccacacaggauucucgauggcgagaacuguacccugaucgacgcucuacugggggauccgcauugcgacggauuucagaauaaggaaugggauuuguucguggagagaucuaaagccuauucgaacuguuaccccuaugacgucccugauuacgcaucacuccggagccugguggccaguuccggcacucuggaauuuaauaacgagucuuucaauuggacagguguugcucagaacgggaccagcuuugcaugcaagcgccgauccauaaagucauucuuuagucgucucaauugguuacaccaacugaaauauaaguacccagcccuuaacgugacgaugcccaauaacgacaaauucgauaaguuguauaucuggggaguccaucacccuagcacugacucugaucagaccucccuguacgcucaggccucaggcagagugacaguaagcacuaaaaggagucagcaaaccguuauuccaaauaucggcucucggcccugggugcgcggggucuccagcagaauuucgaucuacuggacaauagugaagccuggagacauucuacucaucaacucuaccgguaaccugauugcgccaaggggcuauuuuaagauccgguccgggaaaucaaguaucaugcgcagcgacgcaccgauuggaaaguguaauuccgagugcauaacgcccaacggcucuaucccuaaugauaaaccauuccagaacgugaaucgaauuacuuacggugccugucccagauaugucaagcagaacacacuuaaacuggcuaccgggaugaggaauguuccugaaaagcagacucggggaaucuuuggcgccauagcaggcuucauugagaacgggugggaaggaaugguggacgguugguacggcuuucgucaccaaaauagcgaggggacaggacaggcugccgauuugaaaucaacccaggcggccaucaaccaaaucaauggcaagcucaaccgccugauugagaagacgaaugaaaaauuccaucagaucgagaaggaguucagugaaguagaagguaggauucaggacuuagagaaauauguggaggauaccaagauagaccugugguccuacaacgcagaacuccuugucgcucuggagaaucagcacacaaucgauuugacugacagcgaaaugaacaaacuauuugagagaacccggaagcaacugcgagaaaacgccgaggauauggggaauggcugcuucaagauuuaucauaaaugugacaacgcuugcaucggaucuauccgcaauggcacauacgaucacgacguguacagagacgaggcccucaacaauagguuucagauuaaggggguugaacugaaaucaggauauaaggauuggauacuuuggaucaguuucgcaauuagcugcuuucuguugugugugguccuccuggguuucaucaugugggccugccagaaaggcaacauucgguguaauaucugcauauga

SEQ ID NO: 122435 - RNA, 1701 nt, Artificial Sequence
  derived and/or modified sequence opt3 from hemagglutinin__InfluenzaA__ABB46436
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguacgacaaacuuuauaucuggggcguccaccauccuggcacagauaaugaccagauuagcuuguacgcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguauuucaagauacggagcggaaagucgucuaucaugcgcuccgacgcgcccauuggcaaauguaauucagagugcaucacuccuaacgguaguauaccaaaugauaagcccuuucagaacgucaaucgaauuacauacggggcauguccuagauaugugaaacagaacacccugaaacuugccacuggaaugaggaaugugccagaaaagcaaacacggggcaucuucggcgcuaucgccggguuuauugagaacggaugggaagguauggucgacggcugguacggguuccgucaccagaauagcgagggaaucggccaggcagcugaucugaaguccacccaagccgcgauuaaccagauaaaugguaaauugaaccgccucaucgggaagacgaacgagaaguuucaccagauugaaaaagaguucucugaaguugagggcagaauccaggaccuggaaaaguauguggaggauaccaaaaucgacuuauggagcuacaaugccgagcugcucguagcacuugaaaaccaacauacaauugaucugacugacucagagaugaauaaguuguucgaaaggaccaaaaagcagcuacgggagaacgcugaagauaugggaaauggcugcuuuaagauauaucacaaaugugacaacgccugcaucgggaguauucgaaauggaacauacgaucaugacguguaccgcgacgaggcucugaacaauagauuccagaucaagggugucgagcucaaauccggcuauaaggauuggauucuguggaucagcuuugccauaucuugcuuccuucuguguguggcauugcucggguuuaucaugugggccugccagaaaggaaacauuagguguaauaucugcauuuga

SEQ ID NO: 122436 - RNA, 1701 nt, Artificial Sequence; identical to SEQ ID NO: 122369
  derived and/or modified sequence opt3 from hemagglutinin__InfluenzaA__ABB46447

SEQ ID NO: 122437 - RNA, 1701 nt, Artificial Sequence
  derived and/or modified sequence opt3 from hemagglutinin__InfluenzaA__ABB46458
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaaaccaacagacaguaauuccaaauaucggaucaaggccccggguucgcgauauaccuagcagaauuaguaucuacuggaccauugugaaaccaggugacauccugcuaaucaacucuacgggcaaucucauugccccgaggggguacuuuaagauacgguccggaaagagcucgaucaugcgcucugacgcgcccauuggcaaauguaaguccgagugcaucacuccuaacgguucaauaccaaaugauaaacccuuccagaacgucaaucgaauuacauauggggcauguccuagauacgugaagcagaacacccugaaacuugccacuggaaugaggaaugugccagaaaagcaaacacggggcaucuuuggcgcuaucgccggguucauugagaacggaugggaagguauggucgacggcugguauggguuucgucaccagaauagugagggaaucggccaggcagcugaucugaaaagcacccaagccgcgauuaaccagauaaaugguaaguugaaccgccucaucgggaagacgaacgagaaauuccaccagauugaaaaggaguucuccgaaguugagggcagaauccaggaccuggaaaaauacguggaggauaccaagaucgacuuauggucuuauaaugccgagcugcucguagcacuugaaaaccaacauacaauugaucugacugacagcgagaugaauaaauuguuugaaaggaccaagaagcagcuacgggagaacgcugaagauaugggaaauggcugcuucaaaauauaccacaagugugacaacgccugcaucgggucaauucgaaauggaacauaugaucaugacguguaccgcgacgaggcucugaacaauagauuucagaucaaaggugucgagcucaagaguggcuacaaagauuggauucuguggaucuccuucgccauaagcugcuuucuucuguguguggcauugcucggguucaucauguggggaugccagaagggcaacauuagguguaauaucugcauuuga

SEQ ID NO: 122438 - RNA, 1701 nt, Artificial Sequence
  derived and/or modified sequence opt3 from hemagglutinin__InfluenzaA__ABB51961
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuuuuucaacagguggcauuugcgacaguccacaccagauccuagauggggagaauuguacccucauagacgcucugcuuggagauccgcagugcgacggcuuccaaaacaaaaagugggaucuguuuguggaaagaagcaaagccuauuccaauuguuaccccuaugacgucccugauuacgcaugcgugaggucuuugguugccucgucagguacucucgaguucaacaaugagagcuuuaacugggcuggggugacacagaauggaaccaguuccgcauguaagcggcgcucuaacaagagcuucuuuucccgacugaauuggcugacgcaucucaaauauaaguacccagccuuaaacgucacuaugcccaauaacgaaaaauucgacaagcuguauaucuggggcgugcaccauccuggcaccgauucagaccagauuagucuuuacgcucaggccagcgggcguaucacaguaucuacucaaagaugcaaacaguugguuauuccaaacaucggauccaggccccgggugcgcgaugucucaagcagaauaaguauuuacuggaccaucgugaauccuggugacauucugcuaaucaacucuacaggcaaucucaucgcgccaaggggguauuuuaagauucgguccggaaagagcucgauaaugcgcucugacgcaccgaucggcaaauguaacuccgagugcauuacccccaaugguucaaucccuaacgauaagccauuccagaaugugaaccgaauaacguacggggccugucccagauaugucaaacagaauacucugaagcuggcuacaggaaugaggaacguuccugaaaaacaaacccggggcauuuuuggcgccaucgcaggguucaucgagaauggaugggaagguaugguggacggcugguacggguuucgucaccagaacagugagggaacuggccaggcugccgaucuuaagagcacacaagcggccauuaaucagaucaacgguaaauugaaucgccucauugggaagaccaacgagaaguuccaccagauagaaaaagaguucuccgaaguagagggcagaauccaggaccuggaaaaguauguggaggauacgaaaauugacuuauggucuuacaacgcagagcugcucgucgcucuugaaaaucaacauaccaucgaucugacagacagcgagaugaacaaguuguuugaaaggacuaaaaagcagcuacgggagaaugccgaagauaugggaaacggcugcuucaagaucuaucacaaaugcgacaaugcuuguauugagucaauacgaaacgggaccuacgaucaugacguguaccgcgacgaggcccugaauaacagauuucagaucaagggaguugaacucaaaagugguuauaaggauuggauucuguggaucuccuucgcaauuagcugcuuucuucuguguguggccuugcucggcuucaucaugugggcuugccagaaagggaauauaagguguaacaucugcauuuga

SEQ ID NO: 122439 - RNA, 1698 nt, Artificial Sequence
  derived and/or modified sequence opt3 from hemagglutinin__InfluenzaA__ABB51962
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguucuaguacucuggggagugcaucacccuccaaacaucgggaaccagcgcgcccuguaccacacugagaaugcuuaugucuccguggugucaagccauuacagucgacguuucacccccgaaauagcaaagagaccuaaagucagggaucaggagggucggaucaacuauuacuggacacuucuggaaccaggcgacacuauuaucuuugaggccaaugggaacuugauugcuccgugguaugccuucgcgaugucucgcggauuuggcuccgguaucagcaccucgaaugcacccaugggggagugugaugccaaguuccagacaccucaaggaggcauaaacauuucucucccauuucagaauguucaccccgugaccaucggcgaaugcccuaacuacguaagauccgcuaagcugaggauggugacgggguuacggaauauuccaucaauccagagucgcggacuguucggugccaucgcaggcuuuauugaagggggauggacuggcauggucgacgguugguauggguaccaucaccagaacgaacaaggcagcggauacgcugccgaucagaaauccacacagaaugcgauaaacggcaucaccaauaaggugaacucuguuauugagaaaaugaauacucaguucacagccguggggaaggaguucaacaaacucgagcgaagaauggagaaccuuaauaagaaagucgacgauggauuucuggacaucuggaccuauaacgcagaauugcuagugcugcucgagaaugaaaggacgcuggauuuccacgacagcaacguaaagaaucuuuacgagaagguuaaaucacaacugaagaacaaugcuaaagaaauagguaacggcuguagugaguuuuaucauaagugcaauaacgaguguauggaauccgugaaaaaugggaccuacgacuaucccaaguacagcgaggaaucuaaguugaaccgggagaaaauugauggagucaagcucgagucaaugggcguguaucagauccuggccaucuacaguacagucgcuagcuccuuagugcugcuaguuucucucggugccauuucguucuggaugugcagcaaugggucccugcagugccguaucuguauuuga

SEQ ID NO: 122440 - RNA, 1701 nt, Artificial Sequence
  derived and/or modified sequence opt3 from hemagglutinin__InfluenzaA__ABB51963
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaucuucaaguacagguggcauuugcgacagcccacaccagauccuagauggggagaauuguacccucauagacgcucugcuuggagauccgcagugcgacggcuuucagaacaaaaagugggaucuguucguggaaagguccaaagccuauucuaauuguuaccccuaugacgucccugauuacgcaucguugcggucacucguggccagcagugguacucuggaguuuaacaaugaauccuucaacuggacagggguuacccaaaauggaacgucuagcgcuugcaagcgccgauccaacaauucauuuuucagucgucugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggagaaucacuguguccaccaagaggucacagcaaacaguaauuccaaacaucggaagccggccccgcguuagacacauaccuaguaggauuucuaucuacuggaccauugugaauccaggugauauccugcuaaucaacuccacgggcaaucucauugccccgcggggguacuuuaaaauacgcagcggaaagucgucuaucaugcgauccgacgcgcccauuggcaaguguaacucagagugcaucacuccuaaugguaguauaccaaacgacaaacccuuccagaaugucaacagaauuacauauggggcauguccuagguacgugaagcagaauacccugaaacuugccacuggaaugcggaacgugccagaaaagcagaaucguggcaucuuuggcgcuaucgccggguucauugagaacggaugggaagguauggucgauggcugguauggguuucgccaccaaaauagcgagggaaucggccaggcagcugaccugaaauccacacaggccgcgauuaaccaaauaaacgagaaguugaauagacucaucgguaaaaccaacgaaaaguuccaucagauugagaaggaguucucugaaguugaagggaggauccaggaucuggagaaauacguggaggacacgaagaucgauuuauggagcuauaaugccgaacugcucguagcacuugagaaccagcacaccauugaccugacagauucagaaaugaauaaauuguuugagcggacuaagaaacaacuacgagaaaacgcugaggacaugggcaauggaugcuucaagguguaccauaagugugauaacgccugcauaggcaguauccgcaaugggaccuaugaccacaacgucuacagagaugaggcucugaauaacagguuucagauuaaaggaguggaacucaaguccgguuacaaagacuggauccuguggauuagcuucgccaucucuugcuuucuucuguguguugcauugcucggcuucauaaugugggccugccagaaggggaauauccgguguaacauuugcaucuga

SEQ ID NO: 122441 - RNA, 1701 nt, Artificial Sequence; identical to SEQ ID NO: 122298
  derived and/or modified sequence opt3 from Hemagglutinin__InfluenzaA__ABB51964

SEQ ID NO: 122442 - RNA, 1698 nt, Artificial Sequence
  derived and/or modified sequence opt3 from hemagglutinin__InfluenzaA__ABB53603
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuaccggaauuuacuguggcuuaccggaaagaacggcuuguaucccaaucugagcaagucuuacgccaacaauaaaaagaaagaagugcuaauacucuggggcguacaucacccuccaaacaucgggaaccagcgcacgcuguacuauacugagaaugcuuacguuuccguggucucaagccacuauagucgacguuucacccccgaaauuacaaagagaccuaaggugagggaucaggagggacggaucaacuacuauuggacucuucuggaaccaggugacaccauuaucuuugaggcaaauggcaacuugauagccccgugguacgcuuucgcccucucucgcggguuuggauccggcauuaucacaagcaaugcgcccauggaugagugugacgcaaaaugccagaccccucaaggugccauuaacucgucucugccauuccagaaugugcaucccgucacgaucggggaauguccuaaguauguuagauccgcuaaauuaaggauggugacuggacugcggaacaucccaucaauucagagucgcggccucuuuggcgccauagcaggguucaucgagggagguuggacaggcaugguagaugggugguacggauaccaccaucagaaugaacaaggcagcgguuaugcugccgaccagaaguccacccagaacgcgauuaaugggaucacuaacaaaguaaauucugucauagagaagaugaacacacaguuuaccgccgugggcaaagaguucaauaaacuugaacgaagaauggagaaccugaacaagaaaguugaugacggauucuuggauauuuggacguacaaugcagaacuacuggugcuccuggagaacgaaaggacccuugacuuucacgacagcaaugucaagaaccuguaugagaaagugaagucacaauugaaaaauaacgcuaaggaaaucggcaaugggugcuucgaguuuuaccacaaguguaacaaugagugcauggaaagugugaaaaacggaacauaugauuaccccaaguauuccgaggaaagcaaacucaaucgggagaagaucgacgguguuaaacuggauucuaugggcguguaccagauuuuagccaucuacucaacugucgcuaguagccuggugcuacucgucucccugggggccauuucuuucuggaugugcucgaacggaagccuucagugucguauaugcaucuga

SEQ ID NO: 122443 - RNA, 1701 nt, Artificial Sequence; identical to SEQ ID NO: 122271
  derived and/or modified sequence opt3 from hemagglutinin__InfluenzaA__ABB53614

SEQ ID NO: 122444 - RNA, 1701 nt, Artificial Sequence; identical to SEQ ID NO: 122271
  derived and/or modified sequence opt3 from hemagglutinin__InfluenzaA__ABB53625

SEQ ID NO: 122445 - RNA, 1701 nt, Artificial Sequence; identical to SEQ ID NO: 122298
  derived and/or modified sequence opt3 from hemagglutinin__InfluenzaA__ABB53652

SEQ ID NO: 122446 - RNA, 1701 nt, Artificial Sequence
  derived and/or modified sequence opt3 from hemagglutinin__InfluenzaA__ABB53663
augaagaccaucuucgcccugagcuacauucucugccuuguguuugcucagaaacugcccggcaacgacaauuccacagcaacuuuguguuuagggcaccaugccgucccuaacggaacgauaguuaagaccaucacaaaugaucaaauugaggugacuaacgcgaccgaacugguacagucuucaaguacagguggcaucugcgacagcccacaccagauucuagauggggagaauuguacccucaucgacgcucugcuuggagauccgcagugcgacggcuuccaaaacaaaaagugggaucuguuuguggaaagauccaaagcccauucuaauuguuaucccuacgacgucccugauuaugcaucguugaggucacucguggccagcagugguacucuggaguucaacaaugaauccuuuaacuggacagggguuacccagaauggaacgucuagcgcuugcaagcggcgcuccaacaauucauucuuuagucgacugaacuggcucacucacuuaaaguucaaauacccagcacugaaugugaccaugcccaacaacgagaauuuugacaaacuuuauauauggggcguccaucacccuggcacagauaacgaccagaucagcuuguacgcccaggcuucugggcguauuacuguguccaccaagagaucacaacagacaguaaucccaaauauuggaagcaggccccggguucgcgauaucccuaguagaauaucuauuuauuggaccaucgugaagccaggugacauucugcuaaucaacuccacgggcaaucucaucgccccgaggggguacuucaaaauucggagcggaaagucgucuauaaugcgcuccgacgcgcccaucggcaaguguaacucagagugcauuacuccuaaugguaguaucccaaacgauaaacccuuucagaaugucaaccgaauaacauacggggcauguccuagauaugugaagcagaauacccugaaacuugccacuggaaugaggaacgugccagaaaagcaaacacggggcauuuucggcgcuaucgccggguuuaucgagaauggaugggaagguauggucgacggcugguacggguuccgucaccagaacagcgagggaauuggccaggcagcugaucugaaauccacccaagccgcgaucaaucagauuaacgguaaguugaaccgccucauagggaaaacgaaugagaaguuccaucagaucgaaaaggaguuuucugaaguugagggcaggauucaggaccuggaaaaauauguggaggauaccaagaucgacuuauggagcuacaacgccgagcugcucguagcacuugaaaaucaacacacaaucgaucugacugacucagagaugaacaaauuguucgaaagaaccaagaaacagcuacgggagaaugcugaagauaugggaaacggcugcuuuaagauuuaucauaagugugacaaugccugcauagggaguauccgaaacggaacauacgaucacgacguguaucgcgacgaggcucugaauaacagauuccagauuaaaggugucgagcucaaguccggcuacaaagauuggauccuguggauuagcuuugccaucucuugcuuccuucuguguguggcauugcucggguuuauaaugugggccugccagaagggaaauaucagguguaacauuugcaucuga

SEQ ID NO: 122447 - RNA, 1701 nt, Artificial Sequence; identical to SEQ ID NO: 122271
  derived and/or modified sequence opt3 from hemagglutinin__InfluenzaA__ABB53685

SEQ ID NO: 122448 - RNA, 1701 nt, Artificial Sequence
  derived and/or modified sequence opt3 from hemagglutinin__InfluenzaA__ABB53696
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugaaaagaccaaugagaaguuucaucagaucgaaaaagaguucagugaaguagaggguaggauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugcgggagaacgccgaggacauggggaauggcugcuuuaagauuuaucauaaaugugauaacgcuugcaucggaucuauccgaaauggcaccuacgaccacgauguguaccgcgacgaagcccucaacaauagauuccagauuaaggggguugagcugaaaucaggauauaaggacuggauacuuuggaucaguuuugcaauuagcugcuuccuguuguguaucgcccuccuggguuuuauuaugugggcuugccagaaaggcaacaucagguguaaugugugcauauga

SEQ ID NO: 122449 - RNA, 1698 nt, Artificial Sequence; identical to SEQ ID NO: 122312
  derived and/or modified sequence opt3 from hemagglutinin__InfluenzaA__ABB53707

SEQ ID NO: 122450 - RNA, 1701 nt, Artificial Sequence; identical to SEQ ID NO: 122259
  derived and/or modified sequence opt3 from hemagglutinin__InfluenzaA__ABB53718

SEQ ID NO: 122451 - RNA, 1698 nt, Artificial Sequence
  derived and/or modified sequence opt3 from hemagglutinin__InfluenzaA__ABB53740
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaugggggaucagcgcgcccuguaccacacugaaaacgcuuaugucuccguggugucaagccauuacagucgacguuucacccccgagaucgcaaaaagaccuaaggucagggaccaggaaggacggauaaauuauuacuggacacuucuggagccaggugagacuaucauuuuugaagccaacggcaauuugaucgcuccgcgcuaugccuucgcgcucucuagaggguuuggauccggcauuaucaccagcaacgcacccauggaugagugugacgccaagugccagacaccucaaggugcuauaaauucgucucugccauuccagaacguucaccccgugaccauuggggaauguccuaaauacguaagguccacgaaguuacggauggugacuggacugcgcaauaucccaucaauucagagucgaggccucuuuggcgccaucgcaggguucaucgagggagguuggacaggcauggucgaugggugguauggauaccaucaccagaacgaacaaggcagcgguuacgcugccgaccagaaauccacccagaaugcgauuaacgggauaacuaauaaggugaacucuguuaucgagaaaaugaauacacaguuuaccgccgugggcaaggaguucaacaaacuugaaagaaggauggagaaucugaacaagaaggucgaugacggauucuuggauauuuggacguauaacgcagaacuacuggugcuccuggagaaugaacggacccuugacuuucacgacagcaacguuaaaaaucuguacgagaagguaaaaucacaauugaagaacaaugcuaaagagaucggcaacgggugcuucgaauuuuaucauaaguguaaugaugagugcauggaaagugugaagaacggaacauacgacuaucccaaauacuccgaggagagcaagcucaaucgugagaaaauagauggugucaagcuggaaucuaugggcguguaucagauuuuagccaucuacucaacugucgcuaguagccuggugcuacucguuucccugggggccaucucuuucuggaugugcucgaacggaagccuucagugucgcauuugcaucuga

SEQ ID NO: 122452 - RNA, 1701 nt, Artificial Sequence
  derived and/or modified sequence opt3 from hemagglutinin__InfluenzaA__ABB53751
augaagaccaucauugcccugagcuacauauccugccucguguucgcucagaaccuucccggcaaugacaacucuacagcaacucuguguuuggggcaccaugccgucccuaauggaacguuaguuaaaaccaucacaaacgaucaaauugaggugacuaaugcgaccgaacugguacagucaaguagcacagguagaaucugcgacuccccacacaggauucuagauggcaagaacuguacccucaucgacgcucugcuuggggauccgcauugcgacggauuucagaaugagaaaugggaucuguucguggaacggucuaaggccuuuucgaacuguuaucccuacgacgucccugauuaugcaucauugcgcagccucguggccaguuccggcacucuggaguucauaaaugaagguuuuaacuggacagggguuacccagucuggaggcagcuacgcuugcaaacgaggcuccgacaauucauucuuuagucgucugaacuggcucuauaagagcgagucuaaguacccaguguuaaaugucacgaugcccaacaaugggaacuucgauaaacuguauaucuggggagugcaccauccuuccacugacaaggagcaaaccaaccuuuacguaagagcaucagguaggguuacagugagcacuaaacggagucagcagaccauuaucccaaauauuggcucucgccccugggucagaggguuguccagcggaaucucgauauacuggacaauugugaagccuggcgauauccugcuaauuaacucuaaugguaaccucaucgccccaaggggguauuuuaaaauccggaccggaaaguccucaauucugcgcagugacgcuccgauaggcacguguagcuccgaaugcaucacucccaauggcucuauuccuaacgacaagccauuccagaaugugaacaaaaucacauacggggccugucccaaguaugucaaacaaaauacccuuaagcuggcgacuggaaugcgaaacguuccugagaaacagacaagagguauauuuggcgcaauugccggguucaucgaaaauggaugggagggcaugguggaugguugguacggguuuaggcaccagaacagcgagggcaccggacaggcugccgacuugaagucaacgcaagcagcuaucgaucagauuaauggcaaacucaaccggguaaucgaaaagaccaaugagaaguuccaccagauugaaaaagaguucagugaaguggaggggcguauacaagaccuggagaaguaugucgaagauacaaaaaucgacuuaugguccuacaacgccgagcugcucguggcgcuugaaaaccagcauacuauugaucugaccgacagcgagaugaauaaguuguuugagaaaacacgcagacagcuaagggaaaacgccgaggauaugggaaaugguugcuucaagaucuaucacaagugugacaacgcaugcaucggcucuauucggaaugggacuuacgaucaugacguuuaccgagacgaagcucugaacaaucgcuuucagauaaaaggaguggagcucaagucaggcuauaaagauuggauccuguggauuaguuucgccaucagcugcuuucuucugugugucguguugcucgguuucauuaugugggcuugccaaaaggggaacaucagauguaauauaugcaucuga

SEQ ID NO: 122453 - RNA, 1701 nt, Artificial Sequence
  derived and/or modified sequence opt3 from hemagglutinin__InfluenzaA__ABB60007
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagacagaaucugcgauagcccacacaggauucucgacggugagaauuguacccugaucgaugcccuucugggcgacccgcauugcgauggguuucagaacaaagaaugggacuuguucguggagcgguccaaggcuuauucuaauuguuaccccuaugaugucccugacuacgcaucgcuccgcucacugguggccagcaguggaacucuggaauuuaacaaugaguccuucaacuggacaggcguugcucagaaugguaccucuuaugcaugcaaacgacguagcauaaaguccuuuuucucaagacucaacugguuacaccaacugaaguacaaauauccagcccuuaaugugacgaugcccaacaaugauaaguuugacaaauuguacaucuggggaguccaucacccuaguacugauagcgaccagaccucucuguacgcucaggccuccgggagggugacaguaucaacuaagcggagccagcaaaccguuauuccaaacaucggcagucgccccugggugagaggcgucucuuccaggauuagcaucuauuggacaauagugaaaccuggggacauucuacucaucaacucgaccggaaaucugauugcgccacgggguuacuucaagauccgcucuggcaaguccucaaucaugcgaagugaugcaccgauugggaaauguaacagcgagugcauaacgcccaauggauccaucccuaacgacaagccauuucagaaugugaacagaauuacuuauggcgccugucccagguacgucaaacagaauacacuuaagcuggcuaccgguaugcggaacguuccugaaaaacagacucgugggaucuucggagccauagcaggcuuuauugagaauggcugggaagggaugguggauggaugguaugguuuccgccaccaaaacucugagggcacagggcaggcugccgaccuaaagagcacccaggcggccaucaaucaaaucaacggaaaacucaauagacugauugagaagacgaacgaaaaguuucaucagaucgagaaagaguucucagaaguagaaggcaggauucaggauuuagagaaguacguggaggacaccaaaauagaucuguggaguuauaaugcagaacuccuugucgcucuggagaaccagcacacaaucgacuugacugauuccgaaaugaacaagcuauucgagcggacccgaaaacaacugcgcgaaaaugccgaggacauggguaacgggugcuuuaagauuuaccauaagugugauaaugcuugcaucggcagcaucagaaacggaacauacgaccacgacguguauagggaugaggcccucaauaaccgguuccagauuaaaggcguugaacugaagucuggguacaaagacuggauacuuuggaucucauuugcaauuaguugcuuccuguugugugugguccuccugggauuuaucaugugggccugccagaaggguaauauucgcuguaacaucugcauauga

SEQ ID NO: 122454 - RNA, 1701 nt, Artificial Sequence
  derived and/or modified sequence opt3 from hemagglutinin__InfluenzaA__ABB77853
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcgagaauuguacccucaucgacgcucugcuuggggauccgcauugcgacggauuucagaacaaagaaugggaucuguucguggagcggucuaaggccuauucgaauuguuaccccuaugacgucccugauuacgcaucauugcgcagccucguggccaguuccggcacucuggaauuuaacaaugagucuuucaacuggacagguguugcucagaaugggaccagcuaugcaugcaaacgacguuccauaaagucauuuuucaguagacugaacuggcuccaccaauuaaaguacaaauauccagcccugaaugugacgaugcccaacaaugacaaguuugauaaacuuuacaucuggggaguccaucacccuagcacugacucugaucagaccuccuuguacgcucaggccucaggcagggugacaguaagcacuaagcggagucagcaaaccguuauuccaaacaucggcucucgccccugggugagaggggucuccagcaggauuucgaucuauuggacaauagugaaaccuggagacauucugcuaaucaacucuaccgguaaucucauugcgccacggggcuacuucaagauccgcuccgggaagucaaguaucaugcgaagcgacgcaccgauuggaaaauguaacuccgagugcauaacgcccgauggcucuaucccuaaugacaagccauuucagaacgugaauagaauuacuuauggugccugucccagguacgucaaacagaacacacugaaacuugcuaccgggaugcggaauguuccugaaaagcagacucguggaaucuucggcgccauagcaggcuuuauugagaacgggugggaaggaaugguggaugguugguauggcuuccgccaccaaaauagcgaggggacaggacaggcugccgaccugaagucaacccaggcggccaucaaccaaaucaauggcaaauugaacagacucauugagaagacgaaugaaaaguuucaucagaucgagaaagaguucagugaaguagaagguaggauucaggaucuggagaaguacguggaggacaccaaaauagauuuaugguccuauaacgcagaacugcucgucgcucuugagaaucagcacacaaucgaccugacugauagcgaaaugaacaaguuguucgagcggacccgaaaacaacuacgcgaaaacgccgaggacauggggaauggcugcuuuaagauuuaccauaagugugauaacgcuugcaucggaucuaucagaaauggcacauacgaccacgacguguauagggaugaggcccugaacaaucgguuccagauuaaagggguugaacucaagucaggauacaaagacuggauacuguggaucaguuuugcaauuagcugcuuccuucuguguguggucuugcucgguuuuaucaugugggccugccagaagggcaacauucgcuguaauaucugcauauga

SEQ ID NO: 122455 - RNA, 1701 nt, Artificial Sequence
  derived and/or modified sequence opt3 from hemagglutinin__InfluenzaA__ABB79731
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagaauaguucaacagguggcauuugcgacaguccacaccagauccuagauggggaaaacuguacccucauagacgcucugcuuggagauccgcagugcgacggcuuucaaaauaagaaaugggaucuguucguggagagaagcaaggccuauuccaacuguuaccccuaugacgucccugauuacgcaucuuugaggucgcucguggccucaagcgguacucuggaauuuaauaacgagaguuucaauuggacagggguuacccagaacggaacguccucugcuugcaaacggcgcagcaauaacuccuuuuucucacgacugaauuggcucacucauuuaaaguuuaaguauccagcacugaacgugaccaugcccaacaaugagaaauucgacaaacuuuacaucuggggcguccaccauccuggcacagauaacgaccagacuucuuuguaugcccaggcuagcgggcguauuaccgugucuacaaagagaucccaacagaccguaaucccaaauauuggaucaaggccccggguucgcgauaucccuagcagaauaaguauuuacuggacgaucgugaagccaggugacauucugcuaaucaacucuacuggcaaucucaucgccccgaggggguacuuuaaaauucgguccggaaagagcucgauaaugcgcucugacgcgcccaucggcaaguguaacuccgaaugcauuacaccuaaugguucaaucccaaacgauaaacccuuccagaaugucaaccgaauaaccuauggggcauguccuagauacgugaagcagaauacucugaaacuugccacaggaaugaggaacgugccagagaagcaaacccggggcauuuuuggcgcuaucgccggguucaucgaaaauggaugggaggguauggucgacggcugguauggguuucgucaccagaacagugagggaauuggccaggcagcugaucugaaaagcacgcaagccgcgaucaaucagauuaacgguaaguugaaccgccucauagggaaaaccaaugaaaaguuccaccagaucgagaaggaguucuccgaaguugaaggcaggauucaggaccuggagaaauacguggaggauacaaagaucgacuuauggucuuauaacgccgaacugcucguagcacuugagaaucaacauacuaucgaucugaccgacagcgaaaugaacaaauuguuugagagaacaaagaaacagcuacgggaaaaugcugaggauaugggaaacggcugcuucaagauuuaccacaagugugacaaugccugcauagggucaauccgaaacggaacuuaugaucaugacguguaccgcgacgaggcucugaauaacagauuucagauuaaaggugucgaacucaagaguggcuacaaagauuggauccuguggauuuccuucgccaucagcugcuuucuucuguguguggcauugcucggguucauaaugugggccugccagaagggaaauaucagguguaacauuugcaucuga

SEQ ID NO: 122456 - RNA, 1701 nt, Artificial Sequence
  derived and/or modified sequence opt3 from hemagglutinin__InfluenzaA__ABB79788
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacgcuugcaagcgaggcagcgugaacuccuuuuucucacgucugaauuggcucuaugagagugagagcaaguacccagucuuaaacgugacgaugcccaauaacgggaaauuugacaagcuguauaucuggggaguacaccauccuauuacugauaaagaacaaaccaaucuuuacguuagagcaucugguagggugacagucuccacuaagcggucacagcagaccgugaucccaaacauuggcagccgccccugggugagaggguugaguucuaggaucuccauauacuggacaauugucaaaccuggagacauccugcuaauuaacagcaccggcaaucucaucgccccacgggguuauuucaagauccgcacggggaagucgucuauuaugcgauccgaugcuccgauaggaacuuguucaagugagugcaucacacccaacggcagcauuccuaaugacaaaccauuucagaacguuaauaagaucaccuacggcgccugucccagauaugugaaacaaaacacucugaaacuugcgacagggaugaggaauguaccugaaaagcagacccggggaauauucggugcaauugccggcuuuaucgagaacgggugggagggaaugguggacggcugguacgguuuccgucaccaaaauuccgaagggacgggccaggcugccgaucugaagucuacccaggcagcuaucgaccagauuaacggaaaauugaaucgccucaucgagaagacaaacgaaaaguuccaccagauugagaaagaauuuagcgaggucgagggcagaauacaagaucuggaaaaguauguggaggacacuaaaaucgauuuauggucauacaaugccgaacugcucguugcgcuugagaaccagcauaccauugaccugacagauagugaaaugaauaaguuguucgagaaaacuaggaagcagcuacgggagaacgccgaagacauggggaacggaugcuuuaagaucuaucacaaaugugauaaugcaugcaucgguuccauucgaaacggcaccuacgaccaugauguguaccgcgacgaggcucugaauaacagauuccagauaaagggggucgaacucaaaagcggauauaaggacuggauccuguggauuucuuuugccaucucaugcuuccuucugugugugguauugcucggcuuuauuaugugggcuugccaaaaagguaauaucagguguaacauaugcaucuga

SEQ ID NO: 122457 - RNA, 1701 nt, Artificial Sequence
  derived and/or modified sequence opt3 from hemagglutinin__InfluenzaA__ABB79799
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacgcuugcaagcgaggcagcgugaacuccuuuuucucacgucugaauuggcucuaugagagugagagcaaguacccagucuuaaacgugacgaugcccaauaacgggaaauuugacaagcuguauaucuggggaguacaccauccuucuacugauaaagaacaaaccaaucuuuacguuagagcauccgguaaggugacagucucaacuaaaaggagccagcagaccgugauuccaaacaucggcagucggcccugggugcgcggguugucuuccagaauuagcaucuacuggacaauagucaagccuggagacauucugcuaaucaacucgaccggcaaucucauugccccaagggguuauuucaagauccggacggggaaaucuuccaucaugcgcucagaugcuccgauuggaacuuguaguagcgagugcauaacacccaacggcuccaucccuaaugacaagccauuucagaacguuaauaaaauuaccuacggcgccuguccccgauaugugaagcaaaacacucugaaacuugcgacagggaugagaaauguaccugaaaagcagaccaggggaaucuucggugcaauagccggcuuuauugagaacgggugggagggaaugguggacggcugguacgguuuccggcaccaaaauucugaagggacgggccaggcugccgaucugaaaagcacccaggcagcuaucgaccagaucaacggaaaguugaaucgucucauugagaagacaaacgaaaaauuccaccagaucgagaaggaauuuucagaggucgagggccgcauucaagaucuggaaaaauauguggaggacacuaagauagauuuauggaguuacaaugccgaacugcucguugcgcuugagaaccagcauaccaucgaccugacagauuccgaaaugaauaaauuguucgagaagacuagaaagcagcuaagggagaacgccgaagacauggggaacggaugcuuuaaaauuuaucacaagugugauaaugcaugcaucgguagcauccggaacggcaccuacgaccaugauguguaccgagacgaggcucugaauaaccgcuuccagauuaaaggggucgaacucaagucuggauauaaagacuggauacuguggaucucauuugccauuaguugcuuccuucugugugugguauugcucggcuuuaucaugugggcuugccaaaaggguaauauuagauguaacaucugcauauga

SEQ ID NO: 122458 - RNA, 1701 nt, Artificial Sequence
  derived and/or modified sequence opt3 from hemagglutinin__InfluenzaA__ABB79810
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagacucugcgacagcccacacaggauccuggauggcaaaaauuguacccuuauugacgcucuguugggggauccgcauugcgacggauuucagaacaaggagugggaucucuucguggaacgguccaaagccuauucuaauuguuaccccuaugacgucccugauuacgcaucgcugcgcucacugguggccagcaguggcacucucgaguuuaucaacgaagacuucaauuggacagguguugcucaggaugggggauccuaugcaugccgacguggcucugugaacagcuuuuucuccagauuaaauuggcugcacaagcuagaguacaaguauccagccuugaacgucaccaugcccaauaacggcaaauuugacaagcuguacauauggggagugcaucacccuucaacggauagugaccaaacuagccuauacguaagggcuucugggcggguuaccguguccacaaaacgcucacagcagacugucaucccaaauauugguagcagacccugggugaggggccagaguucucggaucuccauuuauuggaccaucgugaagccuggggacauacuccugauugauagcacaggaaaccuuaucgccccacgcggcuacuucaaaauucgaaacgguaagucgucuaucaugagauccgacgcgccgaucgggaauuguucaagugagugcauuacccccaacggaagcauaccuaaugauaagccauuucaaaacgucaauaggaucacguauggcgcauguccccgguacguuaaacagcacacucugaaguuggccacaggcaugcguaacgugccugaaaaacagacccgcgggauuuucggagcuaucgccgguuuuauagagaauggcugggaagggaugguagacggaugguauggcuucagacaucagaacuccgaggguacugggcaagcagcugaucucaagucuacacaggccgcgauugaccagaucaauggcaaacugaacagguuaaucgagaagaccaaugaaaaauuucaccaaauugagaaggaguucagcgaaguggaaggacggauccaggaucuggagaaguacgucgaggacacgaaaauugaucucuggucauauaacgccgaacuucugguggcauuggagaaucagcauaccauagaccuaacagauagugaaaugaacaagcuguucgagcgaacucgcaaacagcucagagaaaaugcugaggacaugggcaacgggugcuuuaagaucuaccacaaaugugacaacgccugcauuggauccaucaggaaugguaccuacgaucacgacguuuaucgggaugaggcucugaacaaucgcuuccaaaucaagggcguggaacuuaagagcggguacaaagacuggauucuguggauaucuuuugccaucucaugcuucuugcucugugucgugcuguuaggauuuauuaugugggcaugccagaagggcaacaucagauguaauauuugcaucuga

SEQ ID NO: 122459 - RNA, 1701 nt, Artificial Sequence
  derived and/or modified sequence opt3 from hemagglutinin__InfluenzaA__ABB79957
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagacucugcgacagcccacacaggauccuggauggcaaaaauuguacccuuauugacgcucuguugggggauccgcauugcgacggauuucagaacaaggagugggaucucuucguggaacgguccaaagccuauucuaauuguuaccccuaugacgucccugauuacgcaucgcugcgcucacugguggccagcaguggcacucucgaguuuaucaacgaagacuucaauuggacagguguugcucaggaugggggauccuaugcaugccgacguggcucugugaacagcuuuuucuccagauuaaauuggcugcacaagcuagaguacaaguauccagccuugaacgucaccaugcccaauaacggcaaauuugacaagcuguacauauggggagugcaucacccuucaacggauagugaccaaacuagccuauacguaagggcuucugggcggguuaccguguccacaaaacgcucacagcagacugucaucccaaauauugguagcagacccugggugaggggccagaguucucggaucgggauuuauuggaccaucgugaagccuggagacauacuccugauuaacuccacaggcaaccuuaucgccccacgcgguuacuucaaaauucgaaauggaaagagcucgaucaugagaucugaugcgccgaucgggaacuguuccucagagugcauuacccccaauggcaguauaccuaacgacaagccauuucaaaaugucaacaggaucacguauggcgcauguccccgguacguuaaacagcacacucugaaguuggccacagggaugcguaaugugccugaaaaacagacccgcggaauuuucggugcuaucgccggcuuuauagagaacgggugggaaggaaugguagauggcugguaugguuucagacaucagaauagcgaggggacuggccaagcagcugaccucaaguccacacaggccgcgauugaucagaucaacggaaaacugaauagguuaaucgagaagaccaacgaaaaauuucaccaaauugagaaggaguucucugaaguggaaggccggauccaggaccuggagaaguacgucgaggauacgaaaauugaccucuggagcuauaaugccgaacuucugguggcauuggagaaccagcauaccauagaucuaacagacucagaaaugaauaagcuguucgagcgaacucgcaaacagcucagagaaaacgcugaggauauggggaacggaugcuuuaagaucuaccacaaaugugacaaugccugcauugguaguaucaggaacggcaccuacgaccacgauguuuaucgggacgaggcucugaauaaccgcuuccaaaucaaggggguggaacuuaaguccggauacaaagauuggauucuguggaucagcuuugccauaucuugcuucuugcucugugucgugcuguuaggcuuuauuaugugggcaugccagaaggguaauaucagauguaacauuugcaucuga

SEQ ID NO: 122460 - RNA, 1701 nt, Artificial Sequence
  derived and/or modified sequence opt3 from hemagglutinin__InfluenzaA__ABB79968
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagacucugcgacagcccacacaggauccuggauggcaaaaauuguacccuuauugacgcucuguugggggauccgcauugcgacggauuucagaacaaggagugggaucucuucguggaacgguccaaagccuauucuaauuguuaccccuaugacgucccugauuacgcaucgcugcgcucacugguggccagcaguggcacucucgaguuuaucaacgaagacuucaauuggacagguguugcucaggaugggggauccuaugcaugccgacguggcucugugaacagcuuuuucuccagauuaaauuggcugcacaagcuagaguacaaguauccagccuugaacgucaccaugcccaauaacggcaaauuugacaagcuguacauauggggagugcaucacccuucaacggauagugaccaaacuagccuauacguaagggcuucugggcggguuaccguguccacaaaacgcucacagcagacugucaucccaaauauugguagcagacccugggugaggggccagaguucucggaucuccauuuauuggaccaucgugaagccuggggacauacuccugauuaacagcacaggaaaccuuaucgccccacgcggcuacuucaaaauucgaaaugguaagucgucuaucaugagauccgaugcgccgaucgggaacuguucaagugagugcauuacccccaauggaagcauaccuaacgacaagccauuucaaaaugucaacaggaucacguauggcgcauguccccgguacguuaaacagcacacucugaaguuggccacaggcaugcguaaugugccugaaaaacagacccgcgggauuuucggagcuaucgccgguuuuauagagaacggcugggaagggaugguagauggaugguauggcuucagacaucaaaauuccgaggguacugggcaggcagcugaccucaagucuacacaggccgcgauugaucagaucaacggcaaacugaauagguuaaucgagaagaccaacgaaaaauuucaccaaauugagaaggaguucagcgaaguggaaggacggauccaggaccuggagaaguacgucgaggauacgaaaauugaccucuggucauauaaugccgaacuucugguggcauuggagaaccagcauaccauagaucuaacagacagugaaaugaauaagcuguucgagcgaacucgcaaacagcucagagaaaacgcugaggauaugggcaacgggugcuuuaagaucuaccacaaaugugacaaugccugcauuggauccaucaggaacgguaccuacgaccacgauguuuaucgggacgaggcucugaauaaccgcuuccaaaucaagggcguggaacuuaagagcggguacaaagauuggauucuguggauaucuuuugccaucucaugcuucuugcucugugucgugcuguuaggauuuauuaugugggcaugccagaagggcaauaucagauguaacauuugcaucuga

SEQ ID NO: 122461 - RNA, 1698 nt, Artificial Sequence
  derived and/or modified sequence opt3 from hemagglutinin__InfluenzaA__ABB79979
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuaucacuggacacuucuggaaccaggcgauacuauuaucuuugaggccaacgggaauuugauugcuccgugguacgccuucgcgcucucucgcggauuuggcuccgguaucauaaccagcaacgcacccauggacgagugugaugccaagugccagacaccucaaggggcuauuaauucgucucugccauuccagaacguucaucccgugaccaucggagaauguccuaaguauguaagauccgccaaauuaaggauggugacgggccugcggaauauuccaucaauccagagucgcggccucuuuggggcaaucgcuggauucauugaggguggcuggacugggauggucgacggaugguacggcuaucaccaccagaacgaacaagguagcggguacgccgcggaucagaaguccacacagaaugccauaaacggcaucaccaauaaagugaacucuguuauugagaagaugaauacucaguuuacagcagugggaaaagaguucaacaagcuagaacgaagaauggagaaucugaacaaaaaggucgacgauggcuucuuggacaucuggaccuacaacgcugaacuacuggugcuccuggagaaugaaaggacgcuugacuuucaugauagcaacguaaagaaucuguaugagaaaguuaagucacaauugaaaaacaaugccaaggaaauagggaacggaugcuucgaguuuuaccacaaauguaauaacgagugcauggaaagugugaagaaugguaccuaugacuaccccaaguauuccgaggaaagcaaacucaaccgggagaagauugauggcgucaaacuggagucuauggggguguaccagaucuuagcuaucuauucaacagucgccaguagccuggugcuacucguuucccugggagcaauuucuuucuggaugugcucgaauggcagccuucagugucguaucugcauuuga

SEQ ID NO: 122462 - RNA, 1698 nt, Artificial Sequence
  derived and/or modified sequence opt3 from hemagglutinin__InfluenzaA__ABB79990
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguucuaguacucuggggagugcaucacccuccaaacaucggggaucagaaggcccuguaccacacugagaacgcuuaugucuccguggugucaagccauuacagucgccgauucacccccgaaauagcaaaacguccuaaggucagagaccaggaggguaggaucaauuauuacuggacacuucuggaaccaggcgauacuauuaucuuugaggccaacgggaauuugauugcuccgugguaugccuucgcgcucucucggggauuuggcuccgguaucauaaccagcaacgcacccauggacgagugugaugccaagugccagacaccucaaggggcuauuaauucgucucugccauuccagaacguucaccccgugaccaucggagaauguccuaaauacguacgcuccgccaaguuaagaauggugacgggccugaggaauauuccaucaauccagagucggggccucuuuggggcaaucgcuggauucauugaggguggcuggacugggauggucgacggaugguauggcuaccaucaccagaacgaacaagguagcggguacgccgcggaucagaaauccacacagaaugccauaaacggcaucaccaauaaggugaacucuguuauugagaaaaugaauacucaguuuacagcagugggaaaggaguucaacaaacuugaacgccgaauggagaaucugaacaagaaggucgacgauggcuucuuggacaucuggaccuauaacgcugaacuacuggugcuccuggagaaugaaagaacgcuugacuuucacgauagcaacguuaaaaaucuguacgagaagguaaaaucacaauugaagaacaaugccaaagaaauagggaacggaugcuucgaguuuuaucauaaguguaauaacgagugcauggaaagugugaagaaugguaccuacgacuaucccaaauacuccgaggaaagcaagcucaacagggagaaaauugauggcgucaagcuggagucuauggggguguaucagaucuuagcuaucuacucaacagucgccaguagccuggugcuacucguuucccugggagcaauuucuuucuggaugugcucgaauggcagccuucagugucggaucugcauuuga

SEQ ID NO: 122463 - RNA, 1701 nt, Artificial Sequence
  derived and/or modified sequence opt3 from hemagglutinin__InfluenzaA__ABB80001
augaagaccaucauugcccugagcuacacacucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacagucuucaaguaccgguggcaucugcgacagcccacaccagauucuagauggggagaauuguacucucaucgacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacacuggaguuuaacaaugaauccuucaacuggaccgggguuacgcagaauggaacuucuagcgcuugcaagcggcgcuccaacaauucauuuuucagucgacugaacuggcucacccauuuaaaguuuaaauauccagcacugaaugugacaaugcccaacaacgagaaguucgacaaacuuuacauauggggcguccaccauccuggcacugauaaugaccagaucagcuuguaugcccaggcuucugggcguauuaccguguccacaaagagaucacaacagaccguaaucccaaacauuggaagcaggccccggguucgcgauaucccuaguagaauaucuauuuacuggacgaucgugaaaccaggugacauucugcuaaucaauuccacuggcaaccucaucgccccgaggggguacuuuaagauucggagcggaaagucgucuauaaugcgcuccgacgcgcccaucggcaaauguaauucagagugcauuacaccuaacgguaguaucccaaaugauaagcccuuccagaacgucaaucgaauaaccuauggggcauguccuagauacgugaaacagagcacucugaaacuugccacaggaaugaggaacgugccagaaaaacaaacccggggcauuuuuggcgcuaucgccggguucaucgagaauggaugggaagguauggucgacggcugguauggguuucgucaccagaacuccgagggaauuggccaggcagcugaucugaagucuacgcaagccgcgaucaaucagauuaacgguaaauugaaucgccucauagggaagaccaacgagaaguuccaccagaucgaaaaagaguucagcgaaguugagggcaggauucaggaccuggaaaaguacguggaggauacaaaaaucgacuuauggucauauaacgccgagcugcucguagcacuugaaaaucaacauacuaucgaucugaccgacagugagaugaacaaguuguuugaaagaacaaagaagcagcuacgggagaaugcugaagauaugggaaacggcugcuucaagauuuaccacaaaugugacaaugccugcauaggguccauccgaaacggaacuuaugaucaugacguguaccgcgacgaggcucugaauaacagauuucagauuaagggugucgagcucaaaagcggcuacaaggauuggauccuguggauuucuuucgccaucucaugcuuucuucuguguguggcauugcucggguucauaaugugggccugccagaaaggaaauaucagguguaacauuugcaucuga

SEQ ID NO: 122464 - RNA, 1701 nt, Artificial Sequence; identical to SEQ ID NO: 122259
  derived and/or modified sequence opt3 from hemagglutinin__InfluenzaA__ABB80012

SEQ ID NO: 122465 - RNA, 1701 nt, Artificial Sequence
  derived and/or modified sequence opt3 from hemagglutinin__InfluenzaA__ABB80023
augaagaccaucauugcccugagcuacauauucuaucucgcucuuggccaggaccugcccgggaacgauaauuccaaagcaacauugugcuuaggacaccaugccgugccuaacgguacucuggucaagacgaucaccaaugaccaaacagagguuacuaacgcgaccgaacuugugcagucuucaaguacaggcaaaauuuguaauaacccacacagaauccucgaugggauggacugcacccugauugaugcucuacugggagacccgcauugugauguauuucagaaugagacuugggacuuguucguggaaaggagcaaggccuuuuccaacugcuaccccuaugaugucccugacuacgcaucucuccggucgcugguggccucaagcggcacacuggaguucaucaccgaagguuuuacguggacugagguuacccagaaugggggaaguaacgcuuguaaacgcggcccagauuccggcuucuuuucucgacucaauugguuaacaaagagcgggcguacuuaucccgugcugaacgucaccaugccuaauaacgacaauuucgauaaacuuuacauauggggagugcaccauccauccacagaccaagagcagaccaacuuguauguacagacgucagguagaguuacugugaguacaaggcggagccagcaaaccaucauucccaacaucggcucucgcccuugggucagagggcuguccucaaggauuagcaucuacuggacuauagugaaaccaggagacgugcuagucauuaauaguaacggcaaucucaucgcaccgcgggguuacuuuaagaugcgcacagggaaaucuuccauuaugcgaagcgaugcccccaucgauaccugcaucucggaauguauuacgccuaacggaucuauaccaaaugacaagcccuuccagaacguuaauaaaaucaccuauggcgcuugcccuaaguacgugaagcaggacacacugaaacuugccacuggcaugagaaacguaccagagaagcagaccagggggcuguuuggagcgauugcagguuucaucgaaaauggcugggaggggaugauagauggaugguauggcuuucggcaccaaaacuccgaggguacagggcaggccgcugacuugaaaucaacucaggccgcaauugaucaaaucaauggcaagcucaaccguaucauugaaaagaccaaugagaaguuccaccagaucgaaaaagaguucagugaaguggagggacgcauucaggaccuggagaaguacgucgaagauacaaagauagacuuauggagcuauaacgcugagcugcucguggcccuugaaaaucagcauaccaucgaucugacugacuccgagaugaacaaauuguuugaaaagacgagaaggcaacuacgggagaacgcggaggacaugggcaauggguguuucaaaauuuaccacaagugcgauaacgccuguaucgaaucuauccgaaauggaacauaugaccaugauguuuaccgcgacgaggcacugaacaauagauuucagauuaaagguguggaacucaagagcggcuacaaggauuggauacuguggaucucauucgcuauuaguugcuuucuucugugcgucguguugcucggguucaucaugugggccugucagaggggaaacauucggugcaauaucuguauauga

SEQ ID NO: 122466 - RNA, 1701 nt, Artificial Sequence
  derived and/or modified sequence opt3 from hemagglutinin__InfluenzaA__ABB80034
augaagaccaucauugcccugagcuacauauucugccucgugcuuggccaggaccugcccgggaacgauaauuccacagcuacuuuguguuuaggacaccaugcagucccuaacgguacgcugguuaaaaccaucacagacgaucaaauugaggugacuaaugccaccgagcuaguacagucuucaaguacaggcaagaucugcaacaauccacacaggauucucgacgggcuggauuguacccuuaucgacgcgcuguugggagauccgcauugcgacguguuucagaacgaaacuugggaucucuucgucgaaagaagcaaggcuuuuuccaauuguuaucccuacgacgugccugauuaugccucucugcggucgcugguugcaucaagcggcacacucgaguucauaaccgaagguuuuacguggacuggggugacccagaacggaggcaguaaugccugcaaacgcggcccaggguccggauucuuuucucgauuaaacuggcugacaaaaagcgguuccacuuaccccguccuuaaugugaccaugccuaacaaugacaacuucgauaaguuguauaucuggggcguacaccauccaucaacaaaucaagagcagaccagucuguacguucaggcuagcgggcgugugacggucucuacuagaaggucccagcaaacaauuauccccaacauuggaucacggccuugggugcgcggccuaagcaguagaaucucuauauauuggaccauugugaagccaggugacguccucguuaucaacuccaaugggaaccugauugcaccgaggggauacuuuaaaaugcggacuggcaagagcucgaucaugcgcucugacgccacaaucgauaccuguauuuccgagugcauaacgcccaauggcucaaucccuaacgacaaaccauuccagaaugugaacaagauuaccuacggggcuugucccaaauauguaaagcagaauacacuuaagcuggccacuggaaugcgaaacgugccugaaaaacagaccagagguuuguuuggcgcgaucgcaggguucauagagaauggaugggaaggcaugauugaugguugguacggguuuaggcaccaaaacagugagggcacaggacaggccgcugaccucaagagcacucaggccgcaaucgaucaaaucaauggcaaacugaaccgggucauugagaagaccaaugaaaaauuccaccagaucgagaaggaguucuccgaaguggaagggcguauucaggacuuagagaaauauguugaggauacaaagauagaccuguggucuuacaacgcugaacuccuuguggcccuggagaaucagcauaccaucgauuugacugacagcgaaaugaacaagcuauuugagaaaacgcgcagacaacugagggaaaacgcggaggauaugggaaaugguugcuucaagauuuaucacaaaugugacaacgccugcaucgagucaauccggaauggcacauacgaccaugaugucuaucgagacgaagcacucaacaaucgcuuucagauuaaggggguggagcugaaaaguggauacaaggauuggauacuuuggaucuccuucgcuauuagcugcuuucuguuguguguaguucuccugggcuucaucaugugggccugccagagagguaacauuagguguaauaucugcauauga

SEQ ID NO: 122467 - RNA, 1698 nt, Artificial Sequence; identical to SEQ ID NO: 122380
  derived and/or modified sequence opt3 from hemagglutinin__InfluenzaA__ABB80045

SEQ ID NO: 122468 - RNA, 1701 nt, Artificial Sequence
  derived and/or modified sequence opt3 from hemagglutinin__InfluenzaA__ABB80081
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcgagaauuguacccucaucgacgcucugcuuggggauccgcauugcgacggauuucagaacaaagaaugggaucuguucguggagcggucuaaggccuauucgaauuguuaccccuaugacgucccugauuacgcaucauugcgcagccucguggccaguuccggcacucuggaauuuaacaaugagucuuucaacuggacagguguugcucagaaugggaccagcuaugcaugcaaacgacguuccauaaagucauuuuucaguagacugaacuggcuccaccaauuaaaguacaaauauccagcccugaaugugacgaugcccaacaaugacaaguuugauaaacuuuacaucuggggaguccaucacccuagcacugacucugaucagaccuccuuguacgcucaggccucaggcagggugacaguaagcacuaagcggagucagcaaaccguuauuccaaacaucggcucucgccccugggugagaggggucuccagcaggauuucgaucuauuggacaauagugaaaccuggagacauucugcuaaucaacucuaccgguaaucucauugcgccacggggcuacuucaagauccgcuccgggaagucaaguaucaugcgaagcgacgcaccgauuggaaaauguaacuccgagugcauaacgcccaauggcucuaucccuaacgauaagccauuucagaaugugaacagaauuacuuauggugccugucccagguacgucaaacagaauacacugaaacuugcuaccgggaugcggaacguuccugaaaagcagacucguggaaucuucggcgccauagcaggcuuuauugagaaugggugggaaggaaugguggacgguugguauggcuuccgccaccaaaacagcgaggggacaggacaggcugccgaucugaagucaacccaggcggccaucaaucaaaucaacggcaaauugaauagacucauugagaagacgaacgaaaaguuucaucagaucgagaaagaguucagugaaguagaagguaggauucaggaccuggagaaguacguggaggauaccaaaauagacuuaugguccuauaaugcagaacugcucgucgcucuugagaaccagcacacaaucgaucugacugacagcgaaaugaacaaguuguucgagcggacccgaaaacaacuacgcgaaaaugccgaggauauggggaacggcugcuuuaagauuuaccauaagugugacaaugcuugcaucggaucuaucagaaacggcacauacgaucacgacguguauagggacgaggcccugaauaaccgguuccagauuaaagggguugaacucaagucaggauacaaagauuggauacuguggaucaguuuugcaauuagcugcuuccuucuguguguggucuugcucgguuuuaucaugugggccugccagaagggcaauauucgcuguaacaucugcauauga

SEQ ID NO: 122469 - RNA, 1701 nt, Artificial Sequence
  derived and/or modified sequence opt3 from hemagglutinin__InfluenzaA__ABB80092
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcgagaauuguacccucaucgacgcucugcuuggggauccgcauugcgacggauuucagaacaaagaaugggaucuguucguggagcggucuaaggccuauucgaauuguuaccccuaugacgucccugauuacgcaucauugcgcagccucguggccaguuccggcacucuggaauuuaacaaugagucuuucaacuggacagguguugcucagaaugggaccagcuaugcaugcaaacgacguuccauaaagucauuuuucaguagacugaacuggcuccaccaauuaaaguacaaauauccagcccugaaugugacgaugcccaacaaugacaaguuugauaaacuuuacaucuggggaguccaucacccuagcacugacucugaucagaccuccuuguacgcucaggccucaggcagggugacaguaagcacuaagcggagucagcaaaccguuauuccaaacaucggcucucgccccugggugagaggggucuccagcaggauuucgaucuauuggacacuggugaaaccuggagacauacuacucauuaacucuaccgguaaucugaucgcgccacggggcuacuucaagauucgcuccgggaagucaaguaucaugcgaagcgacgcaccgaucggaaaauguaacuccgagugcauuacgcccaauggcucuauaccuaacgauaagccauuucagaaugugaacagaaucacuuauggugccugucccagguacgucaaacagaauacacuuaagcuggcuaccgggaugcggaacguuccugaaaaacagacucguggaauuuucggcgccaucgcaggcuuuauagagaaugggugggaaggaaugguggacgguugguauggcuuccgccaccaaaacagcgaggggacaggacaggcugccgauuugaagucaacccaggcggccauuaaucaaaucaacggcaaacucaauagacugaucgagaagacgaacgaaaaguuucaucagauugagaaagaguucagugaaguagaagguaggauccaggacuuagagaaguacguggaggauaccaaaauugaccugugguccuauaaugcagaacuccuugucgcucuggagaaccagcacacaauagauuugacugacagcgaaaugaacaagcuauucgagcggacccgaaaacaacugcgcgaaaaugccgaggauauggggaacggcugcuuuaagaucuaccauaagugugacaaugcuugcauuggaucuaucagaaacggcacauacgaucacgacguguauagggacgaggcccucaauaaccgguuccagaucaaagggguugaacugaagucaggauacaaagauuggauucuuuggauaaguuuugcaaucagcugcuuccuguugugugugguccuccuggguuuuauuaugugggccugccagaagggcaauauccgcuguaacauuugcaucuga

SEQ ID NO: 122470 - RNA, 1701 nt, Artificial Sequence; identical to SEQ ID NO: 122271
  derived and/or modified sequence opt3 from hemagglutinin__InfluenzaA__ABB80137

SEQ ID NO: 122471 - RNA, 1701 nt, Artificial Sequence; identical to SEQ ID NO: 122468
  derived and/or modified sequence opt3 from hemagglutinin__InfluenzaA__ABB80159

SEQ ID NO: 122472 - RNA, 1701 nt, Artificial Sequence; identical to SEQ ID NO: 122039
  derived and/or modified sequence opt3 from hemagglutinin__InfluenzaA__ABB80185

SEQ ID NO: 122473 - RNA, 1701 nt, Artificial Sequence
  derived and/or modified sequence opt3 from hemagglutinin__InfluenzaA__ABB80207
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacacaggauucucgauggcgagaauuguacccugaucgacgcccuucugggggauccgcauugcgacgauuuucagaacaaagaaugggacuuguucguggagcgguccaaggcuuauucuaauuguuaccccuaugaugucccugacuacgcaucgcuccgcucacugguggccagcaguggaacucuggaauuuaacaaugaguccuucaacuggacaggcguugcucagaaugguaccucuuaugcaugcaaacgacguagcauaaaguccuuuuucucaagacucaacugguuacaccaacugaaguacaaauauccagcccuuaaugugacgaugcccaacaaugauaaguuugacaaauuguacaucuggggaguccaucacccuaguacugauagcgaccagaccucucuguacgcucaggccuccgggagggugacaguaucaacuaagcggagccagcaaaccguuauuccaaacaucggcagucgccccugggugagaggcgucucuuccaggauuagcaucuauuggacaauagugaaaccuggggacauucuacucaucaacucgaccggaaaucugauugcgccacgggguuacuucaagauccgcucuggcaaguccucaaucaugcgaagugaugcaccgauugggaaauguaacagcgagugcauaacgcccaauggauccaucccuaacgacaagccauuucagaaugugaacagaauuacuuauggcgccugucccagguacgucaaacagaauacacuuaagcuggcuaccgguaugcggaacguuccugaaaaacagacucgugggaucuucggagccauagcaggcuuuauugagaauggcugggaagggaugguggauggaugguaugguuuccgccaccaaaacucugagggcacagggcaggcugccgaccuaaagagcacccaggcggccaucaaucaaaucaacggaaaacucaauagacugauugagaagacgaacgaaaaguuucaucagaucgagaaagaguucucagaaguagaaggcaggauucaggauuuagagaaguacguggaggacaccaaaauagaucuguggaguuauaaugcagaacuccuugucgcucuggagaaccagcacacaaucgacuugacugauuccgaaaugaacaagcuauucgagcggacccgaaaacaacugcgcgaaaaugccgaggacauggguaacgggugcuuuaagauuuaccauaagugugauaaugcuugcaucggcagcaucagaaacggaacauacgaccacgacguguauagggaugaggcccucaauaaccgguuccagauuaaaggcguugaacugaagucuggguacaaagacuggauacuuuggaucucauuugcaaugaguugcuuccuguugugugugguccuccugggauuuauuaugugggccugccagaaggguaauauccgcuguaacauuugcaucuga

SEQ ID NO: 122474 - RNA, 1701 nt, Artificial Sequence
  derived and/or modified sequence opt3 from hemagglutinin__InfluenzaA__ABB80229
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacacaggauucucgauggcgagaauuguacccugaucgacgcccuucugggggauccgcauugcgacggauuucagaacaaagaaugggauuuguucguggagcgguccaaggcuuauucuaauuguuaccccuaugacgucccugauuacgcaucgcuccgcucacugguggccagcaguggcacucuggaauuuaacaaugaguccuucaacuggacagguguugcucagaaugggaccucuuaugcaugcaaacgacguagcauaaaguccuuuuucucaagacucaacugguuacaccaacugaaguacaaauauccagcccuuaaugugacgaugcccaacaaugacaaguuugauaaauuguacaucuggggaguccaucacccuaguacugacagcgaucagaccucucuguacgcucaggccuccggcagggugacaguaucaacuaagcggagccagcaaaccguuauuccaaacaucggcagucgccccugggugagaggggucucuuccaggauuagcaucuauuggacaauagugaaaccuggagacauucuacucaucaacucgaccgguaaucugauugcgccacggggcuacuucaagauccgcucugggaaguccucaaucaugcgaagugacgcaccgauuggaaaauguaacagcgagugcauaacgcccaauggcuccaucccuaacgauaagccauuucagaaugugaacagaauuacuuauggugccugucccagguacgucaaacagaauacacuuaagcuggcuaccgggaugcggaacguuccugaaaaacagacucguggaaucuucggcgccauagcaggcuuuauugagaaugggugggaaggaaugguggacgguugguauggcuuccgccaccaaaacucugaggggacaggacaggcugccgaucuaaagagcacccaggcggccaucaaucaaaucaacggcaaacucaauagacugauugagaagacgaacgaaaaguuucaucagaucgagaaagaguucucagaaguagaagguaggauucaggacuuagagaaguacguggaggauaccaaaauagaccuguggaguuauaaugcagaacuccuugucgcucuggagaaccagcacacaaucgauuugacugacuccgaaaugaacaagcuauucgagcggacccgaaaacaacugcgcgaaaaugccgaggauauggggaacggcugcuuuaagauuuaccauaagugugacaaugcuugcaucggaagcaucagaaacggcacauacgaucacgacguguauagggacgaggcccucaauaaccgguuccagauuaaagggguugaacugaagucuggauacaaagauuggauacuuuggaucucauuugcaaugaguugcuuccuguugugugugguccuccuggguuuuauuaugugggccugccagaagggcaauauccgcuguaacauuugcaucuga

SEQ ID NO: 122475 - RNA, 1701 nt, Artificial Sequence; identical to SEQ ID NO: 122468
  derived and/or modified sequence opt3 from hemagglutinin__InfluenzaA__ABB80240

SEQ ID NO: 122476 - RNA, 1701 nt, Artificial Sequence
  derived and/or modified sequence opt3 from hemagglutinin__InfluenzaA__ABB80251
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcgagaauuguacccugaucgacgcucuacugggggauccgcauugcgacggauuucagaacaaagaaugggauuuguucguggagcgguccaaggccuauucuaauuguuaccccuaugacgucccugauuacgcaucgcuccgcucacugguggccagcaguggcacucuggaauuuaacaaugaguccuucaacuggacagguguugcucagaaugggaccucuagcgcaugcaaacgacguuccauaaagucauuuuucaguagacucaacugguuacaccaacugaaguauaaauacccagcccuuaaugugacgaugcccaacaaugacaaguuugauaaauuguauaucuggggaguccaucacccuagcacugacucugaucagaccucccuguacgcucaggccucaggcagggugacaguaagcacuaagcggagucagcaaaccguuauuccaaacaucggcucucgccccugggugagaggggucuccagcaggauuucgaucuacuggacaauagugaaaccuggagacauucuacucaucaacucuaccgguaaucugauugcgccacggggcuauuucaagauccgcuccgggaagucaaguaucaugcgaagcgacgcaccgauuggaaaauguaacuccgagugcauaacgcccaauggcucuaucccuaacgauaagccauuucagaaugugaacagaauuacuuacggugccugucccagguaugucaaacagaauacacuuaagcuggcuaccgggaugcggaacguuccugaaaaacagacucguggaaucuucggcgccauagcaggcuuuauugagaaugggugggaaggaaugguggacgguugguacggcuuccgccaccaaaacagcgaggggacaggacaggcugccgauuugaagucaacccaggcggccaucaaucaaaucaacggcaaacucaauagacugauugagaagacgaacgaaaaguuucaucagaucgagaaagaguucagugaaguagaagguaggauucaggacuuagagaaguauguggaggauaccaaaauagaccugugguccuacaaugcagaacuccuugucgcucuggagaaccagcacacaaucgauuugacugacagcgaaaugaacaagcuauucgagcggacccgaaaacaacugcgcgaaaaugccgaggauauggggaacggcugcuuuaagauuuaucauaagugugacaaugcuugcaucggaucuaucagaaacggcacauacgaucacgacguguacagggacgaggcccucaauaaccgguuccagauuaaagggguugaacugaagucaggauauaaagauuggauacuuuggaucaguuuugcaauuagcugcuuccuguugugugugguccuccuggguuuaaucaugugggccugccagaagggcaauauucgcuguaacaucugcauauga

SEQ ID NO: 122477 - RNA, 1701 nt, Artificial Sequence
  derived and/or modified sequence opt3 from hemagglutinin__InfluenzaA__ABB80492
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagaauagcucaacagguagaaucugcgacaguccacacaggauucucgauggcgagaacuguacccugaucgacgcucuacugggggauccgcauugcgacggauuucagaauaaagaaugggauuuguucguggagcggagcaaggccuauuccaacuguuaccccuaugacgucccugauuacgcaucucuccgcucgcugguggccucaagcggcacucuggaauuuaauaacgagaguuucaauuggacagguguugcucagaacgggaccuccuaugcaugcaaacgacguucuauaaagagcuuuuucuccagacucaauugguuacaccaacugaaguacaaauauccagcccuuaacgugacgaugcccaauaacgacaaguuugauaaauuguacaucuggggaguccaucacccuucaacugacagugaucagaccagccuguacgcucaggccucuggcagggugacaguauccacuaagcggucacagcaaaccguuauuccaaacaucggcagccgccccugggugagaggggucaguucuaggauuuccaucuauuggacaauagugaaaccuggagacauucuacucaucaauagcaccgguaaccugauugcgccacggggcuacuucaagauccgcucggggaagucuuccaucaugcgaucagacgcaccgauuggaaaauguaauagugagugcauaacgcccaacggcagcaucccuaaugauaagccauuucagaacgugaauagaauuacuuauggugccugucccagguacgucaaacagaacacacuuaagcuggcuaccgggaugcggaauguuccugaaaaacagacucguggaaucuucggcgccauagcaggcuuuauugagaacgggugggaaggaaugguggacgguugguauggcuuccgccaccaaaauuccgaggggacaggacaggcugccgauuugaagucuacccaggcggccaucaaccaaaucaauggcaaacucaacagacugauugagaagacgaaugaaaaguuucaucagaucgagaaagaguucagcgaaguagaagguaggauucaggacuuagagaaguacguggaggauaccaaaauagaccuguggucauauaacgcagaacuccuugucgcucuggagaaccagcacacaaucgauuugacugacagugaaaugaauaagcuauucgagcggacccgaaaacaacugcgcgaaaacgccgaggauauggggaauggcugcuuuaagauuuaccauaagugugacaacgcuugcaucggauccaucagaaauggcacauacgaucacgacguguauagggacgaggcccucaacaaucgguuccagauuaaagggguugaacugaagucuggauacaaagauuggauacuuuggaucucuuuugcaaugucaugcuuccuguugugugugguccuccuggguuuuauuaugugggccugccagaagggcaacauccgcuguaauauuugcaucuga

SEQ ID NO: 122478 - RNA, 1701 nt, Artificial Sequence
  derived and/or modified sequence opt3 from hemagglutinin__InfluenzaA__ABB80503
augaagaccaucauugcccugagcuacauauccugccucguguucgcucagaaacuucccggcaacgacaauaacacagcaacucuguguuuggggcaccaugccgucccuaauggaacguuaguuaagaccaucacaaacgaucaaauugaggugacuaaugcgaccgaacugguacagucuucaaguacagguagaaucugcgacagcccacacaggauucuagauggcgagaacuguacccucaucgacgcucugcuuggggauccgcauugcgacggauuucagaauaaagaaugggaucuguucguggagcgguccaaggccuauucuaacuguuaccccuaugacgucccugauuacgcaucguugcgcucacucguggccagcaguggcacucuggaauuuaauaacgaguccuucaauuggacagguguugcucagaacgggaccucuuaugcaugcaaacgacguagcauaaaguccuuuuucucaagacugaauuggcuccaccaauuaaaguacaaauauccagcccugaacgugacgaugcccaauaacgacaaguuugauaaacuuuacaucuggggaguccaucacccuaguacugacagcgaucagaccucuuuguacgcucaggccuccggcagggugacaguaucaacuaagcggagccagcaaaccguuauuccaaacaucggcagucgccccugggugagaggggucucuuccaggauuagcaucuauuggacaauagugaaaccuggagacauucugcuaaucaauucgaccgguaaccucauugcgccacggggcuacuucaagauccgcucugggaaguccucaaucaugcgaagugacgcaccgauuggaaaauguaauagcgagugcauaacgcccaacggcuccaucccuaaugauaagccauuucagaacgugaauagaauuacuuauggugccugucccagguacgucaaacagaacacacugaagcuggcuaccgggaugcggaauguuccugaaaaacagacucguggaaucuucggcgccauagcaggcuuuauugagaacgggugggaaggaaugguggacgguugguauggcuuccgccaccaaaauucugaggggacaggacaggcugccgaucuuaagagcacccaggcggccaucaaccaaaucaauggcaaauugaacagacucauugagaagacgaaugaaaaguuucaucagaucgagaaagaguucucagaaguagaagguaggauucaggaccuggagaaguacguggaggauaccaaaauagacuuauggaguuauaacgcagaacugcucgucgcucuugagaaccagcacacaaucgaucugacugacuccgaaaugaauaaguuguucgagcggacccgaaaacaacuacgcgaaaacgccgaggauauggggaauggcugcuuuaagauuuaccauaagugugacaacgcuugcaucggaagcaucagaaauggcacauacgaucacgacguguauagggacgaggcccugaacaaucgguuccagauuaaagggguugaacuccgcucuggauacaaggauuggauacuguggaucucauuugcaauuaguugcuuccuucuguguguggucuugcucgguuuuaucaugugggccugccagaaaggcaacauuagauguaauaucugcauauga

SEQ ID NO: 122479 - RNA, 1701 nt, Artificial Sequence; identical to SEQ ID NO: 122468
  derived and/or modified sequence opt3 from hemagglutinin__InfluenzaA__ABB80514

SEQ ID NO: 122480 - RNA, 1701 nt, Artificial Sequence
  derived and/or modified sequence opt3 from hemagglutinin__InfluenzaA__ABB80529
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcgagaauuguacccucaucgacgcucugcuuggggauccgcauugcgacggauuucagaacaaagaaugggaucuguucguggagcggucuaaggccuauucgaauuguuaccccuaugacgucccugauuacgcaucauugcgcagccucguggccaguuccggcacucuggaauuuaacaaugagucuuucaacuggacagguguugcucagaaugggaccagcuaugcaugcaaacgacguuccauaaagucauuuuucaguagacugaacuggcuccaccaauuaaaguacaaauauccagcccugaaugugacgaugcccaacaaugacaaguuugauaaacuuuacaucuggggaguccaucacccuagcacugacucugaucagaccuccuuguacgcucaggccucaggcagggugacaguaagcacuaagcggagucagcaaaccguuauuccaaacaucggcucucgccccugggugagaggggucuccagcaggauuucgaucuauuggacaauagugaaaccuggagacauucugcuaaucaacucuaccgguaaucucauugcgccacggggcuacuucaagauccgcuccgggaagucaaguaucaugcgaagcgacgcaccgauuggaaaauguaacuccgagugcauaacgcccaauggcucuaucccuaacgauaagccauuucagaaugugaacagaauuacuuauggugccugucccagguacgucaaacagaauacacugaaacuugcuaccgggaugcggaacguuccugacaagcagacucguggaaucuucggcgccauagcaggcuuuauugaaaaugggugggagggaaugguggaugguugguauggcuuccgccaccaaaacagcgaagggacaggacaggcugccgaccugaagucaacccaggcggccaucaaucaaaucaacggcaaauugaauagacucauugagaagacgaacgagaaguuucaucagaucgaaaaagaguucagugaaguagaggguaggauucaggaucuggaaaaguacguggaggacaccaaaauagauuuaugguccuauaaugcagagcugcucgucgcucuugaaaaccagcacacaaucgaccugacugauagcgagaugaacaaguuguucgaacggacccgaaaacaacuacgcgagaaugccgaagacauggggaacggcugcuuuaagauuuaccauaagugugauaaugcuugcaucggaucuaucagaaacggcacauacgaccacgacguguauagggaugaggcccugaauaaccgguuccagauuaaagggguugagcucaagucaggauacaaagacuggauacuguggaucaguuuugcaauuagcugcuuccuucuguguguggucuugcucgguuuuaucaugugggccugccagaagggcaauauucgcuguaacaucugcauauga

SEQ ID NO: 122481 - RNA, 1701 nt, Artificial Sequence
  derived and/or modified sequence opt3 from hemagglutinin__InfluenzaA__ABB80641
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguagaauuugcgacagcccacacaggauccuagauggcgagaauuguacccucauagacgcucugcuuggggauccgcauugcgacggauuucagaacaaagaaugggaucuguucguggagcgguccaaggccuauucuaauuguuaccccuaugacgucucggauuacgcaucauugcgcagccucguggccaguuccggcacucuggaauuuaacaaugagucuuucaacuggacagguguugcucagaaugggaccagcuaugcaugcaaacgacguuccaucaagucauuuuucaguagacugaacuggcuccaccaauuaaaguacaaauauccugcccugaaugugacgaugccaaacaaugacaaguuugauaaacuuuacauuuggggaguccaucaccccagcacugacucugaucagaccuccuuguacgcucaggccucaggcagggugacaguaagcacuaagcggagucagcaaaccguuaucccuaacauuggcucucgcccaugggugagaggggucuccagcaggaucucgauauauuggacaauugugaaacccggagacauccugcuaauuaacucuaccgguaaucucaucgcgccucggggcuacuucaagauccgcuccgggaagucaaguauuaugcgaagcgacgcaccaauaggaaaauguaacuccgagugcaucacgccgaauggcucuauucccaacgauaagccuuuucagaaugugaacagaaucacuuauggugccuguccaagguacgucaaacagaauacacugaaacuugcuaccgggaugcggaacguucccgaaaagcagacucguggaauauucggcgccauugcaggcuuuaucgagaaugggugggaaggaaugguggacgguugguauggcuuccgccaccaaaacagcgaggggacaggacaggcugccgaucugaagucaacccaggcggccaucaaucaaauuaacggcaaauugaauagacucaucgagaagacgaacgaaaaguuucaucagauugagaaagaguucagugaaguagaagguaggauacaggaccuggagaaguacguggaggauaccaaaaucgacuuaugguccuauaaugcagaacugcucgucgcucuugagaaccagcacacaauugaucugacugacagcgaaaugaacaaguuguucgagcggacccgaaaacaacuacgcgaaaaugccgaggauauggggaacggcugcuuuaagaucuaccauaagugugacaaugcuugcaucggaucuauuagaaacggcacauacgaucacgacguguauagggacgaggcccugaauaaccgguuccagauaaaagggguugaacucaagucaggauacaaagauuggauccuguggauuaguuuugcaaucagcugcuuccuucuguguguggucuugcucgguuuuauuaugugggccugccagaagggcaauauccgcuguaacauaugcaucuga

SEQ ID NO: 122482 - RNA, 1701 nt, Artificial Sequence
  derived and/or modified sequence opt3 from hemagglutinin__InfluenzaA__ABB80661
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguagaauuugcgacagcccacacaggauccuagauggcgagaauuguacccucauagacgcucugcuuggggauccgcauugcgacggauuucagaacaaagaaugggaucuguucguggagcgguccaaggccuauucuaauuguuaccccuaugacgucccugauuacgcaucguugcgcucacucguggccagcaguggcacucuggaauuuaacaaugaguccuucaacuggacagguguugcucagaaugggaccucuuaugcaugcaaacgacguagcaucaaguccuuuuucucaagacugaacuggcuccaccaauuaaaguacaaauauccagcccugaaugugacgaugcccaacaaugacaaguuugauaaacuuuacauuuggggaguccaucacccuaguacugacagcgaucaggcuucuuuguacgcccaggcguccggcagggugaccguaucaacaaagcggagccagcaaacuguuaucccaaacauuggcagucgccccugggugagaggggucucuuccaggaucagcauauauuggaccauugugaaaccuggagacauccugcuaauuaacucgacagguaaucucaucgcaccacggggcuacuucaagauccgcucugggaaguccucaauuaugcgaagugacgccccgauaggaaaauguaacagcgagugcaucacccccaauggcuccauuccuaacgauaagccauuucagaaugugaacagaaucacguauggugcuugucccagguacgucaaacagaauacucugaagcuggccacagggaugcggaacguuccugaaaaacagacccguggaauauucggcgcaauugcuggcuuuaucgagaaugggugggaaggaaugguggacgguugguauggcuuccgccaccaaaacucugaggggacuggacaggccgcggaucuuaagagcacacaggccgcaaucaaucaaauuaacggcaaauugaauagacucaucgagaagaccaacgaaaaguuucaucagauugagaaagaguucucagaaguagaagguaggauacaggaccuggagaaguacguggaggauacgaaaaucgacuuauggaguuauaaugcugaacugcucgucgcccuugagaaccagcacaccauugaucugacagacuccgaaaugaacaaguuguucgagcggacucgaaaacaacuacgcgaaaaugcugaggauauggggaacggcugcuuuaagaucuaccauaagugugacaaugccugcaucggaagcauuagaaacggcaccuacgaucacgacguguauagggacgaggcacugaauaaccgguuccagauaaaagggguugaacucaagucuggauacaaagauuggauccuguggauuucauuugccaucaguugcuuccuucuguguguggucuugcucgguuuuauuaugugggcuugccagaagggcaauauccgcuguaacauaugcaucuga

SEQ ID NO: 122483 - RNA, 1701 nt, Artificial Sequence
  derived and/or modified sequence opt3 from hemagglutinin__InfluenzaA__ABB80672
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaggguucuucaacaggcagaaucugcgacaguccacaccagauucucgaugggaaaaauuguacccugaucgacgcucuacugggagauccgcauugcgacggcuuucagaacaaggagugggauuuguucguggaaaggagcacugccuauuccaauuguuaccccuaugacgucccugauuacgcaucucuccggucgcugguggccucaagcgguacacuggaguuuaccaaagaaggguucaacuggacgggaguugcucaagacggcacuagcuaugcaugcaagcgcggcuccgugaagucuuucuucagccgacucaauugguuacacaaacuggaguacaaguauccagcccuuaacgucaccaugcccaauaacgauaaauuugacaaguuguacauauggggagugcaucacccuuccacagauucagaccagaccagucuguacguacaggcuagcgggcguguuacugugucuacaaaaagaucccagcaaaccgucaucccaaauauugguucaaggcccugggugcggggcgugagcagucgcaucucuauuuauuggacgaucgucaagccuggggacauacuacucauuaacuccacuggaaaucugaucgccccaagaggcuacuucaagauuaggagcgguaaaucgucuaucaugcgguccgaugcgccgaucgacaacuguaacucagagugcauuacacccaaugggaguauaccuaacgauaagccauuucagaauguuaaccgcaucaccuauggagcauguccccgauacgugaaacagaauacucuuaagcuggccacaggcaugagaaacguaccugaaaaacagaccaggggcauuuucggggcuaucgccggauuuauagagaaugguugggaaggcaugguggacgggugguauggauuccggcaccaaaacagcgagggcacgggucaggcagcugauuugaaguccacccaggccgcgauuaaucaaaucaacgggaaacucaaucgucugaucgagaagacaaacgaaaaguuucaucagauugagaaagaauuuucugaggucgaaggccgcauccaggacuuagagaaguacguggaggauacuaaaauugaccuguggagcuauaaugccgaacuccuuguugcacuggagaaccagcacaccauagauuugacagacucagaaaugaauaagcuauucgagagaacuaggaaacaacugcgggaaaacgcugaggauaugggaaacggcugcuuuaagaucuaccauaagugugacaaugccugcauugggaguauccgaaacggaaccuacgaccacgauguguaucgcgacgaggcucucaauaacagauuccagaucaaaggugucgaacugaaguccggcuacaaagauuggauucuuuggauaaguuuugccaucucuugcuuccuguugugugugguacuccugggguuuauuaugugggcaugccagaagggaaauaucagguguaacauuugcaucuga

SEQ ID NO: 122484 - RNA, 1701 nt, Artificial Sequence
  derived and/or modified sequence opt3 from hemagglutinin__InfluenzaA__ABB80682
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcgagaauuguacccucaucgacgcucugcuuggggauccgcauugcgacggauuucagaacaaagaaugggaucuguucguggagcggucuaaggccuauucgaauuguuaccccuaugacgucccugauuacgcaucauugcgcagccucguggccaguuccggcacucuggaauuuaacaaugagucuuucaacuggacagguguugcucagaaugggaccagcuaugcaugcaaacgacguuccauaaagucauuuuucaguagacugaacuggcuccaccaauuaaaguacaaauauccagcccugaaugugacgaugcccaacaaugacaaguuugauaaacuuuacaucuggggaguccaucacccuagcacugacucugaucagaccuccuuguacgcucaggccucaggcagggugacaguaagcacuaagcggagucagcaaaccguuauuccaaacaucggcucucgccccugggugagaggggucuccagcaggauuucgaucuauuggacaauagugaaaccuggagacauucugcuaaucaacucuaccgguaaucucauugcgccacggggcuacuucaagauccgcuccgggaagucaaguaucaugcgaagcgacgcaccgauuggaaaauguaacuccgagugcauaacgcccaauggcucuaucccuaacgauaagccauuucagaaugugaacagaauuacuuauggugccugucccagguacgucaaacagaauacacugaaacuugcuaccgggaugcggaacguuccugaaaagcagacucguggaaucuucggcgccauagcaggcuuuauugagaaugggugggaaggaaugguggacgguugguauggcuuccgccaccaaaacagcgaggggacaggacaggcugccgaucugaagucaacccaggcggccaucaaucaaaucaacggcaaauugaauagacucauugagaagacgaacgaaaaguuucaucagaucgagaaagaguucagugaaguagaagguaggauucaggaccuggagaaguacguggaggauaccaaaauagacuuaugguccuauaaugcagaacugcucgucgcucuugagaaccagcacacaaucgaucugacugacagcgaaaugaacaaguugcuagagcggacccgaaaacaacugcgcgaaaaugccgaggauauggggaacggcugcuucaagauuuaccauaagugugacaaugcuugcaucggaucuaucagaaacggcacauacgaucacgacguguauagggacgaggcccucaauaaccgguuucagauuaaagggguugaacugaagucaggauacaaagauuggauacuuuggaucaguuucgcaauuagcugcuuucuguugugugugguccuccuggguuucaucaugugggccugccagaagggcaauauucgcuguaacaucugcauauga

SEQ ID NO: 122485 - RNA, 1701 nt, Artificial Sequence
  derived and/or modified sequence opt3 from hemagglutinin__InfluenzaA__ABB80693
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaugugcgacuccccacacaggauccuagauggcgagaauuguacccucauugacgcucugcuuggggauccgcauugcgacggauuucagaacaaagaaugggaucuguucguggagcggucuaaggccuauucgaauuguuaccccuaugacgucccugauuacgcaucauugcgcagccucguggccaguuccggcacucuggaauuuaacaaugagucuuucaacuggacagguguugcucagaaugggaccagcuaugcaugcaaacgacguuccaucaagucauuuuucaguagacugaacuggcuccaccaauuaaaguacaaauauccagcccugaaugugacgaugcccaacaaugacaaguuugauaaacuuuacauauggggaguccaucacccuagcacugacucugaucagaccuccuuguacgcucaggccucaggcagggugacaguaagcacuaagcggagucagcaaaccguuaucccaaacauuggcucucgccccugggugagaggggucuccagcaggaucucgauuuauuggacaaucgugaaaccuggagacauacugcuaauuaacucuaccgguaaucucaucgcgccacggggcuacuucaagauucgcuccgggaagucaaguaucaugcgaagcgacgcaccgaucggaaaauguaacuccgagugcauuacgcccaauggcucuauaccuaacgauaagccauuucagaaugugaacagaaucacuuauggugccugucccagguacgucaaacagaauacacugaaacuugcuaccgggaugcggaacguuccugaaaagcagacucguggaauuuucggcgccaucgcaggcuuuauagagaaugggugggaaggaaugguggacgguugguauggcuuccgccaccaaaacagcgaggggacaggacaggcugccgaucugaagucaacccaggcggccauuaaucaaaucaacggcaaauugaauagacucaucgagaagacgaacgaaaaguuucaucagauugagaaagaguucagugaaguagaagguaggauccaggaccuggagaaguacguggaggauaccaaaauugacuuaugguccuauaaugcagaacugcucgucgcucuugagaaccagcacacaauagaucugacugacagcgaaaugaacaaguuguucgagcggacccgaaaacaacuacgcgaaaaugccgaggauauggggaacggcugcuuuaagaucuaccauaagugugacaaugcuugcauuggaucuaucagaaacggcacauacgaucacgacguguauagggacgaggcccugaauaaccgguuccagaucaaagggguugaacucaagucaggauacaaagauuggauucuguggauaaguuuugcaaucagcugcuuccuucuguguguggucuugcucgguuuuauuaugugggccugccagaagggcaauauccgcuguaacauuugcaucuga

SEQ ID NO: 122486 - RNA, 1701 nt, Artificial Sequence
  derived and/or modified sequence opt3 from hemagglutinin__InfluenzaA__ABB80704
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguagaauuugcgacagcccacacaggauccuagauggcgagaauuguacccucauagacgcucugcuuggggauccgcauugcgacggauuucagaacaaagaaugggaucuguucguggagcgguccaaggccuauucuaauuguuaccccuaugacgucccugauuacgcaucguugcgcucacucguggccagcaguggcacucuggaauuuaacaaugaguccuucaacuggacagguguugcucagaaugggaccucuuaugcaugcaaacgacguagcaucaaguccuuuuucucaagacugaacuggcuccaccaauuaaaguacaaauauccagcccugaaugugacgaugcccaacaaugacaaguuugauaaacuuuacauuuggggaguccaucacccuaguacugacagcgaucagaccucuuuguacgcucaggccuccggcagggugacaguaucaacuaagcggagccagcaaaccguuaucccaaacauuggcagucgccccugggugagaggggucucuuccaggaucagcauauauuggacaauugugaaaccuggagacauccugcuaauuaacucgaccgguaaucucaucgcgccacggggcuacuucaagauccgcucugggaaguccucaauuaugcgaagugacgcaccgauaggaaaauguaacagcgagugcaucacgcccaauggcuccauuccuaacgauaagccauuucagaaugugaacagaaucacuuauggugccugucccagguacgucaaacagaauacacugaagcuggcuaccgggaugcggaacguuccugaaaaacagacucguggaauauucggcgccauugcaggcuuuaucgagaaugggugggaaggaaugguggacgguugguauggcuuccgccaccaaaacucugaggggacaggacaggcugccgaucuuaagagcacccaggcggccaucaaucaaauuaacggcaaauugaauagacucaucgagaagacgaacgaaaaguuucaucagauugagaaagaguucucagaaguagaagguaggauacaggaccuggagaaguacguggaggauaccaaaaucgacuuauggaguuauaaugcagaacugcucgucgcucuugagaaccagcacacaauugaucugacugacuccgaaaugaacaaguuguucgagcggacccgaaaacaacuacgcgaaaaugccgaggauauggggaacggcugcuuuaagaucuaccauaagugugacaaugcuugcaucggaagcauuagaaacggcacauacgaucacgacguguauagggacgaggcccugaauaaccgguuccagauaaaagggguugaacucaagucuggauacaaagauuggauccuguggauuucauuugcaaucaguugcuuccuucuguguguggucuugcucgguuuuauuaugugggccugccagaagggcaauauccgcuguaacauaugcaucuga

SEQ ID NO: 122487 - RNA, 1701 nt, Artificial Sequence; identical to SEQ ID NO: 122468
  derived and/or modified sequence opt3 from hemagglutinin__InfluenzaA__ABB80715

SEQ ID NO: 122488 - RNA, 1701 nt, Artificial Sequence
  derived and/or modified sequence opt3 from hemagglutinin__InfluenzaA__ABB80724
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacacaggauucucgauggcgagaauuguacccugaucgacgcccuucugggggauccgcauugcgacggauuucagaacaaagaaugggauuuguucguggagcgguccaaggcuuauucuaauuguuaccccuaugacgucccugauuacgcaucgcuccgcucacugguggccagcaguggcacucuggaauuuaacaaugaguccuucaacuggacagguguugcucagaaugggaccucuuaugcaugcaaacgacguagcauaaaguccuuuuucucaagacucaacugguuacaccaacugaaguacaaauauccagcccuuaaugugacgaugcccaacaaugacaaguuugauaaauuguacaucuggggaguccaucacccuaguacugacagcgaucaggcuucucuguacgcccaggcguccggcagggugaccguaucaacaaagcggagccagcaaacuguuauuccaaacaucggcagucgccccugggugagaggggucucuuccaggauuagcaucuauuggaccauagugaaaccuggagacauucuacucaucaacucgacagguaaucugauugcaccacggggcuacuucaagauccgcucugggaaguccucaaucaugcgaagugacgccccgauuggaaaauguaacagcgagugcauaacccccaauggcuccaucccuaacgauaagccauuucagaaugugaacagaauuacguauggugcuugucccagguacgucaaacagaauacucuuaagcuggccacagggaugcggaacguuccugaaaaacagacccguggaaucuucggcgcaauagcuggcuuuauugagaaugggugggaaggaaugguggacgguugguauggcuuccgccaccaaaacucugaggggacuggacaggccgcggaucuaaagagcacacaggccgcaaucaaucaaaucaacggcaaacucaauagacugauugagaagaccaacgaaaaguuucaucagaucgagaaagaguucucagaaguagaagguaggauucaggacuuagagaaguacguggaggauacgaaaauagaccuguggaguuauaaugcugaacuccuugucgcccuggagaaccagcacaccaucgauuugacagacuccgaaaugaacaagcuauucgagcggacucgaaaacaacugcgcgaaaaugcugaggauauggggaacggcugcuuuaagauuuaccauaagugugacaaugccugcaucggaagcaucagaaacggcaccuacgaucacgacguguauagggacgaggcacucaauaaccgguuccagauuaaagggguugaacugaagucuggauacaaagauuggauacuuuggaucucauuugccaugaguugcuuccuguugugugugguccuccuggguuuuauuaugugggcuugccagaagggcaauauccgcuguaacauuugcaucuga

SEQ ID NO: 122489 - RNA, 1701 nt, Artificial Sequence; identical to SEQ ID NO: 122474
  derived and/or modified sequence opt3 from hemagglutinin__InfluenzaA__ABB80737

SEQ ID NO: 122490 - RNA, 1701 nt, Artificial Sequence
  derived and/or modified sequence opt3 from hemagglutinin__InfluenzaA__ABB80748
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcgagaauuguacccucaucgacgcucugcuuggggauccgcauugcgacggauuucagaacaaagaaugggaucuguucguggagcggucuaaggccuauucgaauuguuaccccuaugacgucccugauuacgcaucauugcgcagccucguggccaguuccggcacucuggaauuuaacaaugagucuuucaacuggacagguguugcucagaaugggaccagcuaugcaugcaaacgacguuccauaaagucauuuuucaguagacugaacuggcuccaccaauuaaaguacaaauauccagcccugaaugugacgaugcccaacaaugacaaguuugauaaacuuuacaucuggggaguccaucacccuagcacugacucugaucagaccuccuuguacgcucaggccucaggcagggugacaguaagcacucagcggagucaacagaccguuauuccaaacaucggcucucgccccugggugagaggggucuccagcaggauuucgaucuauuggacaauagugaagccuggagacauucugcuaaucaacucuaccgguaaucucauugcgccacggggcuacuucaaaauccgcuccgggaagucaaguaucaugcgaagcgacgcaccgauuggaaaguguaacuccgagugcauaacgcccaauggcucuaucccuaacgauaaaccauuucagaaugugaacagaauuacuuauggugccugucccagguacgucaagcagaauacacugaaacuugcuaccgggaugcggaacguuccugaaaagcaaacucguggaaucuucggcgccauagcaggcuuuauugagaaugggugggaaggaaugguggacgguugguauggcuuccgccaccagaacagcgaggggacaggacaggcugccgaucugaaaucaacccaagcggccaucaaucagaucaacggcaaguugaauagacucauugagaaaacgaacgaaaaguuucaucagaucgagaaggaguucagugaaguagaagguaggauucaggaccuggaggaguacguggaagauaccaaaauagacuuaugguccuauaaugcagagcugcucgucgcucuugaaaaccaacacacaaucgaucugacugacagcgagaugaacaaguuguucgaacggacccgaaaacagcuacgcgagaaugccgaggauauggggaacggcugcuuuaagauuuaccauaaaugugacaaugcuugcaucggaucuaucagaaacggcacauacgaucacgacguguauagggacgaagcccugaauaaccgguuccagauuaaggggguugagcucaagucaggauacaaagauuggauacuguggaucaguuuugcaauuagcugcuuccuucuguguguggucuugcucgguuuuaucaugugggccugccagaagggcaauauucgcuguaacaucugcauauga

SEQ ID NO: 122491 - RNA, 1701 nt, Artificial Sequence
  derived and/or modified sequence opt3 from hemagglutinin__InfluenzaA__ABB82183
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaagugugaugcgcagcgacgcauccaucggacgauguaauucugaaugcauuaccccgaacggcagcauacccaaugacaaaccuuuucagaacgucaauagaaucacguacggugccuguccaagguauguuaagcagaacacucuuaaacuggcuacagggaugcggaaugugcccgagaagcaaacccguggaauuuucggcgccaucgcaggcuuuauagaaaacgggugggagggaaugguagaugguugguacggcuuccgccaccagaauagcgaggggacuggacaggcugccgacuugaaaaguacacaagcggccauuaaccagaucaauggcaagcucaacagacugaucgagaaaaccaaugaaaaguuucaucagauugaaaaggaguucuccgaaguggaggguaggauccaggauuuagagaaauaugucgaagacacgaagauugaucuguggagcuacaacgcagagcuccuuguggcucuggaaaaccaacacaccauagacuugacagauucugagaugaauaaacuauucgaacggacuaagaaacagcugcgagagaacgccgaggacauggggaauggcugcuuuaagaucuaucauaagugugauaacgcuugcauuggaucaauccgcaauggcaccuacgaccacgauguuuacagagacgaagcccucaacaauagguuccagaucaaagggguggagcugaagaguggauauaaagacuggauucuuuggauaucauuugcaaucuccugcuuccuguugugugucgugcuccuggguuuuauuaugugggccugccagaagggcaacauccgguguaauauuugcaucuga

SEQ ID NO: 122492 - RNA, 1698 nt, Artificial Sequence; identical to SEQ ID NO: 122312
  derived and/or modified sequence opt3 from hemagglutinin__InfluenzaA__ABB82194

SEQ ID NO: 122493 - RNA, 1698 nt, Artificial Sequence
  derived and/or modified sequence opt3 from hemagglutinin__InfluenzaA__ABB82205
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuacaaaaauuuacuguggcuuacgggaaagaacggcuuguaucccaaucugagcaaaucuuacgcaaacuccaaggaaaaagagguacuuguucucuggggcgugcaucacccuccaaauaucggggaucagcgggcccuguaccacacugaaaacgcuuaugucucaguggugagcagucauuacucucgccgauucacccccgagauagcaaagcguccuaaggucagagaccaggaaggaaggaucaacuauuacuggacacuucuggagccaggugauacuauuaucuuugaggccaauggcaacuugauugcuccgcgguaugccuucgcgcucucccgcggguuuggaagcggcaucauaaccucgaaugcacccauggacgaaugugaugccaaaugccagacaccucaaggugcuauuaacucuucccugccauuccagaauguucaccccgugaccaucggggaguguccuaaguacguaagaucagccaaauuaaggauggugacgggacugcggaacauuccaaguauccagagccgcggccucuuuggcgcaaucgcuggguucauugaaggagguuggacuggcauggucgacgggugguauggauaccaucaccagaaugagcaaggcuccgguuacgccgcggaucagaagucuacacagaacgccauaaaugggaucaccaacaaagugaauagcguuauugaaaagaugaacacucaguuuacagcagugggcaaagaguucaauaagcuagagcgaagaauggaaaaccugaauaagaaagucgacgauggauucuuggacaucuggaccuauaacgcugagcuacuggugcuccuggaaaacgagaggacgcuugacuuucacgauucaaauguaaagaaccuguacgaaaaaguuaagagucaauugaaaaauaacgccaaggagauaggcaaugggugcuucgaguuuuaucauaaguguaacgacgaaugcauggaguccgugaaaaauggaaccuacgauuaucccaaguacagcgaagagucuaaacucaaccgggagaagauugacggugucaaacuggaaucaaugggcguguaucagaucuuagcuaucuacaguacagucgccagcucccuggugcuacucguuucucugggggcaauuucguucuggaugugcagcaauggaucccuucagugucguaucugcauuuga

SEQ ID NO: 122494 - RNA, 1698 nt, Artificial Sequence
  derived and/or modified sequence opt3 from hemagglutinin__InfluenzaA__ABB82216
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucuagcuccugcucacacaacgggaagaguagcuuuuaccggaauuuacuguggcuuacgggcaaaaacggauuguaucccaaucugucuaaguccuacguaaacaauaaagaaaaggagguucuagugcucuggggcguccaucacccuccaaacaucggggaucagcgcgcccuguaccacacugaaaacgcauaugugucaguggucagcagucauuacucucgacguuucacccccgagauagccaaaagaccuaagguuagggaccaggaaggacggaucaauuauuacuggacacuucuggagccaggugauacuauuaucuuugaggcuaacggcaauuugauugcaccgcgcuaugccuucgcucucuccagaggguuuggaagcggcaucauaaccucgaacgcccccauggacgaaugugaugcgaagugccagacaccucaaggugcaauuaauucuucccugccauuccagaacgugcaccccguaaccaucggggaguguccuaaauacgugaggucagccaaguuacggauggucacgggacugcgcaauauuccaaguauccagagccgaggccucuuuggcgcuaucgccggguucauugaaggagguuggacuggcaugguggacgggugguauggauaccaucaccagaacgagcaaggcuccgguuacgcagcugaucagaaaucuacacagaaugccauaaacgggaucaccaauaagguuaacagcgugauugaaaagaugaauacucaguuuacagcggucggcaaagaguucaacaaacuugagagaaggauggaaaaucugaacaagaagguggacgauggauucuuggacaucuggaccuauaacgccgagcuacugguacuccuggaaaaugagcggacgcuugacuuucacgauucaaacguuaaaaaucuguacgaaaaggugaaaagucaauugaagaacaaugcaaaagagauaggcaacgggugcuucgaguuuuaucauaaguguaaugacgaaugcauggaguccgucaagaacggaaccuacgauuaucccaaauacagcgaagagucuaagcucaaucgugagaaaauugacggugugaagcuggaaucaaugggcgucuaucagaucuuagcuaucuacaguacaguggccagcucccugguucuacucgugucucugggggcuauuucguucuggaugugcagcaacggaucccuucagugucgcaucugcauuuga

SEQ ID NO: 122495 - RNA, 1701 nt, Artificial Sequence
  derived and/or modified sequence opt3 from hemagglutinin__InfluenzaA__ABB82227
augaagaccaucauugcccugagcuacauauucugccucacacuuggccaggaccugcccgggaacgauaauuccaaagcuacuuuguguuuaggacaccaugcagugccuaacgguacgcuggucaagaccaucacagacgaucaaacugagguuaccaaugccacagaacuugugcagucuucaaguaccggcaaaauuugcaacaauccacacagaauccucgacgggauggauuguacucugauugacgcgcuucugggagauccgcauugcgacguauuucagaacgagacaugggauuuguucguggaaaggagcaaggcuuuuuccaauuguuaucccuacgacgucccugauuaugccucucuccggucgcuggcagccucaagcggcacccuggaguucaucacggaagguuuuacuuggaccggggugacacagaacggaggcaguaaugcuugcaaacgcggcccaggguccggauucuuuucucgacucaacugguuaacuaagagcgguaauaccuaccccguucugaacgugacaaugccuaauaacgacaauuucgauaagcuauauauauggggcguccaccauccauccaccgaccaagagcagacgucauuguacgugcaggcaagugggcguguaacuguuagcacaagaaggucucagcaaaccaucauucccaacaucggaucccggccuugggugcgcggccugucaagcagaauuaguaucuauuggacuauagucaaaccaggugacgugcuagugauuaacucuaaugggaaccucaucgccccgaggggauacuuuaagaugcggacaggcaaauccagcauuaugcgcucggaugcucccaucgacaccuguaucucugagugcauuacgccuaauggcuccauaccaaacgauaagcccuuccagaauaucaacaaaauuaccuacggggccuguccuaaguaugucaagcagaauacacugaaacuugcgacuggaaugcgaaacguuccagaaaagcagaccagaggucuguuuggcgcaaucgccggguucauagagaauggaugggaaggcaugauugacgguugguacggguuuaggcaccaaaacucagagggcacaggacaggcugccgauuugaaaaguacucaggcagcuaucgaccaaaucaauggcaagcucaaccggauuaucgagaaaaccaaugaaaaguuccaccagauugagaaagaguucagcgaaguggaagggcguauacaggaucuggagaaguauguagaggacacaaagaucgauuuaugguccuacaacgccgaacugcucguggcgauggagaaucagcauaccauugaccuuacugauucugaaaugaacaaacuguuugagaagacgcgcagacaauugagggaaaacgccgaggacaugggaaaugguugcuucaaaaucuaucacaagugugacaacgcaugcaucgagagcauucggaauggcacauacgaucaugacgucuaucgagaugaagcucuaaacaaucgcuuucagauaaaagggguggagcugaagucaggauacaaggacuggauccucuggauuaguuucgccaucuccugcuuucugcuuuguguugugcuguugggcuucauuaugugggcuugccagagagguaacaucagguguaauauaugcaucuga

SEQ ID NO: 122496 - RNA, 1698 nt, Artificial Sequence
  derived and/or modified sequence opt3 from hemagglutinin__InfluenzaA__ABB83026
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacggagaaaaacggauuguaucccaaucugagcaagucuuacgcaaacaauaaagagaaggaagugcuaauacucuggggcguacaucacccuccaaacaucggcgaucagcgcacucuguaccacaccgagaacgccuauguuuccguggucucaagccauuacagucgacguuucacacccgaaauuacuaaaagaccuaaggugagggaccaggaggggcggaucaauuauuacuggacccuucuggagccaggagauacaauuaucuuugaagcuaacgguaauuugauagcaccgugguaugccuucgcucucucucgcggcuuuggguccggaauuaucaccagcaacgcccccauggacgagugugaugcgaagugccagacgccucaaggcgcaauuaauucgucucugccauuccagaacgugcaccccgucacuaucggugaauguccuaaauacguuagauccgccaaguuaaggauggugacagggcugcggaauaucccaucaauucagagucgcggacucuuuggcgcuauagccggcuucaucgaagggggauggaccgguaugguagacggcugguauggguaccaucaccagaacgaacaaggaagcggcuacgcagcugaucagaaauccacucagaaugccauuaacgguaucacaaauaaggugaacucugucauagagaaaaugaauacccaguuuacggcgguggggaaggaguucaacaaacuugaacgaagaauggagaaucugaacaagaagguugacgauggcuucuuggacauuuggaccuauaacgccgaacuacuggugcuccuggagaaugaaaggacacuugacuuucacgauagcaacgucaaaaaucuguacgagaaggugaaaucacaauugaagaacaaugcaaaagagaucggaaacggcugcuucgaauuuuaucauaaguguaauaacgagugcauggaaaguguaaagaaugggacuuacgacuaucccaaauacuccgaggagagcaagcucaaccgggagaaaaucgauggaguuaagcuggaaucuauggguguguaucagauuuuagcuaucuacucaaccgucgccaguagccuggugcuacucgucucccugggcgcuauuucuuucuggaugugcucgaaugggagccuucagugucguauaugcaucuga

SEQ ID NO: 122497 - RNA, 1698 nt, Artificial Sequence
  derived and/or modified sequence opt3 from hemagglutinin__InfluenzaA__ABB83127
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuaccggaauuuacuguggcuuaccggcaaaaacggauuguaucccaaucugagcaagucuuacgccaacaauaaagaaaaggaggugcuaauacucuggggcguacaucacccuccaaacaucggggaucagcgcacgcuguaccacacugaaaacgcuuauguuuccguggucucaagccauuacagucgacguuucacccccgagauuacaaaaagaccuaaggugagggaccaggaaggacggaucaauuauuacuggacucuucuggagccaggugauaccauuaucuuugaggcaaacggcaauuugauagccccgugguaugcuuucgcccucucucgcggguuuggauccggcauuaucauuagcaacgcgcccauggacgaaugugaugcaaagugccagacaccucaaggugccaucaauucgucucugccauuccagaacgugcaccccgucaccaucggggaguguccuaaauacguuagauccgcuaaguuaaggauggugacgggacugcggaauauuccaucaauacagagucgcggccucuuuggcgccaucgcaggguucauugaaggagguuggacuggcaugguagacgggugguauggauaccaucaccagaacgagcaaggcagcgguuacgcugccgaucagaaauccacacagaaugcgaucaacgggauaaccaauaaggugaacucugucauugaaaagaugaauacucaguuuacagccgugggcaaagaguucaacaaacuugagcgaagaauggaaaaucugaacaagaagguugacgauggauucuuggacaucuggaccuauaacgcagagcuacuggugcuccuggaaaaugagaggacgcuugacuuucacgauagcaacgucaaaaaucuguacgaaaaggugaaaucacaauugaagaacaaugcuaaagagaucggcaacgggugcuucgaguuuuaucauaaguguaauaacgaaugcauggagaguguaaagaauggaaccuacgacuaucccaaauacuccgaagagagcaagcucaaccgggagaaaauugaugguguuaagcuggacucuaugggcguguaucagaucuuagccauuuacucaacagucgcuaguagccuggugcuacucgucucccugggggccauaucuuucuggaugugcucgaauggaagccuucagugucguaucugcauuuga

SEQ ID NO: 122498 - RNA, 1698 nt, Artificial Sequence
  derived and/or modified sequence opt3 from hemagglutinin__InfluenzaA__ABB83138
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgaucagcucauucgaaagguuugagauauucccuaaggagaguuccuggccaaaucauacuguuacaggugugucugcaagcugcucccacaacgggaagucaaguuuuuaccggaauuuacuguggcuuaccggcaaaaacggauuguaucccaaucugagcaagucuuacgccaacaauaaagaaaaggagguccuaauccucuggggcgugcaucacccuccaaacauuggggaucagcgcacgcuguaccacacugaaaacgcuuauguauccguugugucaagccauuacagucgacguuucacccccgagaucacaaaaagaccuaaggucagggaccaggaaggacggauuaauuauuacuggacucuucuggagccaggugauaccaucauauuugaggcaaacggcaauuugauugccccgugguaugcuuucgcccucucucgcggguuuggauccggcaucauuacaagcaacgcgcccauggacgaaugugaugcaaagugccagaccccucaaggugccaucaauucgucucugccauuccagaacgugcaccccgugacgaucggggaguguccuaaauacgucagauccgcuaaguuaaggaugguuacuggacugcggaauauuccaucaauacagagucgcggccucuuuggcgccaucgcaggguucauugaaggagguuggacaggcaugguggacgggugguauggauaccaucaccagaacgagcaaggcagcgguuacgcugccgaucagaaauccacccagaaugcgaucaacgggauaacuaauaagguaaacucugugauugaaaagaugaauacacaguuuaccgccgucggcaaagaguucaacaaacuugagcgaagaauggaaaaucugaacaagaagguggacgauggauucuuggacaucuggacguauaacgcagagcuacugguucuccuggaaaaugagaggacccuugacuuucacgauagcaacgugaaaaaucuguacgaaaaggucaaaucacaauugaagaacaaugcuaaagagaucggcaacgggugcuucgaguuuuaucauaaguguaauaacgaaugcauggagagugugaagaauggaacauacgacuaucccaaauacuccgaagagagcaagcucaaccgggagaaaauugaugguguaaagcuggacucuaugggcguuuaucagaucuuagccauuuacucaacuguggcuaguagccugguccuacucgugucccugggggccauaucuuucuggaugugcucgaauggaagccuucagugucguaucugcauuuga

SEQ ID NO: 122499 - RNA, 1701 nt, Artificial Sequence
  derived and/or modified sequence opt3 from hemagglutinin__InfluenzaA__ABB86877
augaaggccauccugcucauucuucuguacaccuucacagcuacuaacgcagacacguugugcauaggcuaucacgccaauaacagcaccgauacaguggacacugucuuagagaaaaauguuaccgugacacauuccguaaaccugcuagaagauagacacaaugggaagcucuguaaccugggagguaucgcgccccuuuaccugggcaauugcaacauugcugggugguugcucggaaauccugagugugaacugcuguuuaccgugucuucauggaguuauaucgucgagacuagcaacuccgacaauggcacaugcuacccaggugauuucauuaacuaugaagaacucagggagcaguuaucuucgaugucaagcuacgaacgguuugagaucuucccgaaagaaaguuccuggcccaaucaugagaccaaccgcggggugacggccgcauguccuuaugccggagcuaauucuuuuuaccgaaaccugauauggcuuguuaagaaaggcaacagcuacccaaagaucaauaaguccuaugugaacaauaaagagaaggaagucuuggugcuguggggcauucaccaucccccuacuucagcagaccaacagagucuauaccagaacgccgaugcuuauguaagcguugagucuuccaaauacaauaagaaauucaagccagaaaucgccacccgucccaaggugagagggcaggcgggaaggaugaacuauuacuggacacucgucgagccuggugacacuauuaccuuugaagcaacaggcaaucugguggugccacgguaugccuucgcuaugaaccgcgggucaggaagcggcaucauaauuagugauaccccgguccacgacugcaauacgacuugucaaacacccaaaggugccaucaacaccucucuuccuuuucagaauguucacccagugacuauuggggagugccccaaguacguaaaauccacaaagcugagaauggcaaccggauugaggaacaucccuagcauccagucgcggggccucuucgaggcuauugccggcuuuauagaagggggauggacggguaugaucgauggcugguacggguaucaucaccagaaugagcaaggaucuggcuacgcggccgaccgcaaauccacccagaacgcaauugaugguaucacaaauaaggugaacucagucauagagaaaaugaacacucaguucaccgcuguggggaaggaguuuaaucaucuggaaaagcgaauugagaacuuaaauaaaaagguugacgacggcuuccuggauguguggacauauaacgccgagcuccuuguccuguuggaaaaugagagaacucuagacuuccacgauaguaacgugaaaaaucuguacgaaaagguaaggagccagcuccggaacaaugcuaaagagaucggaaacggcuguuuugaguucuaucacaagugcgacgauaccuguauggaauccguucguaaugggacauacgacuaucugaaguacucugaggaaagcaaacuuaaccgcgagaagaucgaaggagugaaacuggauucagccagaauuuaccaaaucuuggcaauuuauaguaccgucgccuccagccucgugcuguuagucucucugggugcuauaucauuuuggaugugcaguaauggcagccuacagugcaggaucuguauuuga

SEQ ID NO: 122500 - RNA, 1701 nt, Artificial Sequence
  derived and/or modified sequence opt3 from hemagglutinin__InfluenzaA__ABB86887
augaaggccauccugcucauucuucuguacaccuucacagcuacuaacgcagacacguugugcauaggcuaucacgccaauaacagcaccgauacaguggacacugucuuagagaaaaauguuaccgugacacauuccguaaaccugcuagaagauagacacaaugggaagcucuguaaccugggagguaucgcgccccuuuaccugggcaauugcaacauugcugggugguugcucggaaauccugagugugaacugcuguuuaccgugucuucauggaguuauaucgucgagacuagcaacuccgacaauggcacaugcuacccaggugauuucauuaacuaugaggaacucagggagcaguuaucuucgaugucaagcuacgaacgguuugagaucuucccgaaagaaaguuccuggcccaaucaugagaccaaccgcggggugacggccgcauguccuuaugccggagcuaauucuuuuuaccgaaaccugauauggcuuguuaagaaaggcaacagcuacccaaagaucaauaaguccuaugugaacaauaaagagaaggaagucuuggugcuguggggcauucaccaucccccuacuucagcagaccaacagagucuauaccagaacgccgaugcuuauguaagcguugagucuuccaaauacaauaagaaauucaagccagaaaucgccacccgucccaaggugagagggcaggcgggaaggaugaacuauuacuggacacucgucgagccuggugacacuauuaccuuugaagcaacaggcaaucugguggugccacgguaugccuucgcuaugaaacgcgggucaggaagcggcaucauaauuagugauaccccgguccacgacugcaacacgacuugucaaacacccaagggugccaucaauaccucucuuccuuuucagaacauucacccaguuacuaucggggagugccccaaauacgugaaguccacaaaacugagaauggcaaccggauugaggaauaucccuagcauucagucgcggggccucuucggcgcuauagccggguuuaucgagggagguuggacgggcaugauugaugggugguacggauaucaucaccagaacgaacaaggcucugguuacgcggccgaccgcaaguccacccagaaugcaaucgaugggauaacaaacaaaguaaauucagugauugagaagaugaacacucaguucaccgcugucggcaaggaauuuaaccaucuggagaaacgaaucgaaaauuuaaacaagaaaguggacgacggauuccuggauguuuggacauauaaugccgagcuccuugugcuguuggagaacgaaagaacucuagacuuccacgauaguaaugucaagaaccuguacgagaaagugaggagccagcuccggaauaacgcuaaggaaaucggcaauggguguuuugaguucuaucacaagugcgacgauaccuguauggaauccguacguaacggaacauacgacuaucugaaauacucugaggagagcaaacuuaaucgcgaaaagauugaggguguuaagcuggauucagccagaaucuaccaaauuuuggcaauauauaguaccguggccuccagccucguccuguuagugucucugggcgcuaucucauuuuggaugugcaguaacgggagccuacagugcaggauuuguaucuga

SEQ ID NO: 122501 - RNA, 1698 nt, Artificial Sequence
  derived and/or modified sequence opt3 from hemagglutinin__InfluenzaA__ABB86899
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggccauuuugccgacuacgaggaacugagagagcaacucucuucgguuagcucauucgaaagguuugagaucuucccuaaggagaguuccuggccaaaucacacuauaacaggugugucugcaagcugcucccauaacgggaagcggucauuuuaucgcaauuuacuguggcuuaccggcaaaaacggauuguaccccaaucugaguaagagcuaugccaacaauaaagaaaaggagguccuaauccucuggggcgugcaccacccuccaaacauuggggaucagcgaacgcuguaccauacugaaaacgcuuacguaucuguuguguccucacacuauagccguagauucacccccgagaucacaaaaaggccuaagguccgggaccaggaaggacgcauuaauuacuauuggacucuucuggagccaggugauaccaucauauuugaggcaaacggcaauuugauugccccgugguacgcuuucgcccucaguagaggguuuggaucuggcaucauuacauccaacgcgcccauggacgaaugugaugcaaagugccagaccccucaaggugccaucaauagcucgcugccauuccagaacgugcaucccgugacgaucggggaguguccuaaauaugucaggucugcuaaguuacggaugguuacuggacugcgcaauauuccauccauacagucacgaggccucuuuggcgccaucgcaggguucauugaaggagguuggacaggcaugguggacgggugguacggauaucaccaccagaacgagcaaggcagugguuacgcugccgaucagaaaagcacccagaaugcgaucaacgggauaacuaauaagguaaacuccgugauugaaaagaugaauacacaguuuaccgccgucggcaaagaguucucuaaacuugagagaaggauggaaaaccugaauaagaagguggacgauggauucuuggacaucuggacguacaacgcagagcuacugguucuccuggaaaacgagcggacccuugacuuucaugauagcaaugugaaaaaccuguaugaaaaggucaaaggccaauugaagaauaacgcuaaagagaucgggaauggaugcuucgaguuuuaccacaaguguaacaaugaaugcauggagucagugaagaacgguacauaugacuaccccaaauauagugaagaguccaagcucaaucgugagaaaauugauggcguaaagcuggacagcauggggguuuaccagaucuuagccauuuauucuacuguggcuucaagucugauacuacucgucagccugggagccaucuccuucuggaugugcucuaacggcucgcuucagugucgcauuugcaucuga

SEQ ID NO: 122502 - RNA, 1701 nt, Artificial Sequence
  derived and/or modified sequence opt3 from hemagglutinin__InfluenzaA__ABB86907
augaaggccauccugcucgugcuucuguacaccuucacaagcacuaacgcugacacguugugcauuggcuaucacgcaaauaacuccaccgauacagucgacacuguuuuagagaaaaaugugaccguaacacauucugugaaccugcuagaagauaagcacaaugggaaacucuguagacugggagguauagcuccccuucaucugggcaagugcaacaucgcggggugguugcucggaaauccugagugugaccugcugcucaccgucucaaguuggagcuacauuguggaaacuuccaacucuuauaauggcacaugcuacccaggugauuuuaccaacuaugaggaauuaagggagcagcugucgucaguuagcaguuucgagcgguuugaaaucuucccgaaagccuccucuuggcccaaucacgagacgaaccgcggggugacugccgcauguccucaugccggaaccaauagcuuuuaccgaaaccuuauuugguuggucaagaagggcaauacauauccaaaacuguccaagucauacgugaacaacaaaggcaaggaaguucuaguacucugggggauccaccaccccaguacuagcaccgaccaacagucucuguaccagaaugcugauacauauguguucgucggaaccuccaaauacaacaagaaguuuaaaccugagauagcagugcguccaaaggugaaagaccaggccgguagaaugaauuauuacuggacgcuugucgagcccggcgauacuaucacauucgaagcuaccgggaaccugguugugccuagguaugccuuugcgaugaaucggggacauggcucagguauuaucauuagcgacacuccaguacacgauugcaacacaaccugucaaacgccgaagggggcaaucaauaccaguuugcccuuccagaacgugcauccugucacaauaggaaaaugcccaaaguacgugaaaucuacucgccucagaauggccaccggccugaggaauauucccuccauccagagccggggcuuauuuggggcuauugccggauucaucgaggguggcuggacagggaugaucgacggaugguauggcuaccaccaccagaacggucaagggucgggcuacgcagcugaucagaagucuacucagaaugccauugacggaauaaccaacaagguuaauuccgugaucgaaaagaugaacacacaguuuaccgcggucggcaaagaguucaaucaucuggaaaaacgcauugagaaccucaacaagaaaguggacgauggguuccuugacguauggacuuauaaugccgagcuguugguucuacuggaaaacgagcgaacgcucgauuuucacgacucaaaugugaagaaccuguacgaaaaggucagaaggcaacuuaaaaauaacgcaaaggagaucggaaaugguuguuucgaauuuuaucauaacugcgaugacgcuuguauggagagugugaaaaauggcacauacgauuauccuaaguacagcgaggaaucccggcugaaccgugaggaaauaaaugggauuaaauuggacucuacccgcaucuaucagauccucgccauuuacagcacugucgcuucaaguuccgugcuguuaguuagccugggagccaucucuuucuggaugugcucaaacggcagucuacagugcagaauuuguauauga

SEQ ID NO: 122503 - RNA, 1698 nt, Artificial Sequence
  derived and/or modified sequence opt3 from hemagglutinin__InfluenzaA__ABB86917
augaaggugaaacugcucauccuucugugcaccuucacagccacuuacgcugaccccauuuguauaggcuaucacgcaaacaauagcacggauaccgucgacacaguuuuggagaagaacguggccguaacucauuccgugaauuuacuggaagauucucacaacgggaaacuaugccuccugaagggaaucgcgccucuucagcuggguaauuguucagucgcuggcuggauuuuggggaacccagagugcgaacuccugaucaguaaagagagcugguccuacauuguggaaaccccgaaucccgagaacggagccuguuauccuggcuacuuugcagacuaugaggaacugagagagcaacucucuucgguuagcucauucgaaagguuugagaucuucccaaaggagaguuccuggcccaaucauacagugaccggugucucugccagcugcucccacaacgggaagucaaguuuuuaccggaauuuacuguggcuuacuggcaaaaacggauuguauccuaaucugagcaagucuuacgcuaacaauaaagaaaaggaggugcuaauacucuggggcguacaucacccacccaacaucggggaucagcgcacacuguaccacaccgaaaacgcauauguuuccguggucucaagccauuacagucgacguuucacgccugagauuacuaaaagaccaaaggugagggaccaggaaggacggaucaauuauuacuggacccuucuggagccgggugauacaauuaucuuugaggccaacggcaauuugauagcucccugguaugccuucgcgcucucucgcggguuuggauccggcauuaucacuagcaacgcaccuauggacgaaugugaugccaagugccagaccccacaaggugcuauuaauucgucucugcccuuccagaacgugcacccugucacaaucggggaguguccaaaauacguuagauccgccaaguuaaggauggugaccggacugcggaauauccccucaauucagagucgcggccucuuuggcgcaauagcuggguucaucgaaggagguuggacgggcaugguagacgggugguauggauaccaucaccagaacgagcaaggcagcgguuacgccgcggaucagaaauccacucagaaugccauuaacgggaucacaaauaaggugaacucugucauagaaaagaugaauacccaguuuacugcagugggcaaagaguucaacaaacuugagcgaagaauggaaaaucugaacaagaagguugacgauggauucuuggacauuuggacauauaacgcugagcuacuggugcuccuggaaaaugagaggacccuugacuuucacgauagcaacgucaaaaaucuguacgaaaaggugaaaucacaauugaagaacaaugccaaagagaucggcaacgggugcuucgaguuuuaucauaaguguaauaacgaaugcauggagaguguaaagaauggaacguacgacuauccgaaauacuccgaagagagcaagcucaaccgggagaaaaucgaugguguuaagcuggacucuaugggcguguaucagauuuuagcuaucuacucaaccgucgccaguagccuggugcuacucgucucccugggggcaauuucuuucuggaugugcucgaauggaagccuucagugucguauaugcaucuga

SEQ ID NO: 122504 - RNA, 1698 nt, Artificial Sequence
  derived and/or modified sequence opt3 from hemagglutinin__InfluenzaA__ABB86929
augaaggugaaacugcucauccuucuguacaccuucacagccacuuaugcugacacgauuugcauaggcuaccacgcaaacaauagcaccgauacagucgacacuguuuuggagaagaacgugaccguaacacauuccgugaauuuacuggaagauucucacaacgggaaacuaugucuccugaagggaaucgcgccccuucagcuggguaauugcucagucgccggcuggauuuuggggaacccugagugugaacuccugaucaguaaagagagcugguccuauauuguggaaaccccaaauccggagaacggagcuugcuaccccggccauuuugccgacuaugaggaacugagagagcaacucucuucgguuagcucauucgaaagguuugagaucuucccuaaggagaguuccuggccaaaucacacuauaacaggugugucugcaagcuguucccauaacgggaagcggucauuuuaccgcaauuuacuguggcuuaccggcaaaaacggauuguaucccaaucugaguaagagcuacgccaacaauaaagaaaaggagguccuaauccucuggggcgugcaccacccuccaaacauuggggaucagcgaacgcuguaccauacugaaaacgcuuauguaucuguuguguccucacacuacagccguagauucacccccgagaucacaaaaaggccuaagguccgggaccaggaaggacgcauuaauuauuacuggacucuucuggagccaggugauaccaucauauuugaggcaaacggcaauuugauugccccgugguaugcuuucgcccucaguagaggguuuggaucuggcaucauuacauccaacgcgcccauggacgaaugcgaugcaaagugucagaccccucaaggugccaucaauagcucgcugccauuccagaacgugcaucccgugacgaucggggagugcccuaaauacgucaggucugcuaaguuacggaugguuacuggacugcgcaauauuccauccauacagucacgaggccucuuuggcgccaucgcaggguucauugaaggagguuggacaggcaugguggacgggugguauggauaccaccaccagaacgagcaaggcagugguuacgcugccgaucagaaaagcacccagaaugcgaucaacgggauaacuaauaagguaaacuccgugauugaaaagaugaauacacaguuuaccgccgucggcaaagaguucucuaaacuugagagaaggauggaaaaccugaauaagaagguggacgauggauucuuggacaucuggacguauaacgcagagcuacugguucuccuggaaaacgagcggacccuugacuuucaugauagcaaugugaaaaaccuguacgaaaaggucaaaggccaauugaagaauaacgcuaaagagaucgggaauggauguuucgaguuuuaucacaagugcaacaaugaauguauggagucagugaagaacgguacauacgacuaucccaaauacagugaagaguccaagcucaaucgugagaaaauugauggcguaaagcuggacagcauggggguuuaucagaucuuagccauuuacucuacuguggcuucaagucugauacuacucgucagccugggagccaucuccuucuggaugugcucuaacggcucgcuucagugccgcauuuguaucuga

SEQ ID NO: 122505 - RNA, 1701 nt, Artificial Sequence
  derived and/or modified sequence opt3 from hemagglutinin__InfluenzaA__ABB86937
augaaggccauccugcucgugcuucuguacaccuucacaagcacuaacgcugacacguugugcauuggcuaucacgcaaauaacuccaccgauacagucgacacuguuuuagagaaaaaugugaccguaacacauucugugaaccugcuagaagauaagcacaaugggagacucuguaaacugggagguauagcgccccuucaucugggcaagugcaacaucgccgggugguugcucggaaauccugagugugaacugcuguuuaccgucucaaguuggagcuacauuguggagacuuccaacucuuauaauggcacaugcuacccaggugacuucaucaacuaugaagaacucagggagcaguuaucgucaguuagcaguuuugaacgguucgagauuuuuccgaaggcuuccucuuggcccaaucacgaaaccaaccgcggggugacggccgcauguccucaugccggaacuaauagcuucuaccgaaaccugaucuggcuugucaagaagggcaauaccuauccaaaaauauccaagucauacgugaacaacaaaggcaaggagguauugguucugugggggauccaccaccccaguacaagcaaugaucaacagucucuauaccagaacgcugacacuuauguguuugucggaccuuccaaauacaauaagaaguucaaaccagagauugcaacccgucccaaggugagagaucaggccgguaggaugaacuauuacuggacacucguggaaccuggcgacaccaucacguuugaggcuacugggaaucuggucguuccacgguaugccuucgcgaugaaccgcggaucagaaagcggcauuaucauaagugauacaccggugcaugacugcaauaccacuugucaaacacccaaaggugcaauuaacaccucucuuccuuuucagaauguacacccagugacgaucggggagugccccaaguacgucaaauccaccagacugaggauggccacaggauugcggaacauuccuagcauccagucgcgcggccucuucggcgcuaucgccggguuuauugaagagggauggacugguaugauagauggcugguauggguaccaucaccagaauggacaaggcucugguuacgcagcugaccagaaguccacccagaacgccaucgaugggauuacaaauaaagugaacucaguuaucgagaagaugaauacucaguucaccgcggugggcaaggaguucaaccaccuggagaaacgaauagaaaacuuaaauaagaaagucgacgacggauuucuggauguguggacauauaacgccgagcuccuuguacuguuggaaaaugagagaacccuagacuuccaugauaguaacguuaagaaucuguacgagaaagugaggcggcaacucaagaacaaugcaaaggaaauuggcaacggguguuuugaguucuaucacaaaugcgacgaugcuuguauggaaagcgucaagaauggaacuuacgacuauccaaaauacuccgaggaaucucgucugaaccgcgaggagaucaaugguaucaaacuugauagcacgagaauuuaucagauccuggccauuuacucaacaguggcuaguuccagcgucuugcucgugucucugggcgccauaucauuuuggaugugcaguaacgggagcuuacagugcaggaucuguauuuga

SEQ ID NO: 122506 - RNA, 1701 nt, Artificial Sequence
  derived and/or modified sequence opt3 from hemagglutinin__InfluenzaA__ABB86946
augaaggccauccugcucgugcuucuguacaccuucacagcugcaaacgccgacacuuugugcauuggcuaucacgcgaauaacagcacggauaccgucgacacaguuuuagagaaaaaugugacuguaacccauuccgugaaccugcuagaagauagacacaaugggaagcucuguaaacugaggggaauagcuccccuucaucuggguaagugcaacaucgccggcugguugcucgggaauccugagugugaaucucugucaacagucaguagcugguccuacauuguggagaccucuaacucggacaauggaacuugcuauccaggcgauuuuaucaacuacgaagaacugcgggagcagcucucaagcguuaguuccuucgaacgcuuugagauuuucccgaaagcaucuagcuggcccaaucacgaaacaaaccgagguaccacggccgcuuguccuuaugcaggggccaauuccuuuuaccguaacuuaaucuggcuggugaagaagggaaauucauauccaaaacuuaacaagaguuacgucaacaauaaaggcaaggagguguugguacuguggggcauacaucaccccagcacuucuaacgagcaacagucccuauaccagaaugcugacaccuauguuuucguggggucaagcaaauacaacaagaaguuuaaaccugaaaucgccacaagaccaaaggucagggaucaggcgggacggaugaauuauuacuggacucucauugagcccggugacaccaucacauucgaagcaaccggcaaccugguggugccucgcuaugccuuugcuaugaauagagggaguggaucuggcauuaucauauccgauacgccaguccacgacugcaacacuacaugucaaaccccgaaaggugccauuaauacuagccuucccuuccagaacguucauccugugacaaucggggagugcccaaaguacguaaaaucgaccaagcugaggauggcaacgggauugcggaauauucccucuauccagucccgcggccucuuuggcgcuaucgccggguucauugaaggagguuggaccggcaugauagaugggugguauggauaccaccaucagaacgagcaaggcucagguuacgcggccgaccagaaaaguacacagaaugcaaucgaugggauuacuaacaaggugaauagcgucaucgagaagaugaacacccaguuuacagcugugggcaaagaguucaaccaccuggagaagcgaauagaaaauuuaaacaaaaagguugacgacggauuccuggauguguggacuuauaaugccgagcuccuuguccuguuggaaaacgagagaacccuagacuuucacgauuccaaugugaaaaaccuguacgagaagguaaggucucaacucaagaauaacgcuaaagaaauuggcaauggguguuucgaguuuuaucauaagugcgacgaugccuguauggaaagcguuaaaaacggaacauacgacuauccuaaguacucagaggaaagucggcugaaucgugaggagaucgaugguaucaaacuugacuccacccgcauuuaucagauccuggcaauuuacagcacuguggccucuucaagugucuugcucgugagccugggcgcuauauccuucuggaugugcucuaacgggucguuacagugcagaaucuguauuuga

SEQ ID NO: 122507 - RNA, 1701 nt, Artificial Sequence
  derived and/or modified sequence opt3 from hemagglutinin__InfluenzaA__ABB96319
augaagaccaucauugcccugagcuacauauucugccagguguuugcucaaaaccuccccggcaaugacaacuccacagcaacucuuugucuggggcaccaugccgucccuaauggaacguugguuaaaaccaucacaaacgaucagauugaggugacuaaugcgaccgaauuaguacagucuucaaguacagguagaaucugcgacaacccacacaggauucuggauggcaagaauuguacccuaaucgacgcucuccugggggauccgcauugcgacggauuccagaacgagaaaugggaucuuuuuguggaacggagcaaggccuucuccaauuguuaucccuacgacgucccugauuaugcaucucugcgcucguugguggccucaagcggcacucucgaguuuuucaacgaagguuuuaauuggacagggguuacccaaaacggaggcaguuacgcuugcaaacgaggcccagacaauuccuucuuuucucgucugaacuggcuguauaagagcgaguccacguaccccgugcucaaugucacuaugccuaacaacgauaauuucgacaaguuauauauauggggagugcaccauccaucaaccgauaaagagcagacaaaccuguacguacaggcaagugggagaguuacugugagcaccaagaggucucagcaaacaaucauucccaaugucgguccucggccaugggugcgcggccuuuccucaagaaucagcauuuacuggaccaucgugaaaccgggggacgucuugcugauaaacaguaauggaaaccuaauugcccccaggggcuauuuuaagauccggacggguaaaucuuccauuaugcgcagcgacgcuccuaucgggacuuguucgucugaaugcaucacaccaaauggauccauucccaacgauaagccuuuccagaauguuaacaagauaaccuacggcgccuguccaaaauaugugaagcagaauacucucaaacuggcgacaggcaugcgaaacguacccgagaagcagaccagagggaucuuuggagcaauugccgguuucaucgaaaauggcugggaggggaugauagacggaugguacggcuucaggcaccaaaacucagaggguacggggcaggcugccgaucuuaaaaguacccaggcagcuauugaccaaaucaauggcaagcugaaccgggugaucgagaaaacaaacgaaaaguuucaccagauugaaaaggaguucagcgaagucgagggacguauccaggauuuggagaaauauguggaagacacuaagauugaucucugguccuacaaugccgagcuguuaguugcgcuggaaaaccagcauaccauagaccucacagauucugagaugaauaaacuuuuugaaaagacucgcagacaacugagggagaacgccgaggacaugggcaaugggugcuucaaaaucuaucacaagugugauaacgcaugcauuggaagcauccggaaugguaccuacgaccaugacguguaccgagaugaggcuuugaacaaucgcuuucagaucaagggcgucgaacuaaaaucaggguauaaggacuggauucuguggauaaguuucgccaucuccugcuuucuccugugugugguacuucugggauucauuaugugggcuugccagaaaggcaacaucagauguaauauuugcaucuga

SEQ ID NO: 122508 - RNA, 1701 nt, Artificial Sequence
  derived and/or modified sequence opt3 from hemagglutinin__InfluenzaA__ABB96330
augaagaccaucauugcccugagcuacauauucugccagguguuugcucaaaaccuccccggcaaugacaacuccacagcaacucuuugucuggggcaccaugccgucccuaauggaacguugguuaaaaccaucacaaacgaucagauugaggugacuaaugcgaccgaauuaguacagucuucaaguacagguagaaucugcgacaacccacacaggauucuggauggcaagaauuguacccuaaucgacgcucuccugggggauccgcauugcgacggauuccagaacgagaaaugggaucuuuuuguggaacggagcaaggccuucuccaauuguuaucccuacgacgucccugauuaugcaucucugcgcucguugguggccucaagcggcacucucgaguuuuucaacgaagguuuuaauuggacagggguuacccaaaacggaggcaguuacgcuugcaaacgaggcccagacaauuccuucuuuucucgucugaacuggcuguauaagagcgaguccacguaccccgugcucaaugucacuaugccuaacaacgauaauuucgacaaguuauauauauggggagugcaccauccaucaaccgauaaagagcagacaaaccuguacguacaggcaagugggagaguuacugugagcaccaagaggucucagcaaacaaucauucccaaugucgguucccggccuugggugcgcggccuuucaagcagaaucaguauuuacuggaccaucgugaaaccaggggacgucuugcugauaaacucuaauggaaaccuaauugccccgaggggcuauuuuaagauccggacggguaaauccagcauuaugcgcucggacgcucccaucgggacuuguucuuccgaaugcaucacaccuaauggaucaauuccaaacgaucgacccuuccagaauguuaacaagauaaccuacggcgccuguccuaaguaugugaaacagaauacucucaagcuggcgacaggcaugagaaacguaccagagaaacagaccagggggaucuuuggagcaauugccgguuucaucgaaaauggcugggaggggaugguggacggaugguacggcuuccggcaccaaaacagugaggguacggggcaggcugccgaucuuaagagcacccaggcagcuauagaccaaauuaauggcaaacugaaccgugucaucgaaaagacaaacgagaaauuucaccagaucgaaaaggaguucuccgaaguggagggacgcauucagaauuuggagaaguauguugaagauacuaaaaucgaccucuggucuuacaacgccgagcuguuaguggcgcuggaaaaucagcauaccauugaucucacagacagcgagaugaacaaacuuuuugaaaagacuagaaggcaacugcgggagaaugccgaggauaugggcaacgggugcuucaagauauaucacaaaugugacaaugcaugcaucggaucaauucgaaacgguaccuacgaucaugacgucuaccgcgacgaggcuuugaauaacagauuucagaucaagggcguggaacuaaagaguggguauaaagauuggauccuguggauuuccuucgccauaagcugcuuucuccuguguguaguucuucugggauucaucaugugggcuugccagaagggcaauauuagguguaacaucugcauuuga

SEQ ID NO: 122509 - RNA, 1701 nt, Artificial Sequence
  derived and/or modified sequence opt3 from hemagglutinin__InfluenzaA__ABB96341
augaagaccaucauugcccugagcuacauauucugccagguguuugcucaaaaccuccccggcaaugacaacuccacagcaacucuuugucuggggcaccaugccgucccuaauggaacguugguuaaaaccaucacaaacgaucagauugaggugacuaaugcgaccgaauuaguacagucuucaaguacagguagaaucugcgacaacccacacaggauucuggauggcaagaauuguacccuaaucgacgcucuccugggggauccgcauugcgacggauuccagaacgagaaaugggaucuuuuuguggaacggagcaaggccuucuccaauuguuaucccuacgacgucccugauuaugcaucucugcgcucguugguggccucaagcggcacucucgaguuuuucaacgaagguuuuaauuggacagggguuacccaaaacggaggcaguuacgcuugcaaaaagggcccagacaauuccuucuuuucucgacugaacuggcuguauaagagcgaguccacguaccccgugcucaaugucacuaugccuaacaacgauaauuucgacaaauuauauauauggggagugcaccauccaucaaccgauaaggagcagacaaaccuguacguacaggcaagugggcguguuacugugagcaccaaaagaucucagcaaacaaucauucccaaugucgguuccaggccuugggugcggggccuuucaagccgcaucaguauuuacuggaccaucgugaagccaggggacgucuugcugauaaacucuaauggaaaccuaauugccccgagaggcuauuuuaaaaucaggacggguaaguccagcauuaugcggucggacgcucccaucgggacuuguucuuccgaaugcaucacaccuaauggaucaauuccaaacgauaagcccuuccagaauguuaacaaaauaaccuacggcgccuguccuaaguaugugaaacagaauacucucaagcuggcgacaggcaugcgcaacguaccagagaaacagacccgagggaucuuuggagcaauugccgguuucaucgaaaauggcugggaggggaugauagacggaugguacggcuucagacaccaaaacagugaggguacggggcaggcugccgaucuuaagagcacccaggcagcuauugaccaaaucaauggcaaacugaacagggugaucgaaaagacaaacgagaaguuucaccagauugaaaaagaguucuccgaagucgagggacggauccaggauuuggagaaguauguggaagacacuaaaauugaucucuggucuuacaaugccgagcuguuaguugcgcuggaaaaccagcauaccauagaccucacagauagcgagaugaauaaacuuuuugaaaagacucgucgccaacugagagagaacgccgaggacaugggcaaugggugcuucaagaucuaucacaagugugauaacgcaugcauuggaucaaucaggaaugguaccuacgaccaugacguguaccgggaugaggcuuugaacaaucgauuucagaucaaaggcgucgaacuaaagaguggguauaaagacuggauucuguggauauccuucgccaucagcugcuuucuccugugugugguacuucugggauucauuaugugggcuugccagaagggcaacauccgcuguaauauuugcaucuga

SEQ ID NO: 122510 - RNA, 1701 nt, Artificial Sequence
  derived and/or modified sequence opt3 from hemagglutinin__InfluenzaA__ABB96395
augaagaccaucauugcccugagcuacauauucugccagguguuugcucaaaaccuccccggcaaugacaacuccacagcaacucuuugucuggggcaccaugccgucccuaauggaacguugguuaaaaccaucacaaacgaucagauugaggugacuaaugcgaccgaauuaguacagucuucaaguacagguagaaucugcgacagcccacacaggauucuggauggcaagaacuguacccuaauggacgcucuccugggggauccgcauugcgacggauuccagaaugagaaaugggaucuuuuuguggaacgguccaaggccuucucuaacuguuaucccuacgacgucccugauuaugcaucgcugcgcucauugguggccagcaguggcacucucgaguuuaucaaugaagguuucaacuggacagggguuacccaaaauggaggcuccuacgcuugcaaacgaggcccagacaacagcuuuuucucucgucugaauuggcuguauaaguccgagucaacguaccccgugcucaacgucacuaugccuaauaacgauaacuuugacaaguuauauauauggggagugcaccauccaaguaccgauaaagagcagacaaaucuguacguacaggcaagcgggagaguuacugugucuaccaagaggucccagcaaacaaucauucccaacgucgguucacggccuugggugcgcggccuuagcaguagaaucucuauuuacuggaccaucgugaaaccaggggacauauugcugauuaauuccaacggaaaucuaaucgccccgaggggcuauuucaagauucggacggguaaaagcucgaucaugcgcucugacgcucccaucgggacuuguuccucagaaugcauuacaccuaacggaaguauaccaaaugauaagcccuuucagaacgucaauaagaucaccuacggcgccuguccuaaauauguuaagcagaacacucucaaacuggcgacaggcaugcgaaaugugccagagaagcagaccagagggauuuucggagcaaucgccgguuuuauagaaaacggcugggaggggaugauugacggaugguacggcuucaggcaccaaaauagcgaggguacggggcaggcugccgaucuuaaauccacccaggcagcuaucgaccaaaucaacggcaagcugaaucggguaauugaacguacaaacgagaaauuccaccagaucgaaaaggaguuuucugaaguggagggacgcauucaggauuuggagaaguaugucgaagacacuaaaauagaucucuggagcuacaacgccgagcuguuaguggcgcuggaaaaucagcauaccaucgaccucacagauucagagaugaacaaacuuuucgaaaagacuagaaggcaacugcgggagaaugccgaggacaugggcaacgggugcuuuaagauuuaucacaaaugugauaaugcaugcaucggaaguauccgaaacgguaccuacgaccaugacguuuaccgcgaugaggcuuugaauaacagauuccagauuaagggcguggaacuaaaguccggguauaaagacuggauacuguggaucagcuuugccauuucuugcuuccuccugugugucgugcuucugggauuuaucaugugggcuugccagaagggcaauauuagguguaacaucugcauauga

SEQ ID NO: 122511 - RNA, 1698 nt, Artificial Sequence
  derived and/or modified sequence opt3 from hemagglutinin__InfluenzaA__ABB96487
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuucaucuuucgaaagguuugagaucuucccuaagaagaguuccuggccaaaucauacugugacaggugucucugcaagcugcucccacgaugggaaaucaaguuuuuaccggaacuuacuguggcuuaccggaaagaauggcuuguaucccaaccugagcaaaucuuacgccaauaacaaggagaaagaagugcuaauacucuggggcguacaucacccuccaaauaucggggaccagcgcacgcuguaccacacugagaacgcuuauguuuccguggucucaagccauuacagucgacguuucacccccgaaauuacaaagagaccuaaggugagggaucaggagggacggaucaacuauuacuggacucuucuggaaccaggugacaccauuaucuuugaggcaaauggcaacuugauagccccgugguaugcuuucgcccucucucgcggguuuggauccggcauuaucacaagcaaugcgcccauggaugagugugacgcaaaaugccagaccccucaaggugccauuaacucgucucugccauuccagaaugugcaccccgucacgaucggggaauguccuaaguacguuagauccgcuaaauuaaggauggugacuggacugcggaacaucccaucaauucagagucgcggccucuuuggcgccauagcaggguucaucgagggagguuggacaggcaugguagaugggugguauggauaccaucaccagaaugaacaaggcagcgguuacgcugccgaccagaaguccacccagaacgcgauuaaugggaucacuaacaaagugaauagcgucauagagaagaugaacacacaguuuaccgccgugggcaaagaguucaauaaacuugaacgaagaauggagaaccugaauaagaaaguugaugacggauucuuggacauuuggacguauaacgcagaacuacuggugcuccuggagaacgaaaggacccuugauuuucacgacagcaaugucaagaaccuguacgagaaagugaagucacaauugaaaaauaacgcuaaggaaaucggcaaugggugcuucgaguuuuaucauaaguguaacaaugagugcauggaaaguguaaagaacggaacauacgauuaucccaaguacuccgaggaaagcaaacucaaucgggagaagaucgacgguguuaaacuggauucuaugggcguguaucagauuuuagccaucuacucaacugucgcuaguagccuggugcuacucgucucccugggggccauuucuuucuggaugugcucgaacggaagccuucagugucguauaugcaucuga

SEQ ID NO: 122512 - RNA, 1701 nt, Artificial Sequence
  derived and/or modified sequence opt3 from hemagglutinin__InfluenzaA__ABB96520
augaagaccaucauugcccugagcuacauauucugccucgcucuuggccaggaccugcccgggaacggaaauuccacagcaacuuuguguuuaggucaccaugccgugccuaacggcacgcuggucaaaaccaucacagaugaccaaauugagguuacuaaugcgaccgagcuagugcagucuucaaguacagggaagaucugcaacaauccacacaggauucucgauggaaucgacuguacccugauagaugcucugcugggcgacccgcauugcgauguauuucagaacgaaacuugggacuuguucguggaaagaagcaaagccuuuuccaauuguuaucccuacgaugucccugacuaugcaucucuccggucgcugguggccucaagcgguacacuggaguucaucaccgaaggguuuacguggacuggaguuacccagaacggcggcaguaaugcuugcaagcgcgggccaggauccgguuucuuuucucgacucaacugguuaacaaaaagcggcuccacuuaccccgugcugaaugucaccaugccuaacaaugauaacuucgacaaacuuuauauuuggggagugcaccauccaucaacagaucaagagcagaccaguuuguacguacaggcaagcgggcguguuacggugucuacuagaaggucccagcaaacaaucauucccaauaucggcucacggccuuggguccgcggucugagcaguagaauaucuauuuauuggaccaucgugaagccaggggacgugcuagucauuaacuccaacggaaaucucaucgccccgaggggcuacuuuaagaugcggacuggcaagagcucgaucaugcgcucugacgcucccauugauacauguauauccgagugcaucaccccuaacgggucaauuccaaaugacaaacccuuccagaacguuaauaagaucacguacggagccuguccuaaauaugugaagcagaagacccugaaacuugcgacagguaugcgaaacauaccagaaaagaaaacuagaggcauuuuuggggcaaucgccggauucaucgagaauggcugggaagguaugauugaugggugguacggcuuuaggcaccagaacagugagggaaccggccaagcugccgaccuuaagagcacacaggcagcuaucgaucagauuaaugggaaauugaaccggguaauagagaagacuaaugaaaaauuccaccaaaucgagaaggaguucuccgaaguggaaggacguauucaggaccucgagaaguaugucgaggauaccaaaaucgaccuguggucuuacaacgccgaauuacugguggcgcucgagaaucagcauacaaucgaucuuaccgacagcgaaaugaacaagcuguuugagaaaacucgcagacaguugagggaaaaugccgaggauauggguaacggcugcuucaagauuuaucacaaaugugacaacgcaugcauagagucaauccggaaugggacguacgaccaugauguuuaucgagacgaagcucuaaacaaucgcuuucaaauuaagggaguggagcugaagaguggcuacaaagauuggauccucuggauuuccuucgccaucagcugcuuucugcuuugugucgugcuguuggguuucauaaugugggcuugccagagagggaacaucagguguaauauuugcaucuga

SEQ ID NO: 122513 - RNA, 1701 nt, Artificial Sequence
  derived and/or modified sequence opt3 from hemagglutinin__InfluenzaA__ABB96531
augaagaccaucauugcccugagcuacauacucugccuuguguccgcucagaaaauccccggcaacgacucuucaacagcaacucuguguuuggggcaccaugccgucccuaauggaacguuaguuaagaccauuacaaacgaucaaaucgaggugacuaaugcgaccgaacugguacagaguagcuccacagguagaauuugcgacucuccacacaggauccuagauggcgagaacuguacccucauagacgcucugcuuggggauccgcauugcgacggauuccagaauaaagaaugggaucuguuuguggagcggucgaaggccuauucaaacuguuaccccuaugacgucccugauuacgcaagccuucgcagucucguggccuccucuggcacucuggaauuuaauaacgagagcuucaauuggacagguguugcucagaacgggaccuccuaugcaugcaaacgacguucaaucaagaguuucuuuagcagacugaauuggcuccaccaauuaaaguacaaauauccagcccugaacgugacgaugcccaauaacgacaaguucgauaaacuuuacauuuggggaguccaucacccuucuacugacuccgaucagaccucauuguacgcucaggccagcggcagggugacaguaaguacuaagcggucucagcaaaccguuaucccaaauauuggcucccgccccugggugagaggggucagcucgaggaucucuauauauuggacaauugugaaaccuggagacauccugcuaauuaacuccaccgguaaccucaucgcgccacggggcuacuuuaagauccgcucagggaagaguagcauuaugcgauccgacgcaccgauaggaaaauguaauucugagugcaucacgcccaacggcagcauuccuaaugauaagccauuccagaacgugaauagaaucacuuauggugccugucccagguacgucaaacagaacacacugaaguuggcuaccgggaugcggaauguuccugaaaaacagacucguggaauauuuggcgccauugcaggcuucaucgagaacgggugggaaggaaugguggacgguugguauggcuuucgccaccaaaauucagaggggacaggacaggcugccgaucugaagaguacccaggcggccaucaaccaaauuaauggcaaauugaacagacucaucgagaagacgaaugaaaaguuccaucagauugagaaagaauuuuccgagguagaagguaggauacaggaccuggagaaguacguggaggauaccaaaaucgacuuauggagcuauaacgcagaacugcucgucgcucuugagaaucagcacacaauugaucugacugacucugaaaugaacaaguuguucgagcggacccgaaaacaacuacgcgaaaacgccgaggauauggggaauggcugcuucaagaucuaccauaagugugacaacgcuugcaucggaucaauuagaaauggcacauacgaucacgacguguauagggacgaggcccugaacaaucgguuucagauaaaagggguugaacucaagaguggauacaaagauuggauccuguggauuagcuucgcaaucuccugcuuucuucuguguguggucuugcucgguuucauuaugugggccugccagaagggcaacauccgcuguaauauaugcaucuga

SEQ ID NO: 122514 - RNA, 1701 nt, Artificial Sequence
  derived and/or modified sequence opt3 from hemagglutinin__InfluenzaA__ABC02234
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacacaggauucucgauggcgagaauuguacccugaucgacgcccuucugggggauccgcauugcgacggauuucagaacaaagaaugggauuuguucguggagcgguccaaggcuuauucuaauuguuaccccuaugacgucccugauuacgcaucgcuccgcucacugguggccagcaguggcacucuggaauuuaacaaugaguccuucaacuggacagguguugcucagaaugggaccucuuaugcaugcaaacgacguagcauaaaguccuuuuucucaagacucaacugguuacaccaacugaaguacaaauauccagcccuuaaugugacgaugcccaacaaugacaaguuugauaaauuguacaucuggggaguccaucacccuaguacugacagcgaucagaccucucuguacgcucaggccuccggcagggugacaguaucaacuaagauuagccagcaaaccguuaucccaaacauuggcagucggcccugggugcgcggggucucuuccagaaucagcauauauuggacaauugugaaaccuggagacauccuacucauuaacucgaccgguaaucugaucgcgccaaggggcuacuucaagauccggucugggaaguccucaauuaugcgcagugacgcaccgauaggaaaauguaacagcgagugcaucacgcccaauggcuccauuccuaacgauaagccauuucagaaugugaaccgaaucacuuauggugccugucccagauacgucaaacagaauacacuuaagcuggcuaccgggaugaggaacguuccugaaaaacagacucggggaauauucggcgccauugcaggcuuuaucgagaaugggugggaaggaaugguggacgguugguauggcuuccgucaccaaaacucugaggggacaggacaggcugccgaucuaaagagcacccaggcggccaucaaucaaauuaacggcaaacucaaucgccugaucgagaagacgaacgaaaaguuucaucagauugagaaagaguucucagaaguagaagguagaauacaggacuuagagaaguacguggaggauaccaaaaucgaccuguggaguuauaaugcagaacuccuugucgcucuggagaaccagcacacaauugauuugacugacuccgaaaugaacaagcuauucgagaggacccggaaacaacugcgagaaaaugccgaggauauggggaacggcugcuuuaagaucuaccauaagugugacaaugcuugcaucggaagcauucgcaacggcacauacgaucacgacguguauagagacgaggcccucaauaacagguuccagauaaaagggguugaacugaagucuggauacaaagauuggauccuuuggauuucauuugcaaugaguugcuuccuguuuuguguggucuugcucgguuucaucaugugggccugccagaagggcaauauucgguguaacaucugcauauga

SEQ ID NO: 122515 - RNA, 1701 nt, Artificial Sequence
  derived and/or modified sequence opt3 from hemagglutinin__InfluenzaA__ABC02255
augaagaccaucauugcccugagcuacauauucugccucgugcuugcucaggaccugcccggcaacgauaauuccacagcaacuuuguguuuagggcaccaugccgucccuaacggaacgcugguuaaaaccaucacaaaugaccaaauugaggugacuaacgcgaccgaacugguacagucuucaaguacagguaagaucugcaauaacccacacaggauucucgauggcaucaauuguacccugauagacgcccuucugggggauccgcauugcgacggauuucagaacgagaaaugggauuuguucguggaaagaagcaaggcuuuuuccaauuguuaucccuacgacgucccugauuaugcaucucuccggucgcugguggccucaagcggcacucuggaguucaucaacgaagguuuuaauuggacagggguuacccagaacggaggcaguaaugcuugcaaacgcggcccagacuccggguucuuuucucgacucaacugguuauacaagagcggauccacguaucccgugcugaaugucacuaugccuaacaacgauaauuucgacaaacuuuacauuuggggugugcaccauccaucaaccgaucaagagcagacaaacuuguauguacaggcaaguggccguguuacugugagcaccaagagaucucagcaaacaaucauucccaaugucggguccaggccuugggugcggggacugucaagccgcaucaguauauacuggaccauugugaagccaggcgacauccuagucauuaacucuaaugguaaccucaucgccccgagagggcacuuuaaaaugaggacgggaaaguccagcaucaugcggucggacgcucccauuggcacuuguucuuccgagugcauaacaccuaauggcucaaucccaaacgauaaacccuuccagaauguuaacaagauuaccuacggggccuguccuaaguaugugaaacagaauacucugaaacuugcgacaggaaugcgcaacguaccagaaaagcagacccgagguaucuuuggcgcaauagccggguucauugagaauggaugggaaggcaugaucgacgguugguacggguuuagacaccaaaacagugagggcacgggacaggcugccgaucuaaagagcacccaggcagcuaucgaccaaauuaauggcaaauugaacagggugaucgagaagacaaacgaaaaauuccaucagauugagaaggaguucuccgaagucgaagggcggauacaggaucucgagaaguauguggaggacacuaaaaucgaucuguggucuuacaaugccgaauuacugguugcgcucgagaaccagcacaccauugaccuuacagauagcgaaaugaauaagcuguuugagaaaacucgucgccaauugagagaaaacgccgaggacaugggaaaugguugcuucaagaucuaucauaaaugugauaacgcaugcaucggcucaauuaggaaugggaccuacgaccacgacguguaucgggaugaggcucuaaacaaucgauuucagauaaagggagucgaacugaagaguggcuacaaagacuggauccucuggauuuccuucgccaucagcugcuuucugcuuugugugguacuguuggguuucauuaugugggcuugccagaaggggaacauccgcuguaauauaugcaucuga

SEQ ID NO: 122516 - RNA, 1701 nt, Artificial Sequence
  derived and/or modified sequence opt3 from hemagglutinin__InfluenzaA__ABC02266
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacaggauucuagacggcaucaacuguacccucauagaugcucugcuuggggacccgcauugcgauggauuccagaaugagaaaugggaccuguuuguggaaagaagcaaggccuucuccaacuguuaucccuacgaugucccugacuaugcaucuuugcggucgcucguggccucaagcggcacucuggaguuuaucaaugaagguuucaacuggacagggguuacccagaauggaggcagucgcgcuugcaaacgaggcccagauaacggguuuuucucccgucugaauuggcucuacaagucuggaagcacguaucccgugcaaaacgucacuaugccuaauaacgacaacuccgauaaguuauacauuuggggugugcaccauccaucaaccgacaaagagcagacagaccuguauguacaggcaaguggcaagguuacugugagcaccaaaagaucucagcaaacagucauccccaaugugggguccaggccuugggugcggggacuuucaagccgcgucaguauuuacuggaccaucguuaagccaggcgauauauuggugauuaacucuaaugguaaccugaucgccccgagaggguacuuuaaaaugaggacgggaaaguccagcauuaugcggucggacgcucccaucggcacuuguucuuccgagugcaucacaccuaauggcucaauuccaaacgauaagcccuuccagaauguaaacaaaauaaccuauggggccuguccuaaguacgugaaacagaauacucuaaagcucgcgacaggaaugcgcaacgucccagaaaaacagacccgagguaucuuuggcgcaauugccggguucaucgagaauggaugggaaggcaugauagacgguugguauggguuuagacaccaaaacagugagggcacgggacaggcugccgaucuuaagagcacccaggcagcuauugaccaaaucaauggcaaacugaacagggugaucgagaagacaaaugaaaaguuccaccagauugagaaagaguucuccgaaguugaagggcggauccaggaucuggagaaguacguggaggacacuaaaauugauuuguggucuuauaacgccgaacuccuggucgcguuagagaaccagcauaccauagaccugacagauagcgaaaugaauaagcucuuugagaaaacucgucgccaacuuagagaaaacgccgaggacaugggaaaugguugcuucaagaucuaccacaagugugacaacgcaugcauuggcucaaucaggaaugggaccuaugaucaugacguguaccgggaugaggcucugaacaaucgauuucagaucaaaggaguagaauugaagaguggcuacaaagacuggauucuauggauauccuucgccaucagcugcuuucugcucuguguugugcugcuugguuucauuaugugggcuugccagaaggggaacauccgcuguaauauuugcaucuga

SEQ ID NO: 122517 - RNA, 1701 nt, Artificial Sequence
  derived and/or modified sequence opt3 from hemagglutinin__InfluenzaA__ABC02288
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguagaauuugcgacagcccacacaggauccuagauggcgagaauuguacccucauagacgcucugcuuggggauccgcauugcgacggauuucagaacaaagaaugggaucuguucguggagcgguccaaggccuauucuaauuguuaccccuaugacgucccugauuacgcaucguugcgcucacucguggccagcaguggcacucuggaauuuaacaaugaguccuucaacuggacagguguugcucagaaugggaccucuuaugcaugcaaacgacguagcaucaaguccuuuuucucaagacugaacuggcuccaccaauuaaaguacaaauauccagcccugaaugugacgaugcccaacaaugacaaguuugauaaacuuuacauuuggggaguccaucacccuaguacugacagcgaucagaccucuuuguacgcucaggccuccggcagggugacaguaucaacuaagcggagccagcaaaccguuaucccaaacauuggcagucgccccugggugagaggggucucuuccaggaucagcauauauuggacaauugugaaaccuggagacauccugcuaauuaacucgaccgguaaucucaucgcgccacggggcuacuucaagauccgcucugggaaguccucaauuaugcgaagugacgcaccgauaggaaaauguaacagcgagugcaucacgcccaauggcuccauuccuaacgauaagccauuucagaaugugaacagaaucacuuauggugccugucccagguacgucaaacagaauacacugaagcuggcuaccgggaugcggaacguuccugaaaaacagacucguggaauauucggcgccauugcaggcuuuaucgagaaugggugggaaggaaugguggacgguugguauggcuuccgccaccaaaacucugaggggacaggacaggcugccgaucuuaagagcacccaggcggccaucaaucaaauuaacggcaaauugaauagacucaucgagaagacgaacgaaaaguuucaucagauugagaaagaguucucagaaguagaagguaggauacaggaccuggagaaguacguggaggauaccaaaaucgacuuauggaguuauaaugcagaacugcucgucgcucuugagaaccagcacacaauugaucugacugacuccgaaaugaacaaguuguucgagcggacccgaaaacaacuacgcgaaaaugccgaggauauggggaacggcugcuuuaagaucuaccauaagugugacaaugcuugcaucggaagcauuagaaacggcacauacgaucacgacguguauagggacgaggcccugaauaaccgguuccagauaaaagggguugaacucaagucuggacacaaagauuggauccuguggauuucauuugcaaucaguugcuuccuucuguguguggucuugcucgguuuuauuaugugggccugccagaagggcaauauccgcuguaacauaugcaucuga

SEQ ID NO: 122518 - RNA, 1701 nt, Artificial Sequence; identical to SEQ ID NO: 122486
  derived and/or modified sequence opt3 from hemagglutinin__InfluenzaA__ABC02299

SEQ ID NO: 122519 - RNA, 1701 nt, Artificial Sequence; identical to SEQ ID NO: 122510
  derived and/or modified sequence opt3 from hemagglutinin__InfluenzaA__ABC02310

SEQ ID NO: 122520 - RNA, 1701 nt, Artificial Sequence; identical to SEQ ID NO: 122515
  derived and/or modified sequence opt3 from hemagglutinin__InfluenzaA__ABC02321

SEQ ID NO: 122521 - RNA, 1701 nt, Artificial Sequence; identical to SEQ ID NO: 122321
  derived and/or modified sequence opt3 from hemagglutinin__InfluenzaA__ABC02332

SEQ ID NO: 122522 - RNA, 1701 nt, Artificial Sequence
  derived and/or modified sequence opt3 from hemagglutinin__InfluenzaA__ABC39805
augaagaccaucauugcccugagcuacauacucugccuuguguucgcucagaaccugcccggcaaugacaacuccacagcaacuuuguguuuagggcaccaugccgucccuaauggaacgcugguuaaaaccaucacaaacgaucaaauugaggugacuaaugcgaccgaauugguacagucuucaagugcugguagaaucugcgacagcccacacaggauucucgauggcaagaacuguacacugaucgacgcccuucugggggauccgcauugcgacggauuucagaaugagaaaugggauuuguucguggaacgguccaaggcauuuucuaacuguuaucccuacgacguccaggauuaugccucgcuccgcucacugguggcuagcaguggcacccuggaguucauaaaugaagguuuuaacuggacugggguuacacaauccggaggcucuuacgcaugcaaacgaggcagcggaaauuccuucuuuucacgucucaacugguuauauaagagugagagcaaguacccugcccugaaugugaccaugccaaacaaugggaacuucgacaaacuuuauaucugggguguccaccaucccucuacggauaaggagcagacuaacuuguacgugagagcuuccggcaggguaaccguuucaacaaaacggagccagcagacugugauuccuaauaucgggccacgccccugggucagaggacugaguucuaggauuuccaucuacuggaccauagugaagccuggcgacauucuacucaucaacagcucggguaaucugauugccccacggggguauuuuaaaauccgcacaggaaagucuuccaucaugcgaucagaugcgccgauuggcaccuguaguagcgaaugcauaacgcccaacggcuccaucccuaaugacaagccauuccaaaacgugaauaaaauuacuuacggggcaugucccaaguaugucaaacagaacacacuuaagcuggccaccggaaugagaaauaucccugagaaacagacuagggguauauuuggcgcuauugccggguucaucgaaaacggaugggagggcaugguugacgguugguacggguuucggcaccaaaauucugagggcacaggacaggcagcugaucuaaagagcacccaggccgcgaucgaccagauuaacggcaaacucaaucgugugaucgaaaagacgaacgagaaguuccaccaaauugaaaaagaguucucagaaguagaggggcgcauacaggaucuggagaaguauguggaagacaccaaaaucgauuuauggaguuacaaugccgagcugcucgucgcacuugaaaaccagcauacaauugaccugacugauuccgagaugaacaaguuguuugagaaaaccagaaggcagcuacgggaaaaugcugaggacaugggaaacgguugcuucaagaucuaucacaagugugauaaugccugcaucggcagcauucgaaacgggacauacgaccaugauguguaccgcgacgaagcucugaauaacagauuucaaauaaaaggaguugagcucaagucuggcuauaaagacuggauccuguggauuucauucgccaucaguugcuuucuucuguguguggucuugcucgguuucauuaugugggcaugccagaaggggaauaucagguguaacauaugcaucuga

SEQ ID NO: 122523 - RNA, 1698 nt, Artificial Sequence
  derived and/or modified sequence opt3 from hemagglutinin__InfluenzaA__ABC40522
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuacaaaaauuuacuguggcuuaccggaaagaacggcuuguaucccaaucugagcaaaucuuacgccaacaauaaggaaaaagaggugcuaauacucuggggcguacaucacccuccaaacaucggggaucagcggacgcuguaccacacugaaaacgcuuauguuuccguggucucaagccauuacagucgccgauucacccccgagauuacaaagcguccuaaggugagagaccaggaaggaaggaucaauuauuacuggacucuucuggagccaggugauaccauuaucuuugaggcaaacggcaauuugauagccccgugguaugcuuucgcccucucucggggguuuggauccggcauuaucacaagcaacgcgcccauggacgaaugugaugcaaaaugccagaccccucaaggugccauuaauucgucucugccauuccagaacgugcaccccgucacgaucggggaguguccuaaguacguucgcuccgcuaaauuaagaauggugacuggacugaggaauaucccaucaauucagagucggggccucuuuggcgccauagcaggguucaucgaaggagguuggacaggcaugguagacgggugguauggauaccaucaccagaacgagcaaggcagcgguuacgcugccgaucagaaguccacccagaaugcgauuaacgggaucacuaauaaagugaacucugucauagaaaagaugaauacacaguuuaccgccgugggcaaagaguucaacaaacuugagcgccgaauggaaaaucugaacaagaaaguugacgauggauucuuggacauuuggacguauaacgcagagcuacuggugcuccuggaaaaugagagaacccuugacuuucacgauagcaacgucaagaaucuguacgaaaaagugaagucacaauugaaaaacaaugcuaaggagaucggcaacgggugcuucgaguuuuaucauaaguguaauaacgaaugcauggagaguguaaagaauggaacauacgacuaucccaaguacuccgaagagagcaaacucaacagggagaagaucgaugguguuaaacuggacucuaugggcguguaucagauuuuagccaucuacucaacugucgcuaguagccuggugcuacucgucucccugggggccauuucuuucuggaugugcucgaauggaagccuucagugucggauaugcaucuga

SEQ ID NO: 122524 - RNA, 1698 nt, Artificial Sequence; identical to SEQ ID NO: 122312
  derived and/or modified sequence opt3 from hemagglutinin__InfluenzaA__ABC40533

SEQ ID NO: 122525 - RNA, 1701 nt, Artificial Sequence
  derived and/or modified sequence opt3 from hemagglutinin__InfluenzaA__ABC40555
augaagaccaucauugcccugagcuacauauucugccucguguuugcucagaaccuucccagaaaugacaaauccacagcaacucuguguuugggccaccaugccgucccuaacgggacguuaguuaagaccaucacaaaugaucaaauugaggugacuaacgcgaccgaacugguacagucuucaaguacaggaaggaucugcgacagcccacaccggauucuagaugguaaaaauuguacccucguggacgcucugcuuggcgauccgcauugcgacggguuccagaacgagaagugggaucuguuugucgaacgcuccaaagccuucucuaauuguuaucccuacgacgugccugauuaugcaucguugcgaucacucguugccagcaguggaacucuggaguuuaucaacgaauccuucaauuggacaggcgugacccagucuggugggagcuacgcuugcaagcguggauccgacaacucauuuuucaguagacugaauuggcucuaugagagcgagucuaaguacccagucuuaaacgugacgaugcccaauaacggcaauuuugauaaacuguauauauggggcguacaccauccuuccacugacaaggaacaaaccaaccuuuacguuagggcaucagggcgggugacagucagcacuaaacgcagucagcagaccaucauuccaaacaucggaucuagacccugggugagggguuuguccagccggauuucgaucuacuggacaauagugaagccuggcgauauucugcuaaucaauucuaacgggaaucucauugccccacgcggauauuucaaaauccgaaccggcaaguccucaaucaugagaagugacgcuccgauugguacguguagcuccgagugcauaacucccaacgggucuaucccuaaugacaagccauuucagaacgucaauaaaauuacauacggagccugucccaaguauguuaaacaaaacacccugaaacuugcgacuggcaugaggaaugugccugaaaagcagacacggggcaucuucggggcaauagccggauuuauugagaacgguugggagggcaugguagaugggugguacggauuccgucaccagaauagcgaaggcaccggucaggcugccgaccugaagucaacgcaagcagcuaucgaucagaucaacgggaaauugaaucgcgugauugagaagaccaacgaaaaguuccaccagaucgagaaagaauuuagugaggucgagggcaggauucaagaccucgaaaaguauguggaggauacaaaaauagaccugugguccuacaaugccgaauuacugguugcgcucgagaaccagcauacuaucgaucuuaccgacagcgaaaugaacaagcuguucgagaaaacaagacggcaguugcgagagaaugccgaagauaugggaaacggcugcuuuaagauuuaucacaagugugacaaugcaugcaucgggucuauccgcaacggaacuuacgaucaugacguguacagagacgaggcucuaaauaacagguuccagauuaaaggugucgaacugaagucaggcuauaaagauuggauacucuggaucaguuuugccauuagcugcuuccugcuuugugugguacuguugggguuuaucaugugggcuugccaaaagggaaauauucgguguaacaucugcauauga

SEQ ID NO: 122526 - RNA, 1701 nt, Artificial Sequence
  derived and/or modified sequence opt3 from hemagglutinin__InfluenzaA__ABC40608
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcgagaauuguacccugaucgacgcucuacugggggauccgcauugcgacggauuucagaacaaagaaugggauuuguucguggagcgguccaaggccuauucuaauuguuaccccuaugacgucccugauuacgcaucgcuccgcucacugguggccagcaguggcacucuggaauuuaacaaugaguccuucaacuggacagguguugcucagaaugggaccucuagcgcaugcaaacgacguuccauaaagucauuuuucaguagacucaacugguuacaccaacugaaguauaaauacccagcccuuaaugugacgaugcccaacaaugacaaguuugauaaauuguauaucuggggaguccaucacccuagcacugacucugaucagaccucccuguacgcucaggccucaggcagggugacaguaagcacucggcgcagucagcaaaccguuauuccaaacaucggcucuagacccugggugaggggagucuccagccggauuucgaucuacuggacaauagugaagccuggggacauucuacucaucaacucuaccgguaaucugauugcgccacgcggcuauuucaaaauccgauccgggaagucaaguaucaugagaagcgacgcaccgauuggaaaguguaacuccgagugcauaacgcccaauggcucuaucccuaacgauaaaccauuucagagcgugaauaggauuacuuacggugccuguccccgguaugucaagcagaacacacuuaaacuggcuaccgggaugcguaauguuccugaaaagcagacucgcggaaucuucggcgccauagcaggcuuuauugagaacgggugggaaggaaugguggacgguugguacggcuucagacaccaaaauucagaggggacaggacaggcugccgauuugaaaaguacccaggcggccaucaaccaaaucaauggcaagcucaacaggcugauugagaaaacgaaugaaaaguuucaucagaucgagaaggaguucuccgaaguagaaggucggauucaggacuuagagaaauauguggaggauaccaagauagaccuguggagcuacaacgcagaacuccuugucgcucuggagaaucagcacacaaucgauuugacugacucugaaaugaacaaacuauucgagcgaacccgcaagcaacugagagaaaacgccgaggauauggggaauggcugcuuuaaaauuuaucauaagugugacaacgcuugcaucggaucaaucaggaauggcacauacgaucacgacguguaccgggacgaggcccucaacaaucgcuuccagauuaaggggguugaacugaaaaguggauauaaggauuggauacuuuggaucagcuuugcaauuuccugcuuccuguugugugugguccuccuggguuuuaucaugugggccugccagaaaggcaacauuagauguaauaucugcauauga

SEQ ID NO: 122527 - RNA, 1701 nt, Artificial Sequence
  derived and/or modified sequence opt3 from hemagglutinin__InfluenzaA__ABC40619
augaagaccaucauugcccugagcuacauauucugccucgugcuuggccaggacuuuuccgggaacgauaauucuacagcuacucuguguuugggacaccaugcaguccccaacgguacguuaguuaaaaccaucacaaaugaccaaauugaggugacuaacgccaccgaacugguacagucaaguagcacaggcaagaucugcaauaacccucacaggauucuagaugggaucgacuguacccucauagaugcgcugcuuggagacccacauugcgauggcuuccagaaugagacuugggaccuguuuguggaaagauccaaggcuuucucuaacuguuauccguacgauguccccgacuaugccucguugcggucacucguggcaagcagugguacacuggaguuuaucaaugaaggguucaacuggaccggaguuacgcagaauggcggcuccaacgccugcaaacgcgggccugauucuggauuuuucagccgacugaauuggcucuacaaauccgguucaacuuauccaguguuaaacgucaguaugcccaauaacgacaacuuugauaagcuguacauuuggggcgugcaccauccuagcaccgaccaagagcagacaaaucuuuauguacaggcuucugggcguguuacuguguccaccaagagaucacagcaaacaaucauuccaaacaucggaagcaggcccuggguccggggcuugaguucucgcauauccauuuacuggaccaucgugaaaccuggugacauucuggugaucaauagcaacgggaaucuaaucgcaccaagaggauacuucaagaugaggacgggcaaaucgucuauuaugcgguccgaugccccgauaggcacuuguaucucagagugcauuacacccaacgggaguaucccuaaugacaagccauuucagaacgucaauaaaauaaccuauggagcuugucccaaguacguuaagcagaacacucucaaacuggccacagguaugcgcaaugugccugaaaagcagacccgaggcauuuucggggcgaucgcaggauuuaucgagaacggcugggaagguaugauugaugggugguauggcuucagacaccaaaauagcgagggaacgggccaggccgcugaccuuaaauccacccaggccgcaaucgaucaaauuaacgggaagcugaauaggauaaucgagaaaacaaacgaaaaguuccaccagauugagaaagaauuuucugagguagaaggacggauccaggacuuggagaaguacguggaggauacuaagaucgaccucuggagcuauaacgcugaacuguuagucgcccuggagaaucagcauaccauugaucucacagacucagaaaugaacaaacuuuucgagaagacucgucgccaacugagagaaaaugcggaggauauggguaacggcugcuuuaaaauauaccacaagugugacaaugccugcaucgggaguauuaggaacggaaccuaugaccaugauguguaccgggacgaggcauugaauaaccgauuccagaucaaaggcguugaacuaaaguccgguuacaaggauuggauucuguggaucagcuuugcuauaucuugcuuccuccugugugugguccuucugggguuuaucaugugggccugccagaaaggcaauauucgcuguaacaucugcauuuga

SEQ ID NO: 122528 - RNA, 1698 nt, Artificial Sequence
  derived and/or modified sequence opt3 from hemagglutinin__InfluenzaA__ABC40631
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaauacucuggggcguacaucacccuccaaacaucggggaucagcgcacucuguaccacaccgaaaacgccuauguuuccguggucucaagccauuacagucgacguuucacacccgagauuacuaaaagaccuaaggugagggaccaggaaggacggaucaauuauuacuggacccuucuggagccaggugauacaauuaucuuugaggcuaacggcaauuugauagcaccgugguaugccuucgcucucucucgcggguuuggauccggcauuaucaccagcaacgcccccauggacgaaugugaugcgaagugccagacgccucaaggugcaauuaauucgucucugccauuccagaacgugcaccccgucacuaucggggaguguccuaaauacguuagauccgccaaguuaaggauggugacaggacugcggaauaucccaucaauucagagucgcggccucuuuggcgcuauagccggguucaucgaaggagguuggaccggcaugguagacgggugguauggauaccaucaccagaacgagcaaggcagcgguuacgcagcugaucagaaauccacucagaaugccauuaacgggaucacaaauaaggugaacucugucauagaaaagaugaauacccaguuuacggcggugggcaaagaguucaacaaacuugagcgaagaauggaaaaucugaacaagaagguugacgauggauucuuggacauuuggaccuauaacgccgagcuacuggugcuccuggaaaaugagaggacacuugacuuucacgauagcaacgucaaaaaucuguacgaaaaggugaaaucacaauugaagaacaaugcaaaagagaucggcaacgggugcuucgaguuuuaucauaaguguaauaacgaaugcauggagaguguaaagaauggaacuuacgacuaucccaaauacuccgaagagagcaagcucaaccgggagaaaaucgaugguguuaagcuggaaucuaugggcguguaucagauuuuagcuaucuacucaaccgucgccaguagccuggugcuacucgucucccugggggcuauuucuuucuggaugugcucgaauggaagccuucagugucguauaugcaucuga

SEQ ID NO: 122529 - RNA, 1701 nt, Artificial Sequence
  derived and/or modified sequence opt3 from hemagglutinin__InfluenzaA__ABC41692
augaagaccaucauugcccugagcuacauacucugccuuguguucgcucagaaacccccuggcaacgacaauuccacagcaacucuguguuuggggcaccaugccgucccaaacggaacgaucguuaagaccauuacaaaugaucaaaucgaggugacuaacgcgaccgaauuaguacagucuucaaguacagguggcauuugcgacagcccgcaccagauccuggauggggagaauuguacccuaauagacgcucuccugggagauccccagugcgacggcuuucaaaacaaaaagugggaucuuuucguggaaagauccaaagccuauucuaauuguuacccuuaugacgucccagaucaugcaucgcugaggucauugguggccagcagugguacucucgaguuuaacaaugaauccuucgacuggacagggguuacccagaacggaacgucuagcgcuugcaagcggcgcuccaauaagucauuuuucagucgacugaacuggcugacucaccucaaauacaaguaucccgcauuaaaugugaccaugccuaacaaugagaaauuugauaagcuguacaucuggggcguccaucacccaggcacagacagcgaucagauuucucuuuaugcccaggcuuccgggcguaucacugugucaaccaaaagaagccaacagacaguaauucccaacaucggaaguaggccucggguucgcgacgugucuuccagaauaagcauuuacuggaccaucgucaagccaggugacauuuugcugaucaacucgacgggcaaucuaaucgccccgaggggguacuucaagauucggucuggaaaauccucaauaaugcgcagugaugcgcccaucggcaaguguaacagcgagugcauuacuccuaaugguuccaucccaaacgacaaacccuuucagaaugugaaccgaauaacauauggggcauguccuagauacgugaagcagaauacccucaaacuggccacuggaaugaggaacgucccagaaaagcaaacacggggcauuuucggcgcuaucgccggguuuaucgagaauggaugggaagguaugguugauggcugguauggguuccgucaccagaacucugagggaaccggccaggcagcugaccuuaaaagcacgcaagccgcgauuaaucagaucaacgguaagcugaaucgcuugauugggaagaccaacgagaaauuucaucagauagaaaaggaguucucagaaguggagggcagaauccaggaucucgaaaaauacguagaggacacaaagauugaucuguggaguuauaaugccgaguuacugguggcacucgaaaaccaacacacuaucgaccuuaccgauuccgagaugaacaaacuguucgaaaggacaaagaagcaguugcgggagaaugcugaagacaugggaaacggcugcuuuaaaaucuaccauaagugugauaaugccugcauugggagcauacgaaacggaacuuaugaccacgacgucuaccgcgaugaggcucuaaauaacagauuccagaucaaagguguggagcugaagucuggcuacaaagacuggauucucuggaucucauuugccauuaguugcuuccugcuuuguguugcacuguugggguuuaucaugugggccugccagaagggaaauauaagguguaacaucugcauuuga

SEQ ID NO: 122530 - RNA, 1698 nt, Artificial Sequence; identical to SEQ ID NO: 122315
  derived and/or modified sequence opt3 from hemagglutinin__InfluenzaA__ABC41714

SEQ ID NO: 122531 - RNA, 1701 nt, Artificial Sequence
  derived and/or modified sequence opt3 from hemagglutinin__InfluenzaA__ABC41725
augaagaccacaaucgcccugagcuacauucucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacagucuucaaguaccgguggcaucugcgacagcccacaccagauucuagauggggagaauuguacucucaucgacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacacuggaguuuaacaaugaauccuucgacuggaccgggguuacgcagaacggaacuucuagcgcuugcaagcggcgcuccaauaagucauuuuucagucgacugaacuggcucacccacuuaaaauacaaguauccagcacugaaugugacaaugcccaacaaugagaaauuugauaaacuuuacauauggggcguccaucacccuggcacugacagcgaucagaucucuuuguaugcccaggcuuccgggcguauuaccgugucaacaaagagaagccaacagaccguaaucccaaacauuggaaguaggccccggguucgcgacgugucuuccagaaucagcauauacuggacgauugucaagccuggugacauccugcuaauuaacucgacuggcaaucucaucgccccaaggggguacuucaagauccggucuggaaaauccucaauuaugcgcagugaugcgccgauaggcaaguguaacagcgagugcaucacacccaaugguuccauuccuaacgacaaaccauuucagaaugugaaccgaaucaccuauggggcaugucccagauacgugaagcagaauacucugaaacuugccacaggaaugaggaacgucccugaaaagcaaacccggggcauauucggcgcuauugccggguuuaucgagaauggaugggaagguaugguugauggcugguauggguuccgucaccagaacucugagggaacgggccaggcagcugaccugaaaagcacccaagccgcgaucaaucagauuaacgguaaguugaaucgccucaucgggaagacaaacgagaaauuucaucagauugaaaaggaguucucagaaguggagggcagaauacaggaucuggaaaaauacguagaggacacuaagaucgauuuauggaguuauaaugccgagcugcucguggcacuugaaaaccaacacaccauugaccugacagauuccgagaugaacaaauuguucgaaaggacuaagaagcagcuacgggagaaugcugaagacaugggaaacggcugcuuuaaaaucuaccauaagugugauaaugccugcaucgggagcauucgaaacggaaccuaugaccacgacgucuaccgcgaugaggcucugaauaacagauuccagauaaaagguguggagcucaagucuggcuacaaagacuggauccuguggauuucauuugccaucaguugcuuccuucuguguguugcauugcucggguuuauuaugugggccugccagaagggaaauaucagguguaacauaugcaucuga

SEQ ID NO: 122532 - RNA, 1701 nt, Artificial Sequence
  derived and/or modified sequence opt3 from hemagglutinin__InfluenzaA__ABC41736
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacagcgaucagauuucuuuguaugcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguacuucaagauucggucuggaaaauccucaauaaugcgcagugaugcgccgaucggcaaguguaacagcgagugcauuacucccaaugguuccaucccuaacgacaaaccauuucagaaugugaaccgaauaacauauggggcaugucccagauacgugaagcagaauacccugaaacuugccacuggaaugaggaacgucccugaaaagcaaacacggggcauuuucggcgcuaucgccggguuuaucgagaauggaugggaagguaugguugauggcugguauggguuccgucaccagaacucugagggaaccggccaggcagcugaccugaaaagcacgcaagccgcgauuaaucagaucaacgguaaguugaaucgccucauugggaagaccaacgagaaauuucaucagauagaaaaggaguucucagaaguggagggcagaauccaggaucuggaaaaauacguagaggacacaaagauugauuuauggaguuauaaugccgagcugcucguggcacuugaaaaccaacacacuaucgaccugaccgauuccgagaugaacaaauuguucgaaaggacaaagaagcagcuacgggagaaugcugaagacaugggaaacggcugcuuuaaaaucuaccauaagugugauaaugccugcauugggagcauacgaaacggaacuuaugaccacgacgucuaccgcgaugaggcucugaauaacagauuccagaucaaagguguggagcucaagucuggcuacaaagacuggauucuguggaucucauuugccauuaguugcuuccuucuguguguugcauugcucggguuuaucaugugggccugccagaagggaaauauaagguguaacaucugcauuuga

SEQ ID NO: 122533 - RNA, 1701 nt, Artificial Sequence; identical to SEQ ID NO: 122532
  derived and/or modified sequence opt3 from hemagglutinin__InfluenzaA__ABC41952

SEQ ID NO: 122534 - RNA, 1701 nt, Artificial Sequence; identical to SEQ ID NO: 122532
  derived and/or modified sequence opt3 from hemagglutinin__InfluenzaA__ABC41953

SEQ ID NO: 122535 - RNA, 1701 nt, Artificial Sequence; identical to SEQ ID NO: 122532
  derived and/or modified sequence opt3 from hemagglutinin__InfluenzaA__ABC41964

SEQ ID NO: 122536 - RNA, 1701 nt, Artificial Sequence; identical to SEQ ID NO: 122532
  derived and/or modified sequence opt3 from hemagglutinin__InfluenzaA__ABC42014

SEQ ID NO: 122537 - RNA, 1701 nt, Artificial Sequence; identical to SEQ ID NO: 122532
  derived and/or modified sequence opt3 from hemagglutinin__InfluenzaA__ABC42114

SEQ ID NO: 122538 - RNA, 1701 nt, Artificial Sequence; identical to SEQ ID NO: 122532
  derived and/or modified sequence opt3 from hemagglutinin__InfluenzaA__ABC42125

SEQ ID NO: 122539 - RNA, 1701 nt, Artificial Sequence; identical to SEQ ID NO: 122532
  derived and/or modified sequence opt3 from hemagglutinin__InfluenzaA__ABC42136

SEQ ID NO: 122540 - RNA, 1701 nt, Artificial Sequence
  derived and/or modified sequence opt3 from hemagglutinin__InfluenzaA__ABC42147
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacagcgaucagauuucuuuguaugcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguacuucaagauucggucuggaaaauccucaauaaugcgcagugaugugccgaucggcaaguguaacagcgagugcauuacucccaaugguuccaucccuaacgacaaaccauuucagaaugugaaccgaauaacauauggggcgugucccagauacgucaagcagaauacccugaaacuugcaacuggaaugaggaacguuccugaaaagcaaacacggggcauuuucggcgccaucgcuggguuuaucgagaauggaugggaagguaugguggauggcugguauggguuccgucaccagaacucugagggaaccggccaggccgcagaccugaaaagcacgcaagcugccauuaaucagaucaacgguaaguugaaucgccucauugggaagaccaacgagaaauuucaucagauagaaaaggaguucucagaaguagagggcagaauccaggaucuggaaaaauacguggaggacacaaagauugauuuauggaguuauaaugcggagcugcucgucgcccuugaaaaccaacacacuaucgaccugaccgauuccgagaugaacaaauuguucgaaaggacaaagaagcagcuacgggagaaugcagaagacaugggaaacggcugcuuuaaaaucuaccauaagugugauaaugcuugcauugggagcauacgaaacggaacuuaugaccacgacguguaccgcgaugaggcccugaauaacagauuccagaucaaagguguugagcucaagucuggcuacaaagacuggauucuguggaucucauuugcuauuaguugcuuccuucuguguguggccuugcucggguuuaucaugugggcaugccagaagggaaauauaagguguaacaucugcauuuga

SEQ ID NO: 122541 - RNA, 1701 nt, Artificial Sequence; identical to SEQ ID NO: 122532
  derived and/or modified sequence opt3 from hemagglutinin__InfluenzaA__ABC42158

SEQ ID NO: 122542 - RNA, 1701 nt, Artificial Sequence; identical to SEQ ID NO: 122532
  derived and/or modified sequence opt3 from hemagglutinin__InfluenzaA__ABC42169

SEQ ID NO: 122543 - RNA, 1701 nt, Artificial Sequence; identical to SEQ ID NO: 122532
  derived and/or modified sequence opt3 from hemagglutinin__InfluenzaA__ABC42180

SEQ ID NO: 122544 - RNA, 1701 nt, Artificial Sequence; identical to SEQ ID NO: 122532
  derived and/or modified sequence opt3 from hemagglutinin__InfluenzaA__ABC42192

SEQ ID NO: 122545 - RNA, 1701 nt, Artificial Sequence; identical to SEQ ID NO: 122532
  derived and/or modified sequence opt3 from hemagglutinin__InfluenzaA__ABC42307

SEQ ID NO: 122546 - RNA, 1701 nt, Artificial Sequence
  derived and/or modified sequence opt3 from hemagglutinin__InfluenzaA__ABC42318
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacagcgaucagauuucuuuguaugcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguacuucaagauucggucuggaaaauccucaauaaugcgcagugaugcgccgaucggcaaguguaacagcgagugcauuacucccaaugguuccaucccuaacgacaaaccauuucagaaugugaaccgaauaacauauggggcaugucccagauacgugaagcagaauacccugaaacuugccacuggaaugaggaacgucccugaaaagcaaacacggggcauuuucggcgcuaucgccggguuuaucgagaauggaugggaagguaugguugauggcugguauggguuccgucaccagaacucugagggaaccggccaggcagcugaccugaaaagcacgcaagccgcgauuaaucagaucaacgguaaguugaaucgccucauugggaagaccaacgagaaauuucaucagauagaaaaggaguucucagaaguggagggcagaauccaggaucuggaaaaauacguagaggacacaaagauugauuuauggaguuauaaugccgaguuccugguggcacucgaaaaccaacacacuaucgaccuuaccgauuccgagaugaacaaacuguuugaaaggacaaagaagcaguugcgggagaaugcugaagacaugggaaacggcugcuucaaaaucuaccauaagugugauaaugccugcauugggagcauacgaaacggaacuuaugaccacgacgucuaccgcgaugaggcucuaaauaacagauuucagaucaaagguguggagcugaagucuggcuacaaagacuggauucucuggaucucauucgccauuaguugcuuucugcuuuguguugcacuguugggguucaucaugugggccugccagaagggaaauauaagguguaacaucugcauuuga

SEQ ID NO: 122547 - RNA, 1701 nt, Artificial Sequence; identical to SEQ ID NO: 122532
  derived and/or modified sequence opt3 from hemagglutinin__InfluenzaA__ABC42346

SEQ ID NO: 122548 - RNA, 1701 nt, Artificial Sequence; identical to SEQ ID NO: 122532
  derived and/or modified sequence opt3 from hemagglutinin__InfluenzaA__ABC42461

SEQ ID NO: 122549 - RNA, 1701 nt, Artificial Sequence; identical to SEQ ID NO: 122532
  derived and/or modified sequence opt3 from hemagglutinin__InfluenzaA__ABC42494

SEQ ID NO: 122550 - RNA, 1701 nt, Artificial Sequence; identical to SEQ ID NO: 122532
  derived and/or modified sequence opt3 from hemagglutinin__InfluenzaA__ABC42505

SEQ ID NO: 122551 - RNA, 1701 nt, Artificial Sequence
  derived and/or modified sequence opt3 from hemagglutinin__InfluenzaA__ABC42516
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacagcgaucagauuucuuuguaugcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguacuucaagauucggucuggaaaauccucaauaaugcgcagugaugcgccgaucggcaaguguaacagcgagugcauuacucccaaugguuccaucccuaacgacaaaccauuucagaaugugaaccgaauaacauauggggcaugucccagauacgugaagcagaauacccugaaacuugccacuggaaugaggaacgucccugaaaagcaaacacggggcauuuucggcgcuaucgccggguuuaucgagaauggaugggaagguaugguugauggcugguauggguuccgucaccagaacucugagggaaccggccaggcagcugaccugaaaagcacgcaagccgcgauuaaucagaucaacgguaaguugaauaagcucauugggaaaaccaacgagaaguuucaucagauagaaaaagaguucucagaaguggagggccgcauccaggaucuggaaaaguacguagaggacacaaaaauugauuuauggaguuauaaugccgagcugcucguggcacuugaaaaccaacacacuaucgaccugaccgauuccgagaugaacaaguuguucgaaagaacaaagaaacagcuaagggagaaugcugaagacaugggaaacggcugcuuuaagaucuaccauaaaugugauaaugccugcauugggagcauacggaacggaacuuaugaccacgacgucuaccgagaugaggcucugaauaaccgcuuccagaucaaggguguggagcucaaaucuggcuacaaggacuggauucuguggaucucauuugccauuaguugcuuccuucuguguguugcauugcucggguuuaucaugugggccugccagaagggaaauauaagauguaacaucugcauuuga

SEQ ID NO: 122552 - RNA, 1701 nt, Artificial Sequence; identical to SEQ ID NO: 122532
  derived and/or modified sequence opt3 from hemagglutinin__InfluenzaA__ABC42527

SEQ ID NO: 122553 - RNA, 1701 nt, Artificial Sequence; identical to SEQ ID NO: 122532
  derived and/or modified sequence opt3 from hemagglutinin__InfluenzaA__ABC42574

SEQ ID NO: 122554 - RNA, 1701 nt, Artificial Sequence; identical to SEQ ID NO: 122532
  derived and/or modified sequence opt3 from hemagglutinin__InfluenzaA__ABC42585

SEQ ID NO: 122555 - RNA, 1701 nt, Artificial Sequence; identical to SEQ ID NO: 122259
  derived and/or modified sequence opt3 from hemagglutinin__InfluenzaA__ABC42596

SEQ ID NO: 122556 - RNA, 1701 nt, Artificial Sequence; identical to SEQ ID NO: 122298
  derived and/or modified sequence opt3 from hemagglutinin__InfluenzaA__ABC42607

SEQ ID NO: 122557 - RNA, 1701 nt, Artificial Sequence; identical to SEQ ID NO: 122298
  derived and/or modified sequence opt3 from hemagglutinin__InfluenzaA__ABC42618

SEQ ID NO: 122558 - RNA, 1701 nt, Artificial Sequence
  derived and/or modified sequence opt3 from hemagglutinin__InfluenzaA__ABC42629
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucacuuaaaguuuaaauacccagcacugaaugugaccaugcccaacaacgagaaguucgacaaacuuuauaucuggggcguccaucacccuggcacagauaaugaccagauuagcuuguacgcccaggcuucugggcguaucacuguguccaccaagagaucacaacagacaguaauuccaaacaucggaagcaggccccggguucgcgauauaccuaguagaauuucuaucuauuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauacggggcauguccuagauaugugaaacagaacacccugaaacuugccacuggaaugaggaaugugccagaaaaacaaacacggggcaucuuuggcgcuaucgccggguucauugagaacggaugggaagguauggucgacggcugguacggguuucgucaccagaauagcgagggaaccggccaggcagcugaucugaaguccacgcaagccgcgaucaaccagauuaaugguaaauugaaccgccucauagggaagaccaacgagaaguuccaucagaucgaaaaagaguucucugaaguugagggcaggauucaggaccuggaaaaguauguggaggauacaaaaaucgacuuauggagcuacaaugccgagcugcucguagcacuugaaaaccaacacacuaucgaucugaccgacucagagaugaauaaguuguuugaaagaacaaagaagcagcuacgggagaacgcugaagauaugggaaauggcugcuucaagauuuaucauaaaugugacaacgccugcauagggaguauccgaaauggaacuuacgaucacgacguguaucgcgacgaggcucugaacaauagauuucagauuaagggugucgagcucaaauccggcuacaaggauuggauccuguggauuagcuucgccaucucuugcuuucuucuguguguggcauugcucggguucauaaugugggccugccagaaaggaaacaucagguguaauauuugcaucuga

SEQ ID NO: 122559 - RNA, 1701 nt, Artificial Sequence
  derived and/or modified sequence opt3 from hemagglutinin__InfluenzaA__ABC42640
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacagguggcaucugcgacagcccacaccagauacuggauggggagaauuguacccuaaucgacgcucuccugggagauccgcagugcgacggcuuucaaaacaaaaagugggaucuuuucguggaaagauccaaagccuauucuaauuguuaccccuaugacgucccugauuacgcaucgcugaggucauugguggccagcagugguacucucgaguuuaacaaugaauccuucaacuggacagggguuacccagaauggaacgucuagcgcuugcaagcggcgcuccaacaauucauuuuucagucgacugaacuggcugacucaucucaaguuuaaauauccagcauuaaaugugaccaugcccaacaacgagaaguucgacaaacuguacauuuggggcguccaccauccuggcacagauaaugaccagaucagccuuuaugcccaggcuucugggcguauuacuguguccaccaagagaucacaacagacaguaaucccaaacauaggaagcaggccccggguucgcgauauuccuaguagaaucucuauuuacuggaccaucgugaaaccaggugacaucuugcugauuaauuccacgggcaaccuaauagccccgaggggguacuuuaagauccggagcggaaagucgucuauuaugcgcuccgacgcgcccaucggcaaauguaauucagagugcauaacuccuaacgguaguauuccaaaugauaagcccuuccagaacgucaaucgaaucacauauggggcauguccuagauacgugaaacagaacacccucaagcuggccacuggaaugaggaaugugccagaaaaacaaacacggggcaucuuuggcgcuauugccggguucaucgagaacggaugggaagguauggucgacggcugguauggguuucgucaccagaauagcgagggaauuggccaggcagcugaucuuaaguccacccaagccgcgauaaaccagaucaaugguaaacugaaccgcuugauugggaagacgaacgagaaguuccaccagaucgaaaaagaguucucugaaguugagggcagaauccaggaccucgaaaaguacguggaggauaccaaaauugaccuguggagcuauaaugccgaguuacugguagcacucgaaaaccaacauacaauagaucuuacugacucagagaugaauaagcuguuugaaaggaccaaaaagcaguugcgggagaacgcugaagauaugggaaauggcugcuucaagaucuaccacaaaugugacaacgccugcauugggaguauccgaaauggaacauaugaucaugacguguaccgcgacgaggcucuaaacaauagauuucagauuaagggugucgagcugaaauccggcuacaaggauuggauccucuggaucagcuucgccauaucuugcuuucugcuuuguguggcacuguugggguucauuaugugggccugccagaaaggaaacaucagguguaauauuugcaucuga

SEQ ID NO: 122560 - RNA, 1701 nt, Artificial Sequence; identical to SEQ ID NO: 122259
  derived and/or modified sequence opt3 from hemagglutinin__InfluenzaA__ABC42651

SEQ ID NO: 122561 - RNA, 1701 nt, Artificial Sequence
  derived and/or modified sequence opt3 from hemagglutinin__InfluenzaA__ABC42662
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucgacggcugguauggguuucgucaccagaauagcgagggaaucggccaggcagcugaucugaaguccacccaagccgcgauuaaccagauaaaugguaaauugaaccgccucaucgggaagacgaacgagaaguuccaccagauugaaaaagaguucucugaaguugagggcagaauccaggaccuggaaaaguacguggaggauaccaaaaucgacuuauggagcuauaaugccgaguuucugguagcacucgaaaaccaacauacaauugaucuuacugacucagagaugaauaagcuguucgaaaggaccaaaaagcaguugcgggagaacgcugaagauaugggaaauggcugcuuuaagauauaccacaaaugugacaacgccugcaucgggaguauucgaaauggaacauaugaucaugacguguaccgcgacgaggcucuaaacaauagauuccagaucaagggugucgagcugaaauccggcuacaaggauuggauucucuggaucagcuuugccauaucuugcuuccugcuuuguguggcacuguugggguuuaucaugugggccugccagaaaggaaacauuagguguaauaucugcauuuga

SEQ ID NO: 122562 - RNA, 1701 nt, Artificial Sequence
  derived and/or modified sequence opt3 from hemagglutinin__InfluenzaA__ABC42673
augaagaccaucauugcccugagcuacauacucugccuuaucuucgcucagaaacugcccggcaacgacaauuccacagcaacuuuguguuuagggcaccaugccgugccuaacggaacgauugucaagaccaucacaaaugaucaaauugagguuacuaacgcgaccgaacuggugcagucuucaaguacagguggcaucugcgacagcccacaccagauacuagauggggagaauuguacccucaucgacgcucugcuuggagauccgcagugcgacggcuuucaaaacaaaaagugggaucuguucguagaaagauccaaagccuauucuaauuguuaccccuaugacgugccugauuacgcaucguugaggucacucgucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagauaaugaccagaucagcuuguaugcccaggcuucugggcguauuacugucuccaccaagagaucacaacagacagugaucccaaacauaggaagcaggccccggguacgcgauauuccuaguagaaucucuauuuacuggaccaucguuaaaccaggugacauccugcuaauuaauuccacgggcaaccucauagccccgaggggguacuuuaagauccggagcggaaagucgucuauuaugcgcuccgacgcgcccaucggcaaauguaauucagagugcauaacuccuaacgguaguauuccaaaugauaagcccuuccagaacgugaaucgaaucacauauggggcauguccuagauacgucaaacagaacacccugaaacuugccacuggaaugaggaaugugccagaaaagcaaacacggggcaucuuuggcgcuauugccggguucaucgagaacggaugggaagguaugguggacggcugguauggguuucgucaccagaauagcgagggaauuggccaggcagcugaucugaaguccacccaagccgcgauaaaccagaucaaugguaaauugaaccgccucauugggaagacgaacgagaaguuccaccagaucgaaaaagaguucucugaagucgagggcagaauccaggaccuggaaaaguacguugaggauaccaaaauugacuuauggagcuauaaugccgagcugcucguggcacuugaaaaccaacauacaauagaucugacugacucagagaugaauaaguuguuugaaaggaccaaaaagcagcuacgggagaacgcugaagauaugggaaauggcugcuucaagaucuaccacaaaugugacaacgccugcauugggaguauccgaaauggaacauaugaucaugacguauaccgcgacgaggcucugaacaauagauuucagauuaaggguguggagcucaaauccggcuacaaggauuggauccuguggaucagcuucgccauaucuugcuuucuucugugugucgcauugcucggguucauuaugugggccugccagaaaggaaacaucagguguaauauuugcaucuga

SEQ ID NO: 122563 - RNA, 1701 nt, Artificial Sequence; identical to SEQ ID NO: 122259
  derived and/or modified sequence opt3 from hemagglutinin__InfluenzaA__ABC42684

SEQ ID NO: 122564 - RNA, 1701 nt, Artificial Sequence; identical to SEQ ID NO: 122259
  derived and/or modified sequence opt3 from hemagglutinin__InfluenzaA__ABC42695

SEQ ID NO: 122565 - RNA, 1701 nt, Artificial Sequence
  derived and/or modified sequence opt3 from hemagglutinin__InfluenzaA__ABC42706
augaagaccaucauugcccugagcuacauacucugccuuguguucgcucagaaacugcccggcaacgacaauuccacagcaacuuuguguuuagggcaccaugccgucccuaacggaacgaccguuaagacaaucacuaaugaucaaauugaggugaccaacgcgacagaacugguacagucuucaaguaccgguggcaucugcgacagcccacaccagauucuagauggggagaauuguacucucaucgacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacacuggaguuuaacaaugaauccuucaacuggaccgggguuacgcagaauggaacuucuagcgcuugcaagcggcgcuccaacaauucauuuuucagucgacugaacuggcucacccauuuaaaguuuaaauauccagcacugaaugugacaaugcccaacaacgagaaguucgacaaacuuuacauauggggcguccaccauccuggcacugauaaugaccagaucagcuuguaugcccaggcuucugggcguauuaccguguccacaaagagaucacaacagaccguaaucccaaacauuggaagcaggccccggguucgcgauaucccuaguagaauaucuauuuacuggacgaucgugaaaccaggugacauucugcuaaucaauuccacuggcaaccucaucgccccgaggggguacuuuaagauucggagcggaaagucgucuauaaugcgcuccgacgcgcccaucggcaaauguaauucagagugcauuacaccuaacgguaguaucccaaaugauaagcccuuccagaacgucaaucgaauaaccuauggggcauguccuagauacgugaaacagaacacucugaaacuugccacaggaaugaggaaugugccagaaaaacaaacccggggcauuuuuggcgcuaucgccggguucaucgagaacggaugggaagguauggucgacggcugguauggguuucgucaccagaauagcgagggaauuggccaggcagcugaucugaaguccacgcaagccgcgaucaaccagauuaaugguaaauugaaccgccucauagggaagaccaacgagaaguuccaccagaucgaaaaagaguucucugaaguugagggcaggauucaggaccuggaaaaguacguggaggauacaaaaaucgacuuauggagcuauaaugccgagcugcucguagcacuugaaaaccaacauacuaucgaucugaccgacucagagaugaauaaguuguuugaaagaacaaagaagcagcuacgggagaacgcugaagauaugggaaauggcugcuucaagauuuaccacaaaugugacaacgccugcauagggaguauccgaaauggaacuuaugaucaugacguguaccgcgacgaggcucugaacaauagauuucagauuaagggugucgagcucaaauccggcuacaaggauuggauccuguggauuagcuucgccaucucuugcuuucuucugugugugguuuugcucggguucauaaugugggcaugccagaaaggaaacaucagguguaauauuugcaucuga

SEQ ID NO: 122566 - RNA, 1701 nt, Artificial Sequence; identical to SEQ ID NO: 122259
  derived and/or modified sequence opt3 from hemagglutinin__InfluenzaA__ABC42717

SEQ ID NO: 122567 - RNA, 1701 nt, Artificial Sequence
  derived and/or modified sequence opt3 from hemagglutinin__InfluenzaA__ABC42728
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcagucuucaaguacagguggcaucugcgacagcccacaccagauucuagauggggagaauuguacccucauggacgcucugcuuggagauccgcagugcgacggcuuucaaaacaaaaagugggaucuguucgucgaaagauccagggccuauucuaauuguuaccccuaugacgugccugauuacgcaucguugcggucacucguugccagcagugguacucuggaguuuaacaaugaauccuucaacuggacaggggugacccagaauggaacgucuagcgcuugcaaacgccgauccaacaauucauuuuucagucgucugaacuggcucacucauuuaaaguuuaaguauccagcacugaaugucaccaugcccaacaacgagaaauucgacaaguuguacaucuggggcgugcaccauccuggcacagauaaugaccagauaagccuuuaugcccaggcuucugggagaaucacuguauccaccaaaaggucacaacagacaguuauuccaaacaucggaagccggccccgcgugagagauauuccuaguaggaucucuauauacuggaccauugucaagccaggugacauccugcuaauuaauuccacgggcaaccucaucgccccgcggggguacuuuaaaauccgcagcggaaagucgucuauuaugcgauccgacgcgcccauaggcaaguguaauucagagugcaucacuccuaacgguaguauuccaaaugauaaacccuuccagaacgugaauagaaucacauauggggcauguccuagguacgugaagcagaacacccugaaacuugccacuggaaugcggaaugucccagaaaagcaaacacguggcauauuuggcgcuauugccggguucaucgagaacggaugggaagguaugguugacggcugguauggguuucgccaccagaauagcgagggaaccggccaggcagcugaucugaaauccacgcaagccgcgaucaaccagauuaaugguaaguugaacagacucaucgggaaaaccaacgagaaguuccaccagauugaaaaggaguucucugaaguggagggcaggauacaggaccuggaaaaauacguagaggauacaaagaucgacuuauggagcuauaaugccgagcugcucguggcacuugaaaaccaacauacuauugaucugaccgacucagagaugaauaaauuguuugaacggacaaagaaacagcuacgagagaacgcugaagauaugggaaauggcugcuucaagaucuaccacaagugugacaacgccugcaucgggaguauucgcaauggaacuuaugaucaugacgucuacagagacgaggcucugaacaauagguuucagauaaaagguguggagcucaaguccggcuacaaagauuggauccuguggauuagcuucgccaucucuugcuuucuucuguguguuguguugcucggguucauuaugugggcaugccagaagggaaacauccgguguaauauaugcaucuga

SEQ ID NO: 122568 - RNA, 1701 nt, Artificial Sequence; identical to SEQ ID NO: 122259
  derived and/or modified sequence opt3 from hemagglutinin__InfluenzaA__ABC42739

SEQ ID NO: 122569 - RNA, 1698 nt, Artificial Sequence
  derived and/or modified sequence opt3 from hemagglutinin__InfluenzaA__ABC42750
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacgggaaaucaaguuuuuauaagaauuuacuguggcuuaccggaaagaacggcuuguaccccaaucugagcaagucuuaugcaaacaauaaagaaaaggaggugcuaguucucuggggcgugcaccacccuccaaacaucggggaucagaaggcccuguaccauacggaaaacgcuuacgucuccguggugucaagccacuauagucggaaauucacucccgagauagcaaagcgcccuaaaguccgagaccaggaaggacguaucaauuacuauuggacccuucuggagccaggugauacaauuaucuuugaggccaacggcaauuugauugcuccgagauacgccuucgcgcucucuaggggguuuggauccggcaucauaaacagcaaugcacccauggacgaaugugaugccaagugccagacuccucaaggugcuauuaacucgucucugccauuccagaauguucaucccgugaccaucggggaguguccuaaauauguacgguccgccaaguuacgcauggugacaggacugagaaacauuccaucaauccagaguaggggccucuuuggcgcaaucgcuggguucauugaaggagguuggaccggcauggucgacgggugguacggauaucaccaccagaaugagcaaggcagcgguuacgccgcggaucagaaauccacgcagaacgccauaaaugggaucacuaacaagguaaauucuguuauugaaaagaugaacacacaguuuaccgcagugggcaaagaguucaauaaacuugagcggcgcauggaaaaccugaacaaaaaggucgacgauggauucaucgacauauggacuuacaaugcugaguugcuagugcugcucgaaaacgagcgaacacuggacuuucaugauagcaauguuaaaaaccuuuaugaaaagguaaagucacaacugaaaaauaacgccaaggagauuggcaaugggugcuucgaguuuuaccacaaauguaacgacgaaugcauggagagugugaagaauggaaccuaugauuaccccaaauauuccgaagagagcaaguugaacagagagaagaucgacggugucaaacucgaaucuaugggcguguaccagauccuggcuauuuauucaacggucgccaguagcuuagugcugcuaguuucccucggggcaaucucuuucuggaugugcucgaauggaagccugcaguguaggauuugcauauga

SEQ ID NO: 122570 - RNA, 1701 nt, Artificial Sequence; identical to SEQ ID NO: 122259
  derived and/or modified sequence opt3 from hemagglutinin__InfluenzaA__ABC42761

SEQ ID NO: 122571 - RNA, 1701 nt, Artificial Sequence
  derived and/or modified sequence opt3 from hemagglutinin__InfluenzaA__ABC42772
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucgacggcugguauggguuucgucaccagaauagcgagggaaucggccaggcagcugaucugaaguccacccaagccgcgauuaaccagauaaaugguaaauugaaccgccucaucgggaagacgaacgagaaguuccaccagauugaaaaagaguucucugaaguugagggcagaauccaggaccuggaaaaguacguggaggauaccaaaaucgacuuauggagcuauaaugccgagcugcucguagcacuugaaaaccaacauacaauugaucugacugacucagagaugaauaaguuguuugaaaggaccaaaaagcagcuacgggagaacgcugaagauaugggaaauggcugcuucaagauauaccacaaaugugacaacgccugcaucgggaguauucgaaauggaacauaugaucaugacguguaccgcgacgaggcucugaacaauagauuucagaucaaguccgucgagcucaaaagcgguuacaaggauuggauucuguggaucucuuucgccauaucaugcuuucuucuguguguggcauugcucggcuucaucaugugggccugccagaaagggaacauuagguguaauaucugcauuuga

SEQ ID NO: 122572 - RNA, 1701 nt, Artificial Sequence; identical to SEQ ID NO: 122259
  derived and/or modified sequence opt3 from hemagglutinin__InfluenzaA__ABC42783

SEQ ID NO: 122573 - RNA, 1701 nt, Artificial Sequence; identical to SEQ ID NO: 122259
  derived and/or modified sequence opt3 from hemagglutinin__InfluenzaA__ABC42794

SEQ ID NO: 122574 - RNA, 1701 nt, Artificial Sequence; identical to SEQ ID NO: 122259
  derived and/or modified sequence opt3 from hemagglutinin__InfluenzaA__ABC42805

SEQ ID NO: 122575 - RNA, 1701 nt, Artificial Sequence; identical to SEQ ID NO: 122298
  derived and/or modified sequence opt3 from hemagglutinin__InfluenzaA__ABC42816

SEQ ID NO: 122576 - RNA, 1701 nt, Artificial Sequence
  derived and/or modified sequence opt3 from hemagglutinin__InfluenzaA__ABC42827
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaaugucuauuuacuggaccaucgugaaaccaggugacauucugcuaaucaauuccacgggcaaccucaucgccccgaggggguacuuuaagauucggagcggaaagucgucuauaaugcgcuccgacgcgcccaucggcaaauguaauucagagugcauuacuccuaacgguaguaucccaaaugauaagcccuuccagaacgucaaucgaauaacauauggggcauguccuagauacgugaaacagaacacccugaaacuugccacuggaaugaggaaugugccagaaaagcaaacacggggcauuuuuggcgcuaucgccggguucaucgagaacggaugggaagguauggucgacggcugguauggguuucgucaccagaauagcgagggaauuggccaggcagcugaucugaaguccacccaagccgcgaucaaccagauuaaugguaaauugaaccgccucauagggaagacgaacgagaaguuccaccagaucgaaaaagaguucucugaaguugagggcaggauucaggaccuggaaaaguacguggaggauaccaaaaucgacuuauggagcuauaaugccgagcugcucguagcacuugaaaaccaacauacaaucgaucugacugacucagagaugaauaaguuguuugaaagaaccaaaaagcagcuacgggagaacgcugaagauaugggaaauggcugcuucaagauuuaccacaaaugugacaacgccugcauagggaguauccgaaauggaacauaugaucaugacguguaccgcgacgaggcucugaacaauagauuucagauuaagggugucgagcucaaauccggcuacaaggauuggauccuguggauuagcuucgccaucucuugcuuucuucuguguguggcauugcucggguucauaaugugggccugccagaaaggaaacaucagguguaauauuugcaucuga

SEQ ID NO: 122577 - RNA, 1701 nt, Artificial Sequence; identical to SEQ ID NO: 122259
  derived and/or modified sequence opt3 from hemagglutinin__InfluenzaA__ABC42849

SEQ ID NO: 122578 - RNA, 1701 nt, Artificial Sequence
  derived and/or modified sequence opt3 from hemagglutinin__InfluenzaA__ABC42882
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacagaauacucuuaagcuggccacaggaaugaggaacgugccugagaaacaaacccggggcaucuucggcgcuauagccggguuuauugaaaauggaugggaggguaugauggacggcugguacggguuccgucaccagaacucugagggaacuggccaggcagcugaucuaaagagcacacaagccgcgaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugccgagcuccuugucgcacuggaaaaccaacacaccaucgauuugacagacuccgagaugaacaagcuauucgaaagaacuaaaaagcagcugcgggagaaugcugaggauaugggcaacggaugcuuuaagauuuaucauaaaugugacaaugccugcaucggcagcauccgaaacgggaccuacgaucacgacguguaccgcgacgaagcucucaauaacagauuccagauuaagggaguugagcugaaaucugguuauaaggauugggugcuuuggauaucauuugccaucaguugcuuccuguuguguauuguccuccugggcuuuaucaugugggcaugccagaaagggaauauuagguguaacaucugcauauga

SEQ ID NO: 122579 - RNA, 1701 nt, Artificial Sequence; identical to SEQ ID NO: 122578
  derived and/or modified sequence opt3 from hemagglutinin__InfluenzaA__ABC42893

SEQ ID NO: 122580 - RNA, 1701 nt, Artificial Sequence; identical to SEQ ID NO: 122532
  derived and/or modified sequence opt3 from hemagglutinin__InfluenzaA__ABC42929

SEQ ID NO: 122581 - RNA, 1701 nt, Artificial Sequence; identical to SEQ ID NO: 122532
  derived and/or modified sequence opt3 from hemagglutinin__InfluenzaA__ABC42940

SEQ ID NO: 122582 - RNA, 1701 nt, Artificial Sequence; identical to SEQ ID NO: 122532
  derived and/or modified sequence opt3 from hemagglutinin__InfluenzaA__ABC42951

SEQ ID NO: 122583 - RNA, 1701 nt, Artificial Sequence; identical to SEQ ID NO: 122532
  derived and/or modified sequence opt3 from hemagglutinin__InfluenzaA__ABC42962

SEQ ID NO: 122584 - RNA, 1701 nt, Artificial Sequence; identical to SEQ ID NO: 122532
  derived and/or modified sequence opt3 from hemagglutinin__InfluenzaA__ABC42973

SEQ ID NO: 122585 - RNA, 1701 nt, Artificial Sequence; identical to SEQ ID NO: 122532
  derived and/or modified sequence opt3 from hemagglutinin__InfluenzaA__ABC42995

SEQ ID NO: 122586 - RNA, 1701 nt, Artificial Sequence; identical to SEQ ID NO: 122532
  derived and/or modified sequence opt3 from hemagglutinin__InfluenzaA__ABC43006

SEQ ID NO: 122587 - RNA, 1701 nt, Artificial Sequence; identical to SEQ ID NO: 122532
  derived and/or modified sequence opt3 from hemagglutinin__InfluenzaA__ABC43028

SEQ ID NO: 122588 - RNA, 1701 nt, Artificial Sequence; identical to SEQ ID NO: 122532
  derived and/or modified sequence opt3 from hemagglutinin__InfluenzaA__ABC43039

SEQ ID NO: 122589 - RNA, 1701 nt, Artificial Sequence; identical to SEQ ID NO: 122532
  derived and/or modified sequence opt3 from hemagglutinin__InfluenzaA__ABC43050

SEQ ID NO: 122590 - RNA, 1701 nt, Artificial Sequence; identical to SEQ ID NO: 122532
  derived and/or modified sequence opt3 from hemagglutinin__InfluenzaA__ABC43061

SEQ ID NO: 122591 - RNA, 1701 nt, Artificial Sequence
  derived and/or modified sequence opt3 from hemagglutinin__InfluenzaA__ABC43072
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacagcgaucagauuucuuuguaugcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguacuucaagauucggucuggaaaauccucaauaaugcgcagugaugcgccgaucggcaaguguaacagcgagugcauuacucccaaugguuccaucccuaacgacaaaccauuucagaaugugaaccgaauaacauauggggcaugucccagauacgugaagcagaauacccugaaacuugccacuggaaugaggaacgucccugaaaagcaaacacggggcauuuucggcgcuaucgccggguuuaucgagaauggaugggaagguaugguugauggcugguauggguuccgucaccagaacucugagggaaccggccaggcagcugaccugaaaagcacgcaagccgcgauuaaucagaucaacgguaaguugaaucgccucauugggaagaccaacgagaaauuucaucagauagaaaaggaguucucagaaguggagggcagaauccaggaucuggaaaaauacguagaggacacaaagauugauuuauggaguuauaaugccgagcugcucguggcacuugaaaaccaacacacuaucgaccugaccgauuccgagaugaacaaauuguucgaaaagacaaagaaacagcuaagggagaaugcugaagacaugggaaacggcugcuuuaagaucuaccauaaaugugauaaugccugcauugggagcauacggaacggaacuuaugaccacgacgucuaccgagaugaggcucugaauaaccgcuuccagaucaaggguguggagcucaaaucuggcuacaaggacuggauucuguggaucucauuuaccauuaguugcuuccuucuguguguugccuugcucggguuuaucaugugggcaugccagaagggaaauauaagauguaacaucugcauuuga

SEQ ID NO: 122592 - RNA, 1701 nt, Artificial Sequence; identical to SEQ ID NO: 122532
  derived and/or modified sequence opt3 from hemagglutinin__InfluenzaA__ABC43083

SEQ ID NO: 122593 - RNA, 1701 nt, Artificial Sequence; identical to SEQ ID NO: 122532
  derived and/or modified sequence opt3 from hemagglutinin__InfluenzaA__ABC43094

SEQ ID NO: 122594 - RNA, 1701 nt, Artificial Sequence; identical to SEQ ID NO: 122532
  derived and/or modified sequence opt3 from hemagglutinin__InfluenzaA__ABC43116

SEQ ID NO: 122595 - RNA, 1701 nt, Artificial Sequence; identical to SEQ ID NO: 122259
  derived and/or modified sequence opt3 from hemagglutinin__InfluenzaA__ABC43127

SEQ ID NO: 122596 - RNA, 1701 nt, Artificial Sequence; identical to SEQ ID NO: 122298
  derived and/or modified sequence opt3 from hemagglutinin__InfluenzaA__ABC43138

SEQ ID NO: 122597 - RNA, 1701 nt, Artificial Sequence; identical to SEQ ID NO: 122259
  derived and/or modified sequence opt3 from hemagglutinin__InfluenzaA__ABC43149

SEQ ID NO: 122598 - RNA, 1701 nt, Artificial Sequence; identical to SEQ ID NO: 122259
  derived and/or modified sequence opt3 from hemagglutinin__InfluenzaA__ABC43160

SEQ ID NO: 122599 - RNA, 1701 nt, Artificial Sequence; identical to SEQ ID NO: 122259
  derived and/or modified sequence opt3 from hemagglutinin__InfluenzaA__ABC43171

SEQ ID NO: 122600 - RNA, 1701 nt, Artificial Sequence; identical to SEQ ID NO: 122259
  derived and/or modified sequence opt3 from hemagglutinin__InfluenzaA__ABC43182

SEQ ID NO: 122601 - RNA, 1701 nt, Artificial Sequence
  derived and/or modified sequence opt3 from hemagglutinin__InfluenzaA__ABC43475
augaagaccaucauugcccugagcuacauacucugccuuguguucgcucagaaacugcccggcaacgacaauuccacagcaacuuuguguuuagggcaccaugccgucccuaacggaacgaccguuaagacaaucacuaaugaucaaauugaggugaccaacgcgacagaacugguacagucuucaaguaccgguggcaucugcgacagcccacaccagauucuagauggggagaauuguacucucaucgacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacacuggaguuuaacaaugaauccuucaacuggaccgggguuacgcagaauggaacuucuagcgcuugcaagcggcgcuccaacaauucauuuuucagucgacugaacuggcucacccauuuaaaguuuaaauauccagcacugaaugugacaaugcccaacaacgagaaguucgacaaacuuuacauauggggcguccaccauccuggcacugauaaugaccagaucagcuuguaugcccaggcuucugggcguauuaccguguccacaaagagaucacaacagaccguaaucccaaacauuggaagcaggccccggguucgcgauaucccuaguagaauaucuauuuacuggacgaucgugaaaccaggugacauucugcuaaucaauuccacuggcaaccucaucgccccgaggggguacuuuaagauucggagcggaaagucgucuauaaugcgcuccgacgcgcccaucggcaaauguaauucagagugcauuacaccuaacgguaguaucccaaaugauaagcccuuccagaacgucaaucgaauaaccuauggggcauguccuagauacgugaaacagaacacucugaaacuugccacaggaaugaggaaugugccagaaaaacaaacccggggcauuuuuggcgcuaucgccggguucaucgagaacggaugggaagguauggucgacggcugguauggguuucgucaccagaauagcgagggaauuggccaggcagcugaucugaaguccacgcaagccgcgaucaaccagauuaaugguaaauugaaccgccucauagggaagaccaacgagaaguuccaccagaucgaaaaagaguucucugaaguugagggcaggauucaggaccuggaaaaguacguggaggauacaaaaaucgacuuauggagcuauaaugccgagcugcucguagcacuugaaaaccaacauacuaucgaucugaccgacucagagaugaauaaguuguuugaaagaacaaagaagcagcuacgggagaacgcugaagauaugggaaauggcugcuucaagauuuaccacaaaugugacaacgccugcauagggaguauccgaaauggaacuuaugaucaugacguguaccgcgacgaggcucugaacaauagauuucagauuaagggugucgagcucaaauccggcuacaaggauuggauccuguggauuagcuucgccaucucuugcuuucuucuguguguggcauugcucggguucauaaugugggccugccagaaaggaaacaucagguguaauauuugcaucuga

SEQ ID NO: 122602 - RNA, 1701 nt, Artificial Sequence; identical to SEQ ID NO: 122259
  derived and/or modified sequence opt3 from hemagglutinin__InfluenzaA__ABC43486

SEQ ID NO: 122603 - RNA, 1701 nt, Artificial Sequence; identical to SEQ ID NO: 122259
  derived and/or modified sequence opt3 from hemagglutinin__InfluenzaA__ABC43497

SEQ ID NO: 122604 - RNA, 1701 nt, Artificial Sequence; identical to SEQ ID NO: 122298
  derived and/or modified sequence opt3 from hemagglutinin__InfluenzaA__ABC43508

SEQ ID NO: 122605 - RNA, 1701 nt, Artificial Sequence; identical to SEQ ID NO: 122298
  derived and/or modified sequence opt3 from hemagglutinin__InfluenzaA__ABC43519

SEQ ID NO: 122606 - RNA, 1701 nt, Artificial Sequence; identical to SEQ ID NO: 122298
  derived and/or modified sequence opt3 from hemagglutinin__InfluenzaA__ABC43530

SEQ ID NO: 122607 - RNA, 1701 nt, Artificial Sequence
  derived and/or modified sequence opt3 from hemagglutinin__InfluenzaA__ABC43552
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuccagggcguaucacugugucuaccaagagaucccaacagacaguaauucccaacaucggaucaaggccucggguucgcgauauaccaagcagaauuaguaucuacuggaccauugugaaaccgggugacauccugcuaaucaauucuacgggcaaccucauugcccccaggggguacuuuaagauacgguccggaaagagcucgaucaugcgcucugacgcgccuauuggcaaauguaauuccgagugcaucacuccaaacgguucaauacccaaugauaagccuuuccagaacgucaaucgaauuacauauggggcauguccaagauacgugaaacagaacacccugaagcuggccacuggaaugaggaaugugcccgaaaaacaaacacggggcaucuuuggcgcuaucgccggguucauugagaacggaugggaagguauggucgacggcugguauggguuucgucaccagaauagugagggaaucggccaggcagcugaucuuaagagcacccaagccgcgauuaaccagauaaaugguaaauugaaccgccucaucgggaagacgaacgagaaguuccaccagauugaaaaagaguucuccgaaguugagggcagaauccaggaccuggaaaaguacguggaggauaccaaaaucgacuuauggucuuauaaugccgagcugcucguagcacuugaaaaccaacauacaauugaucugacugacagcgagaugaauaaguuguuugaaaggaccaaaaagcagcuacgggagaacgcugaagauaugggaaauggcugcuucaagauauaccacaaaugugacaacgccugcaucgggucaauucgaaauggaacauaugaucaugacguguaccgcgacgaggcucugaacaauagauuucagaucaagggugucgagcucaaaaguggcuacaaggauuggauucuguggaucuccuucgccauaagcugcuuucuucuguguguggcauugcucggguucaucaugugggccugccagaaaggaaacauuagguguaauaucugcauuuga

SEQ ID NO: 122608 - RNA, 1701 nt, Artificial Sequence
  derived and/or modified sequence opt3 from hemagglutinin__InfluenzaA__ABC46554
augaagaccaucauugcccugagcuacauauucugccagguguuugcucaaaaccuccccggcaaugacaacuccacagcaacucuuugucuggggcaccaugccgucccuaauggaacguugguuaaaaccaucacaaacgaucagauugaggugacuaaugcgaccgaauuaguacagucuucaaguacagguagaaucugcgacagcccacacaggauucuggauggcaagaacuguacccuaaucgacgcucuccugggggauccgcauugcgacggauuccagaaugagaaaugggaucuuuuuguggaacgguccaaggccuucucuaacuguuaucccuacgacgucccugauuaugcaucgcugcgcucauugguggccagcaguggcacucucgaguuuauaaaugaagguuucaacuggacagggguuacccaagacggaggcuccuacgcuugcaaacgaggcccagauaauagcuuuuucucucgucugaacuggcuguauaaguccgagucaacguaccccgugcucaaugucacuaugccuaacaaugacaacuuugauaaguuauauaucuggggagugcaccauccaaguaccgacaaagagcagacaaaccuguacguacaggcaagcgggagaguuacugugucuaccaagaggucccagcaaacaauuauccccaaugucgguucacggccuugggugcgcggccuuagcaguagaauuucuaucuacuggaccauagugaaaccaggggacauuuugcugaucaacuccaauggaaaccuaauugccccgaggggcuauuucaagauccggacggguaaaagcucgaucaugcgcucugaugcucccauugggacuuguuccucagaaugcauaacaccuaauggaaguaucccaaacgacaagcccuuucagaaugucaacaagauuaccuacggcgccuguccuaaauauguuaagcagaauacucucaaacuggcgacaggcaugcgaaacgugccagagaagcagaccagagggaucuucggagcaauagccgguuuuauugaaaauggcugggaggggaugaucgauggaugguacggcuucaggcaccaaaacagcgaggguacggggcaggcugccgaccuuaaauccacccaggcagcuaucgaucaaauuaauggcaagcugaaccggguaaucgagaaaacaaaugaaaaguuccaccagauugaaaaggaguuuucugaaguggagggacguauacaggacuuggagaaauaugucgaagauacuaagaucgaccucuggagcuacaacgccgagcuguuaguggcgcuggaaaaccagcauaccauugaucucacagacucagagaugaauaaacuuuucgaaaagacucgcagacaacugagggagaacgccgaggauaugggcaaugggugcuuuaaaaucuaucacaagugugacaacgcaugcaucggaaguauucggaaugguaccuacgaccaugauguuuaccgagacgaggcuuugaacaaucgcuuccagauaaagggcguggaacuaaaauccggguauaaggauuggauccuguggauuagcuuugccaucucuugcuuccuccugugugucgugcuucugggauuuauuaugugggcuugccagaaaggcaacaucagauguaauauaugcaucuga

SEQ ID NO: 122609 - RNA, 1701 nt, Artificial Sequence
  derived and/or modified sequence opt3 from hemagglutinin__InfluenzaA__ABC46576
augaagaccaucauugcccugagcuacauauucugccucguguuugcucagaaccuucccggcaaugacaaauccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucguggacgcucugcuuggggauccgcauugcgacggauuccagaacgagaagugggaucuguuugucgaacgguccaaagccuucucuaauuguuaucccuacgacgugccugauuaugcaucguugcgcucacucguugccagcaguggcacucuggaguuuaucaacgaauccuucaauuggacaggugugacccagucugggggaagcuacgcuugcaagcgaggcuccgacaacucauuuuucagucgucugaauuggcucuaugagagcgagucuaaguacccagucuuaaacgugacgaugcccaauaacggcaauuuugauaaacuguauauauggggaguacaccauccuuccacugacaaggaacaaaccaaccuuuacguuagagcaucagggagggugacagucagcacuaaacggagucagcagaccaucauuccaaacaucgguucucgccccugggugagaggcuuguccagcaggauuucgaucuacuggacaauagugaagccuggggauauucugcuaaucaauucuaacggaaaucucauugccccacggggcuauuucaaaauccgcaccgguaaguccucaaucaugcgaagugacgcuccgauugggacguguagcuccgagugcauaacucccaacggaucuaucccuaaugacaagccauuucagaacgucaauaaaauuacauacggcgccugucccaaguauguuaaacaaaacacccugaaacuugcgacuggcaugagaaaugugccugaaaagcagacaagggggaucuucggagcaauagccgguuuuauugagaacggcugggaggggaugguagauggaugguacggcuuccggcaccagaauagcgaagguaccgggcaggcugccgaccugaagucaacgcaagcagcuaucgaucagaucaacggcaaauugaaucgugugauugagaagaccaacgaaaaguuccaccagaucgagaaagaauuuagugaggucgagggacgcauucaagaccucgaaaaguauguggaggauacaaaaauagaccugugguccuacaaugccgaauuacugguugcgcucgagaaccagcauacuaucgaucuuaccgacagcgaaaugaacaagcuguucgagaaaacaagaaggcaguugcgggagaaugccgaagauaugggcaacgggugcuuuaagauuuaucacaagugugacaaugcaugcaucggaucuauccgaaacgguacuuacgaucaugacguguaccgcgacgaggcucuaaauaacagauuccagauuaaaggcgucgaacugaagucaggguauaaagauuggauacucuggaucaguuuugccauuagcugcuuccugcuuugugugguacuguugggauuuaucaugugggcuugccaaaagggcaauauuagguguaacaucugcauauga

SEQ ID NO: 122610 - RNA, 1701 nt, Artificial Sequence; identical to SEQ ID NO: 122468
  derived and/or modified sequence opt3 from hemagglutinin__InfluenzaA__ABC50167

SEQ ID NO: 122611 - RNA, 1701 nt, Artificial Sequence; identical to SEQ ID NO: 122468
  derived and/or modified sequence opt3 from hemagglutinin__InfluenzaA__ABC50178

SEQ ID NO: 122612 - RNA, 1701 nt, Artificial Sequence; identical to SEQ ID NO: 122468
  derived and/or modified sequence opt3 from hemagglutinin__InfluenzaA__ABC50189

SEQ ID NO: 122613 - RNA, 1701 nt, Artificial Sequence; identical to SEQ ID NO: 122578
  derived and/or modified sequence opt3 from hemagglutinin__InfluenzaA__ABC50200

SEQ ID NO: 122614 - RNA, 1701 nt, Artificial Sequence; identical to SEQ ID NO: 122578
  derived and/or modified sequence opt3 from hemagglutinin__InfluenzaA__ABC50211

SEQ ID NO: 122615 - RNA, 1701 nt, Artificial Sequence; identical to SEQ ID NO: 122578
  derived and/or modified sequence opt3 from hemagglutinin__InfluenzaA__ABC50222

SEQ ID NO: 122616 - RNA, 1701 nt, Artificial Sequence; identical to SEQ ID NO: 122578
  derived and/or modified sequence opt3 from hemagglutinin__InfluenzaA__ABC50233

SEQ ID NO: 122617 - RNA, 1701 nt, Artificial Sequence; identical to SEQ ID NO: 122578
  derived and/or modified sequence opt3 from hemagglutinin__InfluenzaA__ABC50244

SEQ ID NO: 122618 - RNA, 1701 nt, Artificial Sequence; identical to SEQ ID NO: 122578
  derived and/or modified sequence opt3 from hemagglutinin__InfluenzaA__ABC50266

SEQ ID NO: 122619 - RNA, 1701 nt, Artificial Sequence; identical to SEQ ID NO: 122578
  derived and/or modified sequence opt3 from hemagglutinin__InfluenzaA__ABC50277

SEQ ID NO: 122620 - RNA, 1701 nt, Artificial Sequence
  derived and/or modified sequence opt3 from hemagglutinin__InfluenzaA__ABC50299
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacagaauacucuuaagcuggccacaggaaugaggaacgugccugagaaacaaacccggggcaucuucggcgcuauagccggguuuauugaaaauggaugggaggguaugauggacggcugguacggguuccgucaccagaacucugagggaacuggccaggcagcugaucuaaagagcacacaagccgcgaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugccgagcuccuugucgcacuggaaaaccaacacaccaucgauuugacagacuccgagaugaacaagcuauucgaaagaacuaaaaagcagcugcgggagaaugcugaggauaugggcaacggaugcuuuaagauuuaucauaaaugugacaaugccugcaucggcagcauccgaaacgggaccuacgaucacgacguguaccgcgacgaagcucucaauaacagauuccagauuaagggaguugagcugaaaucugguuauaaggauugggugcuuuggauaucauuugccacaaguugcuuccuguuguguaucguccuccugggcuuuauuaugugggcaugccagaaagggaauaucagguguaacauuugcaucuga

SEQ ID NO: 122621 - RNA, 1701 nt, Artificial Sequence; identical to SEQ ID NO: 122578
  derived and/or modified sequence opt3 from hemagglutinin__InfluenzaA__ABC50310

SEQ ID NO: 122622 - RNA, 1701 nt, Artificial Sequence
  derived and/or modified sequence opt3 from hemagglutinin__InfluenzaA__ABC50321
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacagaauacucuuaagcuggccacaggaaugaggaacgugccuggcaaacaaacccggggcaucuucggggcuauagccggauuuauugagaaugguugggaaggcaugauggacgggugguacggauuccgucaccagaacucugagggcacuggucaggcagcugaucuaaagagcacacaagccgcgaucaaucagaucaacgggaaacucaaucgccugauugagaagaccaacgaaaaguuucaucagaucgagaaagaguucucagaaguagaaggcaggauucaggacuuagagaaguauguggaggauacgaaaauagaccuguggaguuacaaugccgaacuccuugucgcacuggagaaccaacacaccaucgauuugacagacuccgaaaugaacaagcuauucgagagaacuaaaaagcagcugcgggaaaaugcugaggauaugggaaacggcugcuuuaagauuuaucauaaaugugacaaugccugcaucgggagcauccgaaacggaaccuacgaucacgacguguaccgcgacgaggcucucaauaacagauuccagauuaaggguguugaacugaaaucuggcuauaaggauugggugcuuuggauaucauuugccaucaguugcuuccuguuguguauuguccuccugggguuuaucaugugggcaugccagaaaggaaauauuagguguaacaucugcauauga

SEQ ID NO: 122623 - RNA, 1701 nt, Artificial Sequence
  derived and/or modified sequence opt3 from hemagglutinin__InfluenzaA__ABC50332
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgggaagccauuucagaaugucaaccgaauuacguacggagcaugucccagauauguuaaacagaauacucuuaagcuggccacaggcaugaggaacgugccugagaaacaaacccggggcaucuucggggcuauagccggauuuauugaaaaugguugggagggcaugauggaugggugguacggauuccgucaccagaacucugagggcacuggucaggcagcugaccuaaagagcacacaagccgcgaucaaucagaucaacgggaaacucaaucgccugauugaaaagaccaacgagaaguuucaucagaucgaaaaagaguucucagaaguagagggcaggauucaggauuuagagaaguauguggaagacacgaaaauagaucuguggaguuacaaugccgagcuccuugucgcacuggaaaaccaacacaccaucgacuugacagauuccgagaugaacaagcuauucgaaagaacuaaaaagcagcugcgggagaaugcugaggacaugggaaacggcugcuuuaagauuuaucauaaaugugauaaugccugcaucgggagcauccgaaacggaaccuacgaccacgauguguaccgcgacgaagcucucaauaacagauuccagauuaaggguguugagcugaaaucuggcuauaaggacuggauacuuuggaucucauuugccauuaguugcuuccuguuguguaucgugcuccugggguuuauuaugugggcaugccagaaaggaaauaucagguguaacauaugcaucuga

SEQ ID NO: 122624 - RNA, 1701 nt, Artificial Sequence; identical to SEQ ID NO: 122578
  derived and/or modified sequence opt3 from hemagglutinin__InfluenzaA__ABC50343

SEQ ID NO: 122625 - RNA, 1701 nt, Artificial Sequence
  derived and/or modified sequence opt3 from hemagglutinin__InfluenzaA__ABC50354
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcuccugcaaacgccgaucagacaagagcuuuuucagucgucucaacugguuacaccagcugaaguauaaauacccagcucuuaaugucacgaugcccaacaaugagaaguuugauaaauuguauauauggggagugcaucacccuggcacugacucugaucagaucucccuguacgcacaggccucaggcagaguaaccguuagcacaaagaggagucaacagacugugauuccaaacaucgggucucggcccuggguccgcggaguguccagcagaauuucgaucuacuggaccauagugaaaccuggugacauucuacucaucaacucuacaggcaaucugauugcuccaaggggguauuucaagauccgguccggaaagucaaguaucaugcgcagcgacgccccgauuggcaaauguaacuccgaaugcauaacccccaaugguucuaucccuaacgauaagccauuucagaaugucaaccgaauuacguacggggcgugucccagauauguuaaacagaauacucuuaagcuggcaacaggaaugaggaacgugccugagaaacaaacccggggcaucuucggcgccauagcuggguuuauugaaaauggaugggaggguaugauggacggcugguacggguuccgucaccagaacagcgagggaacuggccaggccgcagauuugaagucaacacaagcugccaucaaucagaucaacgguaaacucaaucgccugauugaaaagaccaacgagaaguuucaucagaucgaaaaagaguucagugaaguagaggggaggauucaggacuuagagaaguauguggaagauacgaaaauagaccugugguccuacaaugcggagcuccuugucgcccuggaaaaccaacacaccaucgauuugacagacagcgagaugaacaagcuauucgaaagaacuaaaaagcagcugcgggagaaugcagaggauaugggcaacggaugcuuuaagauuuaucauaaaugugacaaugcuugcaucggcucuauccgaaacgggaccuacgaucacgacguguaccgcgacgaagcccucaauaacagauuccagauuaagggaguugagcugaaaucagguuauaaggauugggugcuuuggauaaguuuugcuaucagcugcuuccuguuguguauuguccuccugggcuuuaucaugugggccugccagaaagggaauauuagguguaacaucugcauauga

SEQ ID NO: 122626 - RNA, 1701 nt, Artificial Sequence
  derived and/or modified sequence opt3 from hemagglutinin__InfluenzaA__ABC50376
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaccgggagucggcccuggguccgcggagugucuuccagaaucagcauuuacuggacaaucgugaaaccuggugacauacuacucauuaacucgaccggcaaucugaucgccccaaggggguauuucaagauucggucuggaaaguccucaaucaugcgcagugacgcgccgaucggcaaauguaacagcgaaugcauuacgcccaaugguuccauaccuaacgauaagccauuucagaaugucaaccgaaucacuuacggggcaugucccagauauguuaaacagaauacacuuaagcuggccaccggaaugaggaacgugccugagaaacaaacucggggcauuuucggcgcuaucgccggguuuauagaaaauggaugggaggguaugauggacggcugguacggguuccgucaccagaacucugagggaacaggccaggcagcugaucuaaagagcacccaagccgcgauuaaucagaucaacgguaaacucaaucgccugaucgaaaagacgaacgagaaguuucaucagauugaaaaagaguucucagaaguagaggggagaauccaggacuuagagaaguauguggaagauaccaaaauugaccuguggaguuacaaugccgagcuccuugucgcacuggaaaaccaacacacaauagauuugacugacuccgagaugaacaagcuauucgaaaggaccaaaaagcagcugcgggagaaugcugaggauaugggcaacggaugcuuuaagaucuaucauaaaugugacaaugccugcauuggcagcauccgaaacgggacauacgaucacgacguguaccgcgacgaagcucucaauaacagauuccagaucaagggaguugagcugaaaucugguuauaaggauugggugcuuuggauuucauuugccauaaguugcuuccuguuguguaucguccuccugggcuuuauuaugugggcaugccagaaagggaauaucagguguaacauuugcaucuga

SEQ ID NO: 122627 - RNA, 1701 nt, Artificial Sequence
  derived and/or modified sequence opt3 from hemagglutinin__InfluenzaA__ABC50387
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauguguggggaguacaucacccuggcacugacagcgaucagauaucucuguacgcccaggcuuccggcagaguuaccgugucaacaaagaggagccaacagacugucaucccaaacauugggagucggcccugggugcgcggagugucuuccagaaucagcauuuacuggaccaucgucaaaccuggugacauacuacucauuaacucgacaggcaaucugaucgccccaaggggguauuucaagauucggucuggaaaguccucaaucaugcgcagugacgcgccgaucggcaaauguaacagcgaaugcauuacccccaaugguuccauaccuaacgauaagccauuucagaauguuaaccgaaucacguacggggcaugucccagauaugugaaacagaauacucuuaagcuggccacaggaaugaggaacguaccugagaaacaaacccggggcauuuucggcgcuaucgccggguuuauagaaaauggaugggaggguaugauggacggcugguacggguuccgucaccagaacucugagggaacuggccaggcagcugaucuaaagagcacacaagccgcgauuaaucagaucaacgguaaacucaaucgccugaucgaaaagaccaacgagaaguuucaucagauugaaaaagaguucucagaaguggaggggagaauccaggacuuagagaaguaugucgaagauacgaaaauugaccuguggaguuacaaugccgagcuccuuguggcacuggaaaaccaacacaccauagauuugacagacuccgagaugaacaagcuauucgaaaggacuaaaaagcagcugcgggagaaugcugaggauaugggcaacggaugcuuuaagaucuaucauaaaugugacaaugccugcauuggcagcauccgaaacgggaccuacgaucacgacguuuaccgcgacgaagcucucaauaacagauuccagaucaagggaguggagcugaaaucugguuauaaggauuggguccuuuggauuucauuugccauaaguugcuuccuguuguguaucgugcuccugggcuuuauuaugugggcaugccagaaagggaauaucagguguaacauuugcaucuga

SEQ ID NO: 122628 - RNA, 1701 nt, Artificial Sequence
  derived and/or modified sequence opt3 from hemagglutinin__InfluenzaA__ABC50409
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgugucguugaggucacucguugcaagcagugguacucuggaguuuaacaaugaauccuucaacuggacaggggugacccagaauggaacgucuagcgccugcaagcggcgcuccaacaauucauuuuucagucgacugaacuggcucacucauuuaaaguuuaaauauccagcucugaaugucaccaugcccaacaacgagaaguucgacaaacuuuacaucuggggcgugcaccauccuggcacagauaaugaccagauuagcuuguaugcacaggccucugggcguaucacuguauccaccaagagaucacaacagacaguuauuccaaacaucggaagcaggccccgggugcgcgauauaccuaguagaauuucuaucuacuggaccauugucaaaccaggugacauccugcuaaucaauuccacgggcaaccucauugcuccgaggggguacuuuaagauacggagcggaaagucgucuaucaugcgcuccgacgcccccauuggcaaauguaauucagagugcaucacuccuaacgguaguauaccaaaugauaagcccuuccagaacgugaaucgaauuacauauggggcguguccuagauacgugaaacagaacacccugaaacuugcaacuggaaugaggaaugucccagaaaagcaaacacggggcaucuuuggcgccaucgcuggguucauugagaacggaugggaagguaugguugacggcugguauggguuucgucaccagaauagcgagggaaucggccaggccgcagaucugaaguccacccaagcugccauuaaccagauaaaugguaaauugaaccgccucaucgggaagacgaacgagaaguuccaccagauugaaaaagaguucucugaaguggagggcagaauccaggaccuggaaaaguacguagaggauaccaaaaucgacuuauggagcuauaaugcggagcugcucguggcccuugaaaaccaacauacaauugaucugacugacucagagaugaauaaguuguuugaaaggaccaaaaagcagcuacgggagaacgcagaagauaugggaaauggcugcuucaagauauaccacaaaugugacaacgcuugcaucgggaguauucgaaauggaacauaugaucaugacgucuaccgcgacgaggcccugaacaauagauuucagaucaaggguguggagcucaaauccggcuacaaggauuggauucuguggaucagcuucgcuauaucuugcuuucuucuguguguugccuugcucggguucaucaugugggcaugccagaaaggaaacauuagguguaauaucugcauuuga

SEQ ID NO: 122629 - RNA, 1701 nt, Artificial Sequence; identical to SEQ ID NO: 122628
  derived and/or modified sequence opt3 from hemagglutinin__InfluenzaA__ABC50420

SEQ ID NO: 122630 - RNA, 1701 nt, Artificial Sequence
  derived and/or modified sequence opt3 from hemagglutinin__InfluenzaA__ABC54668
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucugggcccugggugcggggagucuccagccgcauuucgaucuacuggaccauagugaaaccuggugauauucuacucaucaauucuacaggcaaccugauugcgccaagaggguauuucaagaucagguccggaaagucaaguaucaugcggagcgacgcaccgauuggcaaauguaauuccgaaugcauaacccccaacgguucucuuccuaaugacaagccauuucagaacgugaaucgcaucacguacggggccuguccccgauaugucaaacagaacacucugaaguuggcuacaggaaugagaaauguuccugagaaacaaaccaggggcauuuucggcgccaucgcaggguuuauagaaaacggaugggaggguaugguggauggcugguacggguuccggcaccagaauagcgagggaacuggccaggcugccgaccucaagucaacacaagcggccauuaaccagaucaaugguaaacugaaccguuuaaucgaaaagaccaaugagaaguuucaucagauugaaaaagaguucagugaaguagaggggcgcauccaggaucuggagaaguauguggaagacacgaaaauugaucucugguccuacaacgcagagcuucuggucgcuuuggaaaaccaacacaccauagaccuaacagauagcgagaugaauaagcuguucgaaagaacuaaaaagcagcucagggagaacgccgaggacaugggcaauggaugcuuuaagaucuaucauaaaugugauaacgcuugcauuggcucuauccggaaugggaccuacgaccacgauguguaccgagacgaagcccugaacaaucgcuuccagaucaagggaguugagcuuaaaucagguuauaaggacuggauucuguggauaaguuuugcaaucagcugcuucuugcucugugugguccuguuaggcuuuauuaugugggccugccagaaagggaacaucagauguaauauuugcaucuga

SEQ ID NO: 122631 - RNA, 1701 nt, Artificial Sequence
  derived and/or modified sequence opt3 from hemagglutinin__InfluenzaA__ABC54679
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaccaacagguggcauuugcgacaguccgcaccagauccuagauggggagaauuguacccucauagacgcucugcuuggagauccccagugcgacggcuuucaaaacaaaaagugggaucuguucaucgaaagaagcaaagccuauuccaauuguuacccuuaugacgugccagauuacgcaucuuugaggucgcucgucgccucaagcgguacucuggaguuuaacaaugaaaguuucaacuggacaggggugacccagaauggaacguccucugcuugcaagcggcgcagcaacaauuccuuuuucucacgacugaacuggcucacucauuuaaaguuuaaauaucccgcacugaauguuaccaugccuaacaacgagaaguucgacaaacuuuacauuuggggcgugcaccauccaggcacagauaaugaccagaucaguuuguaugcccaggcuagcgggcguauuacugucucuaccaagagaucccaacagacagugauccccaacguaggaucaaggccucggguucgcgauauaccaagcagaauuaguaucuacuggaccauugugaaaccgggugacauccugcuaaucaauucuacgggcaaccucauugcccccaggggguacuuuaagauacgguccggaaagagcucgaucaugcgcucugacgcgccuauuggcaaauguaauuccgagugcaucacuccaaacgguucaauacccaaugauaagccuuuccagaacgucaaucgaauuacauauggggcauguccaagauacgugaaacagaacacccugaagcuggccacuggaaugaggaaugugcccgaaaaacaaacacggggcaucuuuggcgcuaucgccggguucauugagaacggaugggaagguauggucgacggcugguauggguuucgucaccagaauagugagggaaucggccaggcagcugaucuuaagagcacccaagccgcgauuaaccagauaaaugguaaauugaaccgccucaucgggaagacgaacgagaaguuccaccagauugaaaaagaguucuccgaaguugagggcagaauccaggaccuggaaaaguacguggaggauaccaaaaucgacuuauggucuuauaaugccgagcugcucguagcacuugaaaaccaacauacaauugaucugacugacagcgagaugaauaaguuguuugaaaggaccaaaaagcagcuacgggagaacgcugaagauaugggaaauggcugcuucaagauauaccacaaaugugacaacgccugcaucgggucaauucgaaauggaacauaugaucaugacguguaccgcgacgaggcucugaacaauagauuucagaucaagggugucgagcucaaaaguggcuacaaggauuggauucuguggaucuccuucgccauaagcugcuuucuucuguguguggcauugcucggguucaucaugugggccugccagaaaggaaacauuagguguaauaucugcauuuga

SEQ ID NO: 122632 - RNA, 1701 nt, Artificial Sequence; identical to SEQ ID NO: 122532
  derived and/or modified sequence opt3 from hemagglutinin__InfluenzaA__ABC67319

SEQ ID NO: 122633 - RNA, 1701 nt, Artificial Sequence
  derived and/or modified sequence opt3 from hemagglutinin__InfluenzaA__ABC67454
augaagaccaucauugcccugagcuacauacucugccuuguguucgcucaggagcugcccggcaacgacaauuccacagcaacuuuguguuuagggcaccaugccgucccuaacggaacgcugguuaaaaccaucacaaaugaucaaauugaagugacuaacgcgaccgagcuaguacagucuucaaguacagguagaaucugcgacagcccacaccagauucucgauggcgaaaauuguacccugaucgacgcucugcuuggggauccgcauugcgacggauuucagaacaaggagugggauuuguucguggaaagguccaaagccuauucuaauuguuaccccuaugacgucccugauuacgugucgcuccggucacugguugcaagcaguggcacucuggaguuuaacaaugaguccuucaacuggacagguguggcccaaaaugggaccucuagcgcuugcaagcgccgauccgacaaaucauuuuucagucgucucaacugguuacaccagcugaaguauaaguacccagcacuuaaugucacgaugcccaacaaugaaaaauuugauaaguuguauauauggggagugcaucacccuggcacugacagcgaucagaucucucuguacgcccaggcuuccggcagaguaaccguuucaacaaaaaggagccaacagacugugauuccaaacaucgggagucggcccuggguccgcggagugucuuccagaauuagcaucuacuggaccauagugaagccuggugacauucuacucaucaacucgacaggcaaucugauugccccaaggggguauuucaaaauccggucuggaaaguccucaaucaugcgcagugacgcgccgauuggcaaguguaacagcgagugcauaacccccaaugguuccaucccuaacgauaaaccauuucagaaugucaaccgaauuacguacggggcaugucccagauauguuaagcagaauacucuuaaacuggccacaggaaugaggaacgugccugaaaagcaaacccggggcaucuucggcgcuauagccggguuuauugagaauggaugggaggguaugauggacggcugguacggguuccgucaccagaacucugaaggaacuggccaggcagcugauuugaaaagcacacaagccgcgaucaaucagaucaacgguaagcucaaucgccugauugagaaaaccaacgaaaaguuucaucagaucgagaaggaguucucagaaguagaggggaggauucaggacuuagaaaaauauguggaggauacgaagauagaccuguggaguuacaaugccgaacuccuugucgcacuggagaaccaacacaccaucgauuugacagacuccgaaaugaacaaacuauucgagagaacuaagaaacagcugcgggagaaugcugaagauaugggcaacggaugcuuuaagauuuaucauaagugugacaaugccugcaucggcagcauccgaaacgggaccuacgaucacgacguguaccgcgacgaggcucucaauaacagauuccagauuaaaggaguugaacugaagucugguuauaaagauugggugcuuuggauaucauuugccaucaguugcuuccuguuguguauuguccuccugggcuuuaucaugugggcaugccagaaggggaauauuagguguaacaucugcauauga

SEQ ID NO: 122634 - RNA, 1701 nt, Artificial Sequence; identical to SEQ ID NO: 122578
  derived and/or modified sequence opt3 from hemagglutinin__InfluenzaA__ABC67471

SEQ ID NO: 122635 - RNA, 1701 nt, Artificial Sequence
  derived and/or modified sequence opt3 from hemagglutinin__InfluenzaA__ABC67554
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacagauaacgaccagaucucuuuguaugcccaggcuuccgggcguauuacugucucaaccaagagaagccaacagacagugaucccaaauauaggaaguaggccccggguacgcgauauuccuucuagaaucuccauuuacuggaccaucguuaagccaggugacauccugcuaauuaacagcacgggcaaucucauagccccgaggggguacuuuaaaauccggucgggaaagucuuccauuaugcgcucagacgcgcccaucgugaaguguaacagugaaugcauaacuccuaauggcagcauuccaaacgauaaacccuuccagaaugucaaccgaaucacauauggugcauguccuagauacgugaagcagaauacccugaaacuugccacugggaugaggaacgugccagagaagcaaacacggggaaucuuuggcgcuauugccggcuucaucgaaaaugggugggagggaauggucgacgguugguauggcuuucgucaccagaacuccgaggggauuggacaggcagcugaucugaaaucuacccaagccgcgauagaccagaucaauggcaaguugaaccgccucauugguaaaacgaaugaaaaguuccaccagaucgagaaggaauuuagcgagguugaagggagaauccaggaucuggagaaauacguggaggacaccaagauugauuuauggucauauaacgccgaacugcucguagcacuugagaaccaacauacaauagaccugacugauagugaaaugaauaaauuguuugagaggaccaagaaacagcuacgggaaaacgcugaggacaugggcaauggaugcuucaagaucuaccacaagugugauaacgccugcauuggcuccauccgaaaugggacauaugaccaugacguguaccgcgaugaggcucugaacaauagauuucagauuaaaggagucgaacucaagagcgguuacaaagacuggauccuguggauaucuuucgccaucucaugcuuucuucuguguguggcauugcucggcuucauuaugugggccugccagaaggggaacaucagguguaauauuugcaucuga

SEQ ID NO: 122636 - RNA, 1701 nt, Artificial Sequence
  derived and/or modified sequence opt3 from hemagglutinin__InfluenzaA__ABC67565
augaagaccaucauugcccugagcuacauauucugccucgugcuuggccaggacuuucccgggaacgauaauuccacagcuacucuguguuugggacaccaugcagucccuaacgguacguuaguuaaaaccaucacaaaugaccaaauugaggugacuaacgccaccgaacugguacagucuucaaguacaggcaagaucugcaauaacccacacaggauucuagaugggaucgacuguacccucauagaugcgcugcuuggagacccgcauugcgauggcuuccagaaugagacuugggaccuguuuguggaaagaagcaaggcuuucuccaacuguuaucccuacgaugucccugacuaugccucuuugcggucgcucguggcaucaagcgguacacuggaguuuaucaaugaaggguucaccuggacgggaguuacucagaacggcggcaguaaugccugcaaacgcgggccagauauuggauuuuucucccgacugaacuggcucuacaaaucugguagcaccuaucccguguuaaaugucacaaugccuaacaaugacaacuuugauaagcuguacaucuggggcgugcaccauccauccacugaccaagagcagaccucacuuuauguacaggcuagugggcguguuacagugagcaccaagagaucucagcaaacgauuauccccaacauaggauccaggccuuggguccggggcuugucaagccgcauuaguaucuacuggacuauugugaaaccaggugacauccuggugaucaauucuaacgggaaucuaauugcaccgagaggauacuucaagaugaggacaggcaaauccagcauaaugcggucggaugcccccaucggcaccuguauuucugagugcaucacuccuaacggguccauaccaaaugacaagcccuuucagaacgucaauaaaauuacauauggagcuuguccuaaguacguuaagcagaacacccucaaacuggccacggguaugcgcaaugugccagaaaagcagacccgaggccuuuucggggcgaucgcaggauuuaucgagaacggcugggaagguaugauugaugggugguauggcuucagacaccaaaauucagagggaacaggccaggccgcugaccugaaaaguacucaggccgcaaucgaucaaauuaacgggaaguugaauaggguaauagagaaaaccaacgaaaaguuccaccagaucgagaaagaauuuagcgagguggaaggacggauucaggaccucgagaaguacgucgaggauacaaagaucgaccugugguccuauaaugcugaauuacugguggcccucgagaaccagcauacuaucgaucuuaccgacucugaaaugaacaaacuguucgagaagacacgucgccaauugagagaaaaugcggaggauauggguaacggcugcuuuaaaauuuaccacaagugugacaaugccugcauagggagcaucaggaacggaaccuaugaccaugauguuuaccgggacgaggcacuaaauaaccgauuccagauuaaaggcguggaacugaagucagguuacaaggauuggauccucuggauuaguuuugcuaucuccugcuuccugcuuugugucgugcuguugggguuuauaaugugggccugccagaaaggcaauauccgcuguaacauuugcaucuga

SEQ ID NO: 122637 - RNA, 1701 nt, Artificial Sequence
  derived and/or modified sequence opt3 from hemagglutinin__InfluenzaA__ABC67576
augaagaccaucauugcccugagcuacauacucugccuuguguucgcucagaaacugcccggcaacgacaauuccauggcaacauuguguuuagggcaccaugccgucccuaacggaacucugguuaagacgaucaccaaugaucaaauugaggugacaaacgcgacugaacuuguacagucuucaaguaccgguagaaucugcgacagcccacacaggauucucgauggcgagaauuguacacugaucgacgcucuacugggggauccgcauugcgacggauuucagaacaaagaaugggauuuguucguggagcgguccaaggccuauucuaauuguuaccccuaugacgucccugauuacgcaucgcuccgcucacugguggccagcaguggcacccuggaauuuaacaaugaguccuucaacuggacugguguugcucagaaugggacaucuuaugcaugcaaacgacguagcauaaaguccuuuuucucaagacucaacugguuacaccaacugaaguacaaauauccagcccuuaaugugaccaugcccaacaaugacgaguuugauaaguuguacaucuggggaguccaucacccuaguacggacagcgaucagacuucucuguacgcucaggccuccggcagggugaccguaucaacaaaacggagccagcaaacuguuauuccaaacaucggcagucgccccugggugagaggggucucuuccaggauuagcaucuauuggaccauagugaagccuggagacauucuacucaucaacucgacagguaaucugauugcgccacggggcuacuucaaaauccgcucugggaaguccucaaucaugcgaagugacgcaccgauuggaaaguguaacagcgaaugcauaacccccaauggcuccaucccuaacgauaaaccauuucagaaugugaacagaauuacguauggugccugucccagguacgucaagcagaauacucuuaaacuggcuacagggaugcggaacguuccugagaagcagacccguggaaucuucggcgccauagcaggcuuuauugaaaaugggugggagggaaugguggacgguugguauggcuuccgccaccaaaacucugaggggacuggacaggcugccgauuugaaaagcacacaggcggccaucaaucaaaucaacggcaagcucaauagacugauugagaaaaccaacgaaaaguuucaucagaucgaaaaggaguucucagaaguagaggguaggauucaggacuuagagaaauacguggaagauacgaagauagaccuguggaguuauaaugcagagcuccuugucgcucuggaaaaccagcacaccaucgauuugacagacuccgagaugaacaaacuauucgaacggacucgaaagcaacugcgcgagaaugccgaggauauggggaacggcugcuuuaaaauuuaccauaagugugacaaugcuugcaucggaagcaucagaaacggcaccuacgaucacgacguguauagggacgaagcccucaauaaccgguuccagauuaaggggguugagcugaaaucuggauacaaggauuggauacuuuggaucucauuugcaauuaguugcuuccuguugugugugguccuccuggguuuuaucaugugggccugccagaaaggcaauauucgcuguaacaucugcauauga

SEQ ID NO: 122638 - RNA, 1701 nt, Artificial Sequence
  derived and/or modified sequence opt3 from hemagglutinin__InfluenzaA__ABC67587
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauaugggccuuguccaagauacgugaaacagaacacccugaaacuugcaacuggaaugaggaaugugcccgaaaagcaaacacggggcaucuuuggcgccaucgcuggguucauugagaacggaugggaagguauggucgacggcugguauggguuucgucaccagaauagcgagggaaucggccaggccgcagaucugaaguccacccaagcugccauuaaccagauaaaugguaaauugaaccgccucaucgggaagacgaacgagaaguuccaccagauugaaaaagaguucucugaaguugagggcagaauccaggaccuggaaaaguacguggaggauaccaaaaucgacuuauggagcuauaaugcggagcugcucguagcccuugaaaaccaacauacaauugaucugacugacucagagaugaauaaguuguuugaaaggaccaaaaagcagcuacgggagaacgcagaagauaugggaaauggcugcuucaagauauaccacaaaugugacaacgcuugcaucgggaguauucgaaauggaacauaugaucaugacguguaccgcgacgaggcccugaacaauagauuucagaucaagggugucgagcucaaauccggcuacaaggauuggauucuguggaucagcuucgcuauaucuugcuuucuucuguguguggccuugcucggguucaucaugugggcaugccagaaaggaaacauuagguguaauaucugcauuuga

SEQ ID NO: 122639 - RNA, 1701 nt, Artificial Sequence; identical to SEQ ID NO: 122259
  derived and/or modified sequence opt3 from hemagglutinin__InfluenzaA__ABC67598

SEQ ID NO: 122640 - RNA, 1701 nt, Artificial Sequence; identical to SEQ ID NO: 122578
  derived and/or modified sequence opt3 from hemagglutinin__InfluenzaA__ABC67609

SEQ ID NO: 122641 - RNA, 1701 nt, Artificial Sequence; identical to SEQ ID NO: 122578
  derived and/or modified sequence opt3 from hemagglutinin__InfluenzaA__ABC67620

SEQ ID NO: 122642 - RNA, 1701 nt, Artificial Sequence; identical to SEQ ID NO: 122578
  derived and/or modified sequence opt3 from hemagglutinin__InfluenzaA__ABC67631

SEQ ID NO: 122643 - RNA, 1701 nt, Artificial Sequence; identical to SEQ ID NO: 122578
  derived and/or modified sequence opt3 from hemagglutinin__InfluenzaA__ABC67642

SEQ ID NO: 122644 - RNA, 1701 nt, Artificial Sequence
  derived and/or modified sequence opt3 from hemagglutinin__InfluenzaA__ABC67653
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacagaauacucuuaagcuggccacaggaaugaggaacgugccugagaaacaaacccggggcaucuucggcgcuauagccggguuuauugaaaauggaugggaggguaugauggacggcugguacggguuccgucaccagaacucugagggaacuggccaggcagcugaucuaaagagcacacaagccgcgaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugccgagcuccuugucgcacuggaaaaccaacacaccaucgauuugacagacuccgagaugaacaagcuauucgaaagaacuaaaaagcagcugcgggagaaugcugaggauaugggcaacggaugcuuuaagauuuaucauaaaugugacaaugccugcaucggcagcauccgaaacgggaccuacgaucacgacguguaccgcgacgaagcucucaauaacagauuccagauuaagggaguugagcugaaaucugguuauaaggauugggugcuuuggauaucauuugccaucaguugcuuccuguugugugucgugcuccugggcuuuauuaugugggcaugccagaaagggaauaucagguguaacauuugcaucuga

SEQ ID NO: 122645 - RNA, 1701 nt, Artificial Sequence
  derived and/or modified sequence opt3 from hemagglutinin__InfluenzaA__ABC67697
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaagagugggaucuguucguggaaagauccaaggccuauucuaauuguuaccccuaugacgucccugauuacgcaucguugaggucacucguggccagcaguggcacucuggaguuuaacaaugaguccuucaacuggacagguguuacccagaaugggacgucuagcgcuugcaaacggcgcuccaacaauucauuuuucagucgacugaacuggcucacucauuuaaaguuuaaguauccagcacugaaugugaccaugcccaacaacgaaaaauucgacaaguuguacaucuggggaguccaccauccuggcacagauaaugaccagauuuuucuuuaugcccaggcuagcggccguaucacugugucuaccaaaagaucccaacagacaguaauuccaaacaucgggucaaggccccggguucgcaauauaccuagcagaauuaguaucuacuggaccauugugaagccaggagauauccugcuaaucaacucuacggguaaucucauugccccgaggggcuacuucaaaauacgguccggaaagagcucgaucaugcgcucugacgcgcccauugggaaguguaacuccgagugcaucacuccuaauggcucaauaccaaacgacaaacccuuucagaaugucaaccgaauuacauauggugcauguccuagauacgugaagcagaauacccugaaacuugccacugggaugaggaacgugccagaaaagcaaacacggggaaucuucggcgcuaucgccggcuuuauugagaaugggugggagggaauggucgaugguugguauggcuuccgucaccagaacagugaagggaucggacaggcagcugaccugaaaagcacccaagccgcgauuaaucagauaaacggcaaguugaaccgccucaucgguaaaacgaaugagaaguuccaccagauugaaaaggaguuuuccgaaguugaggggagaauccaggaucuggagaaauacguggaagacaccaagaucgauuuauggucuuauaacgccgagcugcucguagcacuugaaaaucaacauacaauugaccugacugauagcgagaugaacaaauuguucgaaaggaccaagaaacagcuacgggagaaugcugaggacaugggcaacggaugcuuuaagauauaccacaagugugauaaugccugcaucggcucaauucgaaacgggacauaugaccaugauguguaccgcgacgaagcucugaauaacagauuccagaucaaaggagucgagcucaagagugguuacaaagacuggauucuguggaucuccuuugccauaagcugcuuccuucuguguguggcauugcucggcuuuaucaugugggccugccagaaggggaauauuagguguaacaucugcauuuga

SEQ ID NO: 122646 - RNA, 1701 nt, Artificial Sequence
  derived and/or modified sequence opt3 from hemagglutinin__InfluenzaA__ABC67708
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguacguggaggacaccaaaaucgauuuauggucuuauaacgccgagcugcucguagcacuugaaaaucaacauacaauugaccugacugauagcgagaugaacaaguuguucgaaaggaccaaaaagcagcuacgggagaaugcugaagacaugggaaacggcugcuuuaagauauaccacaaaugugauaaugccugcaucgggucaauucgaaacggaacauaugaccaugauguguaccgcgacgaggcucugaauaacagauuccagaucaagggugucgagcucaaaaguggcuacaaggacuggauucuguggaucuccuuugccauaagcugcuuccuucuguguguggcauugcucggguuuaucaugugggccugccagaaaggaaauauuagguguaacaucugcauuuga

SEQ ID NO: 122647 - RNA, 1701 nt, Artificial Sequence; identical to SEQ ID NO: 122646
  derived and/or modified sequence opt3 from hemagglutinin__InfluenzaA__ABC67719

SEQ ID NO: 122648 - RNA, 1701 nt, Artificial Sequence; identical to SEQ ID NO: 122646
  derived and/or modified sequence opt3 from hemagglutinin__InfluenzaA__ABC67733

SEQ ID NO: 122649 - RNA, 1701 nt, Artificial Sequence
  derived and/or modified sequence opt3 from hemagglutinin__InfluenzaA__ABC67806
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggguacgcgacauuccuucuagaaucuccauuuacuggaccaucguuaagccaggugauauccugcuaauuaacagcacgggcaaucucauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccugaaacuugccacuggaaugaggaacgugccagagaagcaaacacggggcaucuuuggcgcuauugccggguucaucgaaaauggaugggaggguaugguggauggcugguacggguuucgucaccagaacuccgagggaauuggccaggcagcugaccugaaaucuacccaagccgcgauagaucagaucaaugguaaguugaaccgccucauugggaaaacgaaugaaaaguuccaccagaucgagaaggaauuuagcgaggucgaaggcagaauccaggaccuggagaaauauguugaggauaccaagauugacuuauggucauacaacgccgaacugcucguggcacuugagaaccaacauacaauagaucugacugacagugaaaugaauaaauuguuugagaggaccaagaaacagcuacgggaaaacgcugaggauaugggaaauggcugcuucaagaucuaucacaagugugacaacgccugcauuggguccauccgaaauggaacauacgaucaugacguauaccgcgacgaggcucugaacaauagauuucagauuaaagguguggaacucaagagcggcuauaaagauuggauccuguggauaucuuucgccaucucaugcuuucuucugugugucgcauugcucggguucauuaugugggccugccagaagggaaacaucagguguaauauuugcaucuga

SEQ ID NO: 122650 - RNA, 1701 nt, Artificial Sequence; identical to SEQ ID NO: 122532
  derived and/or modified sequence opt3 from hemagglutinin__InfluenzaA__ABC67817

SEQ ID NO: 122651 - RNA, 1701 nt, Artificial Sequence; identical to SEQ ID NO: 122646
  derived and/or modified sequence opt3 from hemagglutinin__InfluenzaA__ABC67828

SEQ ID NO: 122652 - RNA, 1701 nt, Artificial Sequence; identical to SEQ ID NO: 122510
  derived and/or modified sequence opt3 from hemagglutinin__InfluenzaA__ABC67839

SEQ ID NO: 122653 - RNA, 1701 nt, Artificial Sequence
  derived and/or modified sequence opt3 from hemagglutinin__InfluenzaA__ABC67850
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccugggcccgcggagucucuuccagaauuagcauccacuggaccauagugaaaccuggugacauucuacucaucaacucgacaggcaaucugauugcgccaaggggguacuucaagauccggucuggaaaguccucaaucaugcgcagugacgcaccgauuggcaaauguaacagcgaaugcauaacccccaaugguuccaucccuaacgauaagccauuucagaaugugaaccgaauuacguauggggccugucccagauacgucaaacagaauacucuuaagcuggcuacaggaaugaggaacguuccugagaaacaaacccggggcaucuucggcgccauagcaggguuuauugaaaauggaugggaggguaugauggacggcugguauggguuccgucaucagaacucugagggaacuggccaggcugccgaucuaaagagcacacaagcggccaucaaucagaucaacgguaaacucaaucgccugauugaaaagaccaacgagaaguuucaccagaucgaaaaagaguucucagaaguggaggggaggauucaggacuuagagaaguacguagaagauacgaaaauagaccuguggaguuauaaugcagagcuccuuguggcucuggaaaaccaacauaccaucgauuugacagacuccgagaugaacaagcuauucgaaagaacuaaaaagcagcugcgggagaaugccgaggauaugggcaacggaugcuuuaagauuuaccacaaaugugacaaugcuugcaucggcagcauccgaaacgggaccuaugaucacgacgucuaccgcgacgaagcccucaauaacagauuccagauuaagggaguggagcugaaaucugguuacaaggauuggguucuuuggauaucauuugcaaucaguugcuuccuguuguguauugugcuccugggcuuuaucaugugggccugccagaaagggaauauuagguguaacaucugcauauga

SEQ ID NO: 122654 - RNA, 1701 nt, Artificial Sequence; identical to SEQ ID NO: 122510
  derived and/or modified sequence opt3 from hemagglutinin__InfluenzaA__ABC67861

SEQ ID NO: 122655 - RNA, 1701 nt, Artificial Sequence; identical to SEQ ID NO: 122578
  derived and/or modified sequence opt3 from hemagglutinin__InfluenzaA__ABC67883

SEQ ID NO: 122656 - RNA, 1701 nt, Artificial Sequence
  derived and/or modified sequence opt3 from hemagglutinin__InfluenzaA__ABC67894
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucaguaagcucaacugguuacaccagcugaaauauaaguacccagcacuuaaugucacgaugcccaacaaugagaaauuugauaaguuguauauauggggagugcaucacccuggcacugacagcgaucagaucucucuguacgcccaggcuuccggccguguaaccguuucaacaaaaagaagccaacagacugugauuccaaacaucgggaguaggcccuggguccggggagugucuucccgcauuagcaucuacuggaccauagugaagccuggugacauucuacucaucaacucgacaggcaaucugauugccccaagaggguauuucaagaucaggucuggaaaauccucaaucaugcggagugacgcgccgauuggcaaguguaacagcgaaugcauaacccccaaugguuccaucccuaacgauaaaccauuucagaaugucaaccgcauuacguacggggcauguccccgauauguuaagcagaauacucuuaaacuggccacaggaaugagaaacgugccugagaagcaaaccaggggcaucuucggcgcuauagccggguuuauugaaaauggaugggaggguaugauggacggcugguacggguuccggcaccagaacucugagggaacuggccaggcagcugauuugaaaagcacacaagccgcgaucaaucagaucaacgguaagcucaaucgucugauugaaaagaccaacgagaaauuucaucagaucgaaaaggaguucucagaaguagaggggcgcauucaggacuuagagaaauauguggaagauacgaagauagaccuguggaguuacaaugccgagcuccuugucgcacuggaaaaccaacacaccaucgauuugacagacuccgagaugaacaaacuauucgaaagaacuaagaagcagcugagggagaaugcugaggauaugggcaacggaugcuuuaaaauuuaucauaagugugacaaugccugcaucggcagcauccggaacgggaccuacgaucacgacguguaccgagacgaagcucucaauaaccgcuuccagauuaaaggaguugagcugaagucugguuauaaagauugggugcuuuggauaucauuugccaucaguugcuuccuguuguguauuguccuccugggcuuuaucaugugggcaugccagaaggggaauauuagauguaacaucugcauauga

SEQ ID NO: 122657 - RNA, 1701 nt, Artificial Sequence; identical to SEQ ID NO: 122578
  derived and/or modified sequence opt3 from hemagglutinin__InfluenzaA__ABC67967

SEQ ID NO: 122658 - RNA, 1701 nt, Artificial Sequence; identical to SEQ ID NO: 122578
  derived and/or modified sequence opt3 from hemagglutinin__InfluenzaA__ABC67978

SEQ ID NO: 122659 - RNA, 1701 nt, Artificial Sequence
  derived and/or modified sequence opt3 from hemagglutinin__InfluenzaA__ABC67989
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaggucacgaugcccaauaacgagaaauuugauaaguuguauauauggggagugcaucacccuggcacugacagcgaucagaucucucuguacgcccaggcuuccggcagaguaaccguuucaacaaaaaggagccaacagacugugauuccaaauaucgggagucggcccuggguccgcggagugucuuccagaauuagcaucuacuggaccauagugaagccuggugacauucuacucaucaacucgacaggcaaccugauugccccaaggggguauuucaagauccggucuggaaaauccucaaucaugcgcagugacgcgccgauuggcaaguguaauagcgaaugcauaacccccaacgguuccaucccuaaugauaaaccauuucagaacgucaaucgaauuacguacggggcaugucccagauauguuaagcagaacacucuuaaacuggccacaggaaugaggaaugugccugagaagcaaacccggggcaucuucggcgcuauagccggguuuauugaaaacggaugggaggguaugauggacggcugguacggguuccgucaccaaaauucugagggaacuggccaggcagcugauuugaaaagcacacaggccgcgaucaaccagaucaaugguaagcucaaccgccugauugaaaagaccaaugagaaauuucaucagaucgaaaaggaguucucagaaguagaggggaggauucaggacuuagagaaauauguggaagauacgaagauagaccuguggaguuacaacgccgagcuccuugucgcacuggaaaaucaacacaccaucgauuugacagacuccgagaugaacaaacuauucgaaagaacuaagaagcagcugcgggagaacgcugaggauaugggcaauggaugcuuuaaaauuuaucauaagugugacaacgugugcaucggcagcauccgaaaugggaccuacgaucacgacguuuaccgcgacgaagcccucaacaauagauuccagauuaaaggaguggagcugaagucugguuauaaagauuggguccuuuggauaucauuugcuaucaguugcuuccuguuguguauugugcuccugggcuuuaucaugugggccugccagaaggggaacauuagguguaauaucugcauauga

SEQ ID NO: 122660 - RNA, 1701 nt, Artificial Sequence; identical to SEQ ID NO: 122633
  derived and/or modified sequence opt3 from hemagglutinin__InfluenzaA__ABC68000

SEQ ID NO: 122661 - RNA, 1701 nt, Artificial Sequence
  derived and/or modified sequence opt3 from hemagglutinin__InfluenzaA__ABC68049
augaagaccaucauugcccugagcuacauacucugccuuguguucgcucagaaacugcccggcaacgacaauuccacagcaacuuuguguuuagggcaccaugccgucccuaacggaacgcugguuaagaccaucacagaugaccaaauugaggugacuaaugcgaccgaacuuguacagucuucaaguacagguagaaucugcgauagcccacaccagauucucgacggcgagaacuguacccugaucgaugcucuacugggggacccgcauugcgauggauuucagaauaaagaaugggacuuguucguggagagguccaaggccuauucuaacuguuaccccuaugaugucccugacuacgugucgcuccggucacugguugcaagcaguggcacucuggaauuuaauaacgaguccuucaauuggacagguguggcccaaaacgggaccucuagcgcuugcaaacgccgauccgauaagucauuuuucagucgucucaauugguuacaccagcugaaguauaaauacccagcacuuaacgucacgaugcccaauaacgagaaguuugacaaauuguauguguggggaguacaucacccuggcacugauagcgaccagauaucucuguacgcccaggcuuccggcagaguuaccgugucaacaaagaggagccaacagacugucaucccaaauauugggagucggcccugggugcgcggagugucuuccaaaaucagcauuuacuggaccaucgucaagccuggugacauacuacucauuaacucgacaggcaaccugaucgccccaagaggguauuucaagauuaggucuggaaaauccucaaucaugcggagugaugcgccgaucggcaaguguaauagcgaaugcauuacccccaacgguuccauaccuaaugacaaaccauuucagaacguuaaucgcaucacguacggggcauguccccgauaugugaagcagaacacucuuaaacuggccacaggaaugagaaauguaccugagaagcaaaccaggggcauuuucggcgcuaucgccggguuuauagaaaacggaugggaggguaugauggauggcugguacggguuccggcaccaaaauucugagggaacuggccaggcagcugacuugaaaagcacacaggccgcgauuaaccagaucaaugguaagcucaaccgucugaucgaaaagaccaaugagaaauuucaucagauugaaaaggaguucucagaaguggaggggcgcauccaggauuuagagaaauaugucgaagacacgaagauugaucuguggaguuacaacgccgagcuccuuguggcacuggaaaaucaacacaccauagacuugacagauuccgagaugaacaaacuauucgaaagaacuaagaagcagcugagggagaacgcugaggacaugggcaauggaugcuuuaaaaucuaucauaagugugauaacgccugcauuggcagcauccggaaugggaccuacgaccacgacguuuaccgagaugaagcucucaacaaucgcuuccagaucaaaggaguggagcugaagucugguuauaaagacuggguccuuuggauuucauuugccauaaguugcuuccuguuguguaucgugcuccugggcuuuauuaugugggcaugccagaaggggaacaucagauguaauauuugcaucuga

SEQ ID NO: 122662 - RNA, 1701 nt, Artificial Sequence; identical to SEQ ID NO: 122578
  derived and/or modified sequence opt3 from hemagglutinin__InfluenzaA__ABC68060

SEQ ID NO: 122663 - RNA, 1701 nt, Artificial Sequence
  derived and/or modified sequence opt3 from hemagglutinin__InfluenzaA__ABC68071
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacagaauacucuuaagcuggccacaggaaugaggaacgugccugagaaacaaacccggggcaucuucggcgcuauagccggguuuauugaaaauggaugggaggguaugauggacggcugguacggguuccgucaccagaacucugagggaacuggccaggcagcugaucuaaagagcacacaagccgcgaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugccgagcuccuugucgcacuggaaaaccaacacaccaucgauuugacagacuccgagaugaacaagcuauucgaaagaacuaaaaagcagcugcgggagaaugcugaggauaugggcaacggaugcuuuaagauuuaucauaaaugugacaaugccugcaucggcagcauccgaaacgggaccuacgaucacaauguguaccgcgacgaagcucucaacaauagauuccagauuaagggaguugagcugaaaucugguuauaaggacugggugcuuuggauaucauuugccaucaguugcuuccuguuguguauuguccuccugggcuuuaucaugugggcaugccagaaagggaacauuagguguaauaucugcauauga

SEQ ID NO: 122664 - RNA, 1701 nt, Artificial Sequence; identical to SEQ ID NO: 122646
  derived and/or modified sequence opt3 from hemagglutinin__InfluenzaA__ABC68082

SEQ ID NO: 122665 - RNA, 1701 nt, Artificial Sequence
  derived and/or modified sequence opt3 from hemagglutinin__InfluenzaA__ABC68093
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaguaaccguuagcacaaagaggagucaacagacugugauuccaaacaucggcucucggcccuggguccgcgggguguccagcauuaucucgauauacuggaccauugugaaaccuggagacauccuacucauuaacucuacagguaaucugaucgccccaagaggcuauuucaagaucagguccgggaagucaaguauuaugcggagcgacgcgccgauaggaaaauguaacuccgaaugcaucacccccaauggcucuauuccuaacgguaagccauuucagaaugucaaccgcaucacguacggggcauguccccgauauguuaaacagaauacucuuaagcuggccacaggaaugagaaacgugccugagaaacaaaccaggggcauauucggcgcuauugccggguuuaucgaaaauggaugggaggguaugauggauggcugguacggguuccggcaccagaacagcgagggaacuggccaggcagcugacuugaagucaacacaagccgcgaucaaucagauuaacgguaaacucaaucgucugaucgaaaagaccaacgagaaguuucaucagauugaaaaagaguucagugaaguagaggggcgcauacaggauuuagagaaguauguggaagacacgaaaaucgaucugugguccuacaaugccgagcuccuugucgcacuggaaaaccaacacaccauugacuugacagauagcgagaugaacaagcuauucgaaagaacuaaaaagcagcugagggagaaugcugaggacaugggcaacggaugcuuuaagaucuaucauaaaugugauaaugccugcaucggcucuauucggaacgggaccuacgaccacgauguguaccgagacgaagcucucaauaaccgcuuccagauaaagggaguugagcugaaaucagguuauaaggacuggauccuuuggauuaguuuugccacaagcugcuuccuguuguguaucgugcuccugggcuuuauuaugugggcaugccagaaagggaauaucagauguaacauaugcaucuga

SEQ ID NO: 122666 - RNA, 1701 nt, Artificial Sequence
  derived and/or modified sequence opt3 from hemagglutinin__InfluenzaA__ABC68222
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucuacacaagcggccaucaaccagaucaaugguaaacucaaccgucugauugaaaagaccaaugagaaguuucaucagaucgaaaaagaguucucagaaguagaggggcgcauucaggauuuagagaaguauguggaagacacgaaaauagaucuguggaguuacaacgcagagcuccuugucgcucuggaaaaccaacacaccaucgacuugacagauuccgagaugaauaagcuauucgaaagaacuaaaaagcagcugagggagaacgccgaggacaugggcaauggauguuuuaagauuuaucauaaaugcgauaacgcuugcaucggcagcauccggaaugggaccuacgaccacgauguguaccgagacgaagcccucaacaaucgcuuccagauuaagggaguugagcugaaaucugguuauaaggacuggauacuuuggaucucauuugcaauuaguuguuuccuguugugcgugguccuccugggcuuuaucaugugggccugucagaaagggaacauuagaugcaauaucuguauauga

SEQ ID NO: 122667 - RNA, 1701 nt, Artificial Sequence; identical to SEQ ID NO: 122458
  derived and/or modified sequence opt3 from hemagglutinin__InfluenzaA__ABC68233

SEQ ID NO: 122668 - RNA, 1707 nt, Artificial Sequence
  derived and/or modified sequence opt3 from hemagglutinin__InfluenzaA__ABC72655
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaagccgaaccccgcgaaugaucuuugcuacccuggggacuucaacgauuaugaggaacugaagcauuugcucagcaggaucaaucacuuugagaaaauucagaucauuccaaaguccucuuggucgucacaugaagcuagcgucggagugaguuccguaugucccuaccagggcaaaucuagcuucuuucggaacguuguguggcugaucaagaaaaauuccacauauccuacuauaaagcgcucauacaacaauaccaaccaagaggaccugcucgucuuaugggguauucaccacccaaaugaugccgcagagcagacaaagcuguaucagaaccccaccacuuacaucaguguggggacaagcacccuuaaccagcgauuggugccucguauugccacgagaucuaaagucaauggacaauccggcaggauggaguucuuuuggacuauccugaagccaaacgacgcuaucaauuucgaaucaaacggcaauuuuauugcaccggaauacgccuauaaaauaguuaagaaaggggauagcaccaucaugaagagugagcuagaauacggaaacugcaauacaaaaugucagacucccaugggugcuauuaacucuuccaugccuuuccauaauauccacccacucaccauaggcgagugccccaaguaugugaaaagcaaccggcugguacuugccacagggcugcgcaauucgccucagagagagaaaaggcggaagaaacgcggauuguuuggcgcgauugcagguuucaucgaagggggauggcagggcaugguggacggcugguacggguaucaucacucuaacgagcaaggauccgguuacgccgcugacaaggaaucaacccagaaagccaucgauggcgucacgaauaaggugaacaguauuaucgacaagaugaauacucaguuugaggcaguugggcgagaguucaacaaccucgaaagaaggauugagaaucugaacaaaaagauggaagauggauucuuagacguguggacauauaaugcugagcugcucguccuuauggaaaacgagcggacccuggauuuucacgacagcaaugugaaaaacuuguacgauaagguacgucuacaacugcgcgacaaugccaaagaacucggcaacgguuguuucgaguuuuaccauaagugcgauaaugaguguauggaauccguuagaaacgggacuuaugacuacccacaguauucugaggaagcgaggcugaagcgggaggagauaagcggcgugaaacuugaaucaaucggaauuuaccagauccugaguaucuauuccacagucgccagcucuuuggcacucgcuauuaugguggccggccugucauuauggaugugcaguaaugggagccugcagugccgaauauguaucuga

SEQ ID NO: 122669 - RNA, 1701 nt, Artificial Sequence; identical to SEQ ID NO: 122259
  derived and/or modified sequence opt3 from hemagglutinin__InfluenzaA__ABC84400

SEQ ID NO: 122670 - RNA, 1701 nt, Artificial Sequence; identical to SEQ ID NO: 122468
  derived and/or modified sequence opt3 from hemagglutinin__InfluenzaA__ABC84411

SEQ ID NO: 122671 - RNA, 1701 nt, Artificial Sequence
  derived and/or modified sequence opt3 from hemagglutinin__InfluenzaA__ABC84433
augaagaccaucauugcccugagcuacauacucugccuuguguucgcucagaaacugcccggcaacgacaauagaacagcaacuuuguguuuagggcaccaugccgucccuaacggaacgaucguuaagaccauuacaaaugaucaaaucgaggugacuaacgcgaccgaacugguacaguccucuucaacagguggcauuugcgacaguccacaccagauccuagauggggagaauuguacccucauagacgcucugcuuggagauccgcagugcgacggcuuucaaaacaaaaagugggaucuguucguggaaaggagcaaagccuauuccaauuguuaccccuaugacgucccugauuacgcaucuuugcggucgcucguggccucaagcgguacucuggaguuuaacaaugaaaguuucaacuggacagggguuacccagaauggaacguccucugcuugcaagcgccgaagcaacaauuccuuuuucucacgucugaacuggcucacucauuuaaaguuuaaauauccagcacugaaugugaccaugcccaacaacgagaaguucgacaaacuuuacaucuggggcguccaccauccuggcacaaauaacgaucagauuaguuuguaugcccaggcuagcgggagaaucacugugucuaccaagaggucccaacagacaguaauuccaaauaucggaucacggccccgcguuagagacauaccuagcaggauuaguaucuacuggaccauugugaaaccaggugauauccugcuaaucaacucuacgggcaaucucauugccccgcggggguacuuuaagauacgcuccggaaagagcucgaucaugcgaucugacgcgcccauuggcaaauguaacuccgagugcaucacuccuaaugguucaauaccaaacgacaagcccuuccagaaugucaacagaauuacauauggggcauguccuagguacgugaaacagaauacccugaagcuggccacuggaaugcggaacgugccagaaaaacaaacacguggcaucuuuggcgcuaucgccggguucauugagaauggaugggaagguauggucgauggcugguauggguuucgccaccagaacagugagggaaucggccaggcagcugaccuuaagagcacccaagccgcgauuaaucagauaaacgguaaauugaacagacucaucgggaagacgaaugagaaguuccaccagauugaaaaagaguucuccgaaguugagggcaggauccaggaucuggaaaaguacguggaggacaccaaaaucgauuuauggucuuauaacgccgagcugcucguagcacuugaaaaucaacauacaauugaccugacugauagcgagaugaacaaguuguuugaacggaccaaaaagcagcuacgagagaaugcugaagacaugggaaacggcugcuucaagauauaccacaaaugugauaaugccugcaucgggucaauucgcaacggaacauaugaccaugauguguacagagacgaggcucugaauaacagguuucagaucaagggugucgagcucaaaaguggcuacaaggacuggauucuguggaucuccuucgccauaagcugcuuucuucuguguguggcauugcucggguucaucaugugggccugccagaaaggaaauauucgguguaacaucugcauuuga

SEQ ID NO: 122672 - RNA, 1701 nt, Artificial Sequence; identical to SEQ ID NO: 122578
  derived and/or modified sequence opt3 from hemagglutinin__InfluenzaA__ABC84444

SEQ ID NO: 122673 - RNA, 1701 nt, Artificial Sequence; identical to SEQ ID NO: 122649
  derived and/or modified sequence opt3 from hemagglutinin__InfluenzaA__ABC84498

SEQ ID NO: 122674 - RNA, 1701 nt, Artificial Sequence; identical to SEQ ID NO: 122649
  derived and/or modified sequence opt3 from hemagglutinin__InfluenzaA__ABC84509

SEQ ID NO: 122675 - RNA, 1701 nt, Artificial Sequence
  derived and/or modified sequence opt3 from hemagglutinin__InfluenzaA__ABC84520
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcgauauaccuagcagaauuaguaucuacuggaccauugugaaaccaggugacauccugcuaaucaauucuacgggcaaccucauugccccgaggggguacuucaagauacgguccggaaagagcucgaucaugcgcucugacgcgcccauuggcaaauguaauuccgagugcaucacuccuaacgguucaauaccaaaugauaagcccuuucagaacgucaaucgaauuacauauggggcauguccuagauacgugaaacagaacacccugaagcuggccacuggaaugaggaaugugccagaaaaacaaacacggggcaucuucggcgcuaucgccggguuuauugagaacggaugggaagguauggucgacggcugguauggguuccgucaccagaauagugagggaaucggccaggcagcugaucuuaagagcacccaagccgcgauuaaccagauaaaugguaaauugaaccgccucaucgggaagacgaacgagaaguuccaccagauugaaaaagaguuuuccgaaguugagggcagaauccaggaccuggaaaaguacguggaggauaccaaaaucgacuuauggucuuauaaugccgagcugcucguagcacuugaaaaccaacauacaauugaucugacugacagcgagaugaauaaguuguucgaaaggaccaaaaagcagcuacgggagaacgcugaagauaugggaaauggcugcuuuaagauauaccacaaaugugacaacgccugcaucgggucaauucgaaauggaacauaugaucaugacguguaccgcgacgaggcucugaacaauagauuccagaucaagggugucgagcucaaaaguggcuacaaggauuggauucuguggaucuccuuugccauaagcugcuuccuucuguguguggcauugcucggguuuaucaugugggccugccagaaaggaaacauuagguguaauaucugcauuuga

SEQ ID NO: 122676 - RNA, 1701 nt, Artificial Sequence
  derived and/or modified sequence opt3 from hemagglutinin__InfluenzaA__ABC84531
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacgcuugcaagcgaggcagcgugaacuccuuuuucucacgucugaauuggcucuaugagagugagagcaaguacccagcauuaaacgucacgaugcccaauaacgggagauuugacaaacuguauaucuggggagugcaccauccuucuacugauaaggaacaaaccaaucuuuacguaagggccgcuggucggguuacaguguccacuaaacgcucacagcagaccgucauuccaaacaucggcagcagacccugggugaggggguugaguucucggauuuccaucuacuggacaauagugaagccuggagacauucugcuaaucaacagcaccggcaaucucauugccccacgcgguuauuucaaaauccgaacggggaagucgucuaucaugagauccgaugcgccgauuggaacuuguucaagugagugcauaacacccaacggcagcaucccuaaugacaagccauuucagaacgucaauaaaauuaccuacggcgcaugucccagguauguuaagcaaaacacucugaaacuugccacagggaugcggaaugugccugaaaagcagacccguggaaucuucggugcuauagccggcuuuauugagaacgggugggagggaaugguagacggcugguacgguuuccgccaccaaaauuccgaagggacgggccaggcagcugaucugaaaucuacccaggccgcgaucgaccagaucaacggaaaguugaauagacucauugagaaaacaaacgaaaaguuccaccagaucgagaaggaauuuagcgagguggagggcaggauucaagaucuggaaaaauaugucgaggacacuaagauagauuuauggucauacaaugccgaacugcucguggcacuugagaaccagcauaccaucgaccugacagauagugaaaugaauaaauuguucgagaagacucggaaacagcuacgagagaacgcugaagacauggggaacggaugcuuuaagauuuaucacaagugugauaaugccugcaucgguuccauccgcaacggcaccuacgaccaugauguuuacagagacgaggcucugaauaacagguuccagauuaaagggguggaacucaagagcggauauaaagacuggauacuguggaucucuuuugccauuucaugcuuccuucugugugucguguugcucggcuuuaucaugugggcaugccaaaaggguaauauucgguguaacaucugcauauga

SEQ ID NO: 122677 - RNA, 1701 nt, Artificial Sequence; identical to SEQ ID NO: 122666
  derived and/or modified sequence opt3 from hemagglutinin__InfluenzaA__ABC84560

SEQ ID NO: 122678 - RNA, 1701 nt, Artificial Sequence
  derived and/or modified sequence opt3 from hemagglutinin__InfluenzaA__ABC84571
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauuaucgauggggagaauuguacccucauagacgcucugcuuggagauccgcauugcgacggcuuucagaacaaagaaugggaucuguucguggagagauccaaggccuauucuaauuguuaccccuaugacgucccugauuacgcaucguugaggucacucguggccagcagugguacucuggaauuuaacaaugaguccuucaacuggacagggguugcucaaaauggaaccucuagcgcaugcaaacggcgcuccaacaagucauuuuucagucgacugaauuggcuccaccaguuaaaguauaaauacccagcccugaacgugacgaugcccaauaacgagaaguuugacaaacuuuauaucuggggcguccaucacccuagcacugauucugaccagauuuccuuguacgcucaggccccaggccgugugaccguaucaacaaagagaagccaacagacuguuauccccaacauugggaguaggccuugggugcggggagucucuucccgcaucagcauauacuggaccauugugaaaccaggugauauccugcuaauuaauuguacaggcaaccucaucgcgccgagaggguauuucaagaucaggucgggaaagucuuccauuaugcggucagacgcaaguauaggcaaaugcaauagcgaauguaucacccccaacgguuccauuccuaaugacaagccauuucagaacgugaaucgcaucacguacggggccugcccccgauaugucaaacagaacacucugaagcuagcuacaggaaugagaaauguuccugagaaacaaaccaggggcauauucggcgccauugcaggguuuaucgaaaacggaugggaggguaugguggauggcugguacggguuccggcaccagaauagcgagggaacuggccaggcugccgaccugaagucuacacaagcggccaucaaccagauuaaugguaaauugaaccgucucaucgaaaagaccaaugagaaguuucaucagauugaaaaagaguucucagaaguagaggggcgcauacaggaucuggagaaguauguggaagacacgaaaaucgauuuauggaguuacaacgcagagcugcucgucgcucuugaaaaccaacacaccauugaccugacagauuccgagaugaauaaguuguucgaaagaacuaaaaagcagcuaagggagaacgccgaggacaugggcaauggauguuuuaagaucuaucauaaaugcgauaacgcuugcaucggcagcauucggaaugggaccuacgaccacgauguguaccgagacgaagcccugaacaaucgcuuccagauaaagggaguugagcucaaaucugguuauaaggacuggauccuguggauuucauuugcaaucaguuguuuccuucugugcguggucuugcucggcuuuauuaugugggccugucagaaagggaacaucagaugcaauauauguaucuga

SEQ ID NO: 122679 - RNA, 1701 nt, Artificial Sequence; identical to SEQ ID NO: 122666
  derived and/or modified sequence opt3 from hemagglutinin__InfluenzaA__ABC85754

SEQ ID NO: 122680 - RNA, 1701 nt, Artificial Sequence; identical to SEQ ID NO: 122646
  derived and/or modified sequence opt3 from hemagglutinin__InfluenzaA__ABC85765

SEQ ID NO: 122681 - RNA, 1701 nt, Artificial Sequence
  derived and/or modified sequence opt3 from hemagglutinin__InfluenzaA__ABC85776
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuucacaggcaaccugauugcgccgagaggguauuuuaagaucaggucgggaaagucuuccaucaugcggucagacgcaaguauuggcaaauguaauagcgaaugcauaacccccaacgguuccaucccuaaugacaagccauuccagaacgugaaucgcauuacguacggggccuguccccgauaugucaaacagaacacucuuaagcuggcuacaggaaugagaaauguuccugagaaacaaaccaggggcaucuuuggcgccauagcaggguucauugaaaacggaugggaggguaugguggauggcugguacggguuucggcaccagaauagcgagggaacuggccaggcugccgacuugaagucuacacaagcggccaucaaccagaucaaugguaaacucaaccgucugauugaaaagaccaaugagaaguuccaucagaucgaaaaagaguucucagaaguagaggggcgcauucaggauuuagagaaguauguggaagacacgaaaauagaucuguggaguuacaacgcagagcuccuugucgcucuggaaaaccaacacaccaucgacuugacagauuccgagaugaauaagcuauuugaaagaacuaaaaagcagcugagggagaacgccgaggacaugggcaauggaugcuucaagauuuaucauaaaugugauaacgcuugcaucggcagcauccggaaugggaccuacgaccacgauguguaccgagacgaagcccucaacaaucgcuuucagauuaagggaguugagcugaaaucugguuauaaggacuggauacuuuggaucucauucgcaauuaguugcuuucuguugugugugguccuccugggcuucaucaugugggccugccagaaagggaacauuagauguaauaucugcauauga

SEQ ID NO: 122682 - RNA, 1701 nt, Artificial Sequence; identical to SEQ ID NO: 122666
  derived and/or modified sequence opt3 from hemagglutinin__InfluenzaA__ABC85787

SEQ ID NO: 122683 - RNA, 1701 nt, Artificial Sequence; identical to SEQ ID NO: 122649
  derived and/or modified sequence opt3 from hemagglutinin__InfluenzaA__ABC85798

SEQ ID NO: 122684 - RNA, 1701 nt, Artificial Sequence; identical to SEQ ID NO: 122646
  derived and/or modified sequence opt3 from hemagglutinin__InfluenzaA__ABC85820

SEQ ID NO: 122685 - RNA, 1701 nt, Artificial Sequence; identical to SEQ ID NO: 122646
  derived and/or modified sequence opt3 from hemagglutinin__InfluenzaA__ABC85831

SEQ ID NO: 122686 - RNA, 1701 nt, Artificial Sequence; identical to SEQ ID NO: 122649
  derived and/or modified sequence opt3 from hemagglutinin__InfluenzaA__ABC85842

SEQ ID NO: 122687 - RNA, 1701 nt, Artificial Sequence; identical to SEQ ID NO: 122646
  derived and/or modified sequence opt3 from hemagglutinin__InfluenzaA__ABC85853

SEQ ID NO: 122688 - RNA, 1701 nt, Artificial Sequence; identical to SEQ ID NO: 122646
  derived and/or modified sequence opt3 from hemagglutinin__InfluenzaA__ABC85864

SEQ ID NO: 122689 - RNA, 1701 nt, Artificial Sequence; identical to SEQ ID NO: 122649
  derived and/or modified sequence opt3 from hemagglutinin__InfluenzaA__ABC85886

SEQ ID NO: 122690 - RNA, 1701 nt, Artificial Sequence; identical to SEQ ID NO: 122578
  derived and/or modified sequence opt3 from hemagglutinin__InfluenzaA__ABC85908

SEQ ID NO: 122691 - RNA, 1701 nt, Artificial Sequence
  derived and/or modified sequence opt3 from hemagglutinin__InfluenzaA__ABC85919
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacagaauacucuuaagcuggccacaggaaugaggaacgugccugagaaacaaacccggggcaucuucggcgcuauagccggguuuauugaaaauggaugggaggguaugauggacggcugguacggguuccgucaccagaacucugagggaacuggccaggcagcugaucuaaagagcacacaagccgcgaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugccgagcuccuugucgcacuggaaaaccaacacaccaucgauuugacagacuccgagaugaacaagcuauucgaaagaacuaaaaagcagcugcgggagaaugcugaggauaugggcaacggaugcuuuaagauuuaucauaaaugugacaaugccugcaucggcagcauccgaaacgggaccuacgaucacgacguguaccgcgacgaagcucucaauaacagauuccagauuaagggaguugagcugaaaucugguuauaaggauugggugcuuuggauaucauuugccaucaguugcuuccuguuguguauuguccucaugggcuuuaucaugugggcaugccagaaagggaauauuagguguaacaucugcauauga

SEQ ID NO: 122692 - RNA, 1701 nt, Artificial Sequence; identical to SEQ ID NO: 122578
  derived and/or modified sequence opt3 from hemagglutinin__InfluenzaA__ABC85930

SEQ ID NO: 122693 - RNA, 1701 nt, Artificial Sequence; identical to SEQ ID NO: 122627
  derived and/or modified sequence opt3 from hemagglutinin__InfluenzaA__ABC85941

SEQ ID NO: 122694 - RNA, 1701 nt, Artificial Sequence
  derived and/or modified sequence opt3 from hemagglutinin__InfluenzaA__ABC85952
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaaaagugggauuuguucguggaaagguccaaagccuauucuaauuguuaccccuaugacgucccugauuacgugucgcuccggucacugguugcaagcaguggcacucuggaguuuaacaaugaauccuucaacuggacagguguggcccaaaaugggaccucuagcgcuugcaagcgccgauccgacaagucauuuuucagucgucucaacugguuacaccagcugaaauauaaguacccagcacuuaaugucacgaugcccaacaaugagaaauuugauaaguuguauauauggggagugcaucacccuggcacugacagcgaucagaucucucuguacgcccaggcuuccggcagaguaaccguuucaacaaaaaggagccaacagacugugauuccaaacaucgggagucggcccuggguccgcggagugucuuccagaauuagcaucuacuggaccauagugaagccuggugacauucuacucaucaacucgacaggcaaucugauugccccaaggggguauuucaagauccggucuggaaaauccucaaucaugcgcagugacgcgccgauuggcaaguguaacagcgagugcauaacccccaaugguuccaucccuaacgauaaaccauuucagaaugucaaccgaauuacguacggggcaugucccagauauguuaagcagaauacucuuaaacuggccacaggaaugaggaacgugccugaaaagcaaacccggggcaucuucggcgcuauagccggguuuauugagaauggaugggaagguaugauggacggcugguacggguuccgucaccauaacucugagggaacuggccaggcagcugauuugaaaagcacacaggccgcgaucaaucaaaucaacgguaagcucaaucgccugauugagaagaccaacgaaaaauuucaccagaucgagaaggaguucucagaaguagaagggaggauucaggacuuagagaaauauguggaggauacgaagauagaccuguggaguuacaaugccgaacuccuugucgcacuggagaaccagcauaccaucgauuugacagacuccgaaaugaacaaacuauucgagagaacuaagaagcaacugcgggaaaaugcugaggauaugggcaacggaugcuuuaaaauuuaucacaagugugacaaugccugcaucggcagcauccgaaacgggaccuacgaucacgacguguaccgcgacgaggcucucaauaacagauuccagauuaaaggaguugaacugaagucugguuauaaagauugggugcuuuggauaucauuugccaucaguugcuuccuguuguguauuguccuccugggcuuuaucaugugggcaugccagaaggggaauauuagguguaacaucugcauauga

SEQ ID NO: 122695 - RNA, 1701 nt, Artificial Sequence; identical to SEQ ID NO: 122578
  derived and/or modified sequence opt3 from hemagglutinin__InfluenzaA__ABC85974

SEQ ID NO: 122696 - RNA, 1701 nt, Artificial Sequence; identical to SEQ ID NO: 122578
  derived and/or modified sequence opt3 from hemagglutinin__InfluenzaA__ABC85985

SEQ ID NO: 122697 - RNA, 1701 nt, Artificial Sequence
  derived and/or modified sequence opt3 from hemagglutinin__InfluenzaA__ABC85996
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguaugauggacggcugguauggguuucgucaccagaauagcgagggaaucggccaggcagcugaucugaaguccacccaagccgcgauuaaccagauaaaugguaaauugaaccgccucaucgggaagacgaacgagaaguuccaccagauugaaaaagaguucucugaagucgagggcagaauccaggaccuggaaaaguacguugaggauaccaaaaucgacuuauggagcuauaaugccgagcugcucguggcacuugaaaaccaacauacaauugaucugacugacucagagaugaauaaguuguuugaaaggaccaaaaagcagcuacgggagaacgcugaagauaugggaaauggcugcuucaagauauaccacaaaugugacaacgccugcaucgggaguauucgaaauggaacauaugaucaugacguauaccgcgacgaggcucugaacaauagauuucagaucaaggguguggagcucaaauccggcuacaaggauuggauucuguggaucagcuucgccauaucuugcuuucuucugugugucgcauugcucggguucaucaugugggccugccagaaaggaaacauuagguguaauaucugcauuuga

SEQ ID NO: 122698 - RNA, 1701 nt, Artificial Sequence; identical to SEQ ID NO: 122259
  derived and/or modified sequence opt3 from hemagglutinin__InfluenzaA__ABC86007

SEQ ID NO: 122699 - RNA, 1701 nt, Artificial Sequence
  derived and/or modified sequence opt3 from hemagglutinin__InfluenzaA__ABC86018
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguaccauaaucgacgcucuccugggagauccgcagugcgacggcuuucaaaacaaaaagugggaucuuuucguggaaagauccaaagccuauucuaauuguuaccccuaugacgucccugauuacgcaucgcugaggucauugguggccagcagugguacucucgaguuuaacaaugaauccuucaacuggacagggguuacccagaauggaacgucuagcgcuugcaagcggcgcuccaacaauucauuuuucagucgacugaacuggcugacucaucucaaguuuaaauauccagcauuaaaugugaccaugcccaacaacgagaaguucgacaaacuguacauuuggggcguccaccauccuggcacagauaaugaccagaucagccuuuaugcccaggcuucugggcguauuacuguguccaccaagagaucacaacagacaguaaucccaaacauaggaagcaggccccggguucgcgauauuccuaguagaaucucuauuuacuggaccaucgugaaaccaggugacaucuugcugauuaauuccacgggcaaccuaauagccccgaggggguacuuuaagauccggagcggaaagucgucuauuaugcgcuccgacgcgcccaucggcaaauguaauucagagugcauaacuccuaacgguaguauuccaaaugauaagcccuuccagaacgucaaucgaaucacauauggggcauguccuagauacgugaaacagaacacccucaagcuggccacuggaaugaggaaugugccagaaaaacaaacacggggcaucuuuggcgcuauugccggguucaucgagaacggaugggaagguauggucgacggcugguauggguuucgucaccagaauagcgagggaauuggccaggcagcugaucuuaaguccacccaagccgcgauaaaccagaucaaugguaaacugaaccgcuugauugggaagacgaacgagaaguuccaccagaucgaaaaagaguucucugaaguugagggcagaauccaggaccucgaaaaguacguggaggauaccaaaauugaccuguggagcuauaaugccgaguuacugguagcacucgaaaaccaacauacaauagaucuuacugacucagagaugaauaagcuguuugaaaggaccaaaaagcaguugcgggagaacgcugaagauaugggaaauggcugcuucaagaucuaccacaaaugugacaacgccugcauugggaguauccgaaauggaacauaugaucaugacguguaccgcgacgaggcucuaaacaauagauuucagauuaagggugucgagcugaaauccggcuacaaggauuggauccucuggaucagcuucgccauaucuugcuuucugcuuuguguggcacuguugggguucauuaugugggccugccagaaaggaaacaucagguguaauauuugcaucuga

SEQ ID NO: 122700 - RNA, 1701 nt, Artificial Sequence; identical to SEQ ID NO: 122259
  derived and/or modified sequence opt3 from hemagglutinin__InfluenzaA__ABC86029

SEQ ID NO: 122701 - RNA, 1701 nt, Artificial Sequence; identical to SEQ ID NO: 122298
  derived and/or modified sequence opt3 from hemagglutinin__InfluenzaA__ABC86040

SEQ ID NO: 122702 - RNA, 1701 nt, Artificial Sequence; identical to SEQ ID NO: 122532
  derived and/or modified sequence opt3 from hemagglutinin__InfluenzaA__ABC86124

SEQ ID NO: 122703 - RNA, 1701 nt, Artificial Sequence; identical to SEQ ID NO: 122609
  derived and/or modified sequence opt3 from hemagglutinin__InfluenzaA__ABC86137

SEQ ID NO: 122704 - RNA, 1701 nt, Artificial Sequence
  derived and/or modified sequence opt3 from hemagglutinin__InfluenzaA__ABC97374
augaagaccaucauugcccugagcuacauauucugccucgugcuuggccaggacuuucccgggaacgauaauuccacagcuacucuguguuugggacaccaugcagucccuaacgguacguuaguuaaaaccaucacaaaugaccaaauugaggugacuaacgccaccgaacugguacagucuucaaguacaggcaagaucugcaauaacccacacaggauucuagaugggaucgacuguacccucauagaugcgcugcuuggagacccgcauugcgauggcuuccagaaugagacuugggaccuguuuguggaaagaagcaaggcuuucuccaacuguuaucccuacgaugucccugacuaugccucuuugcggucgcucguggcaucaagcgguacacuggaguuuaucaaugaaggguucaccuggacgggaguuacucagaacggcggcaguaaugccugcaaacgcgggccagauuccggauuuuucucucgacugaacuggcucuacaaaagcgguuccaccuaucccguguuaaaugucacaaugccuaacaaugacaacuuugauaagcuguacauuuggggcgugcaccauccaucaacugaccaagagcagaccagucuuuauguacaggcuagcgggcguguuacagugucuaccaagagaucccagcaaacgaucauucccaacaucggaucaaggccuuggguccggggcuugagcagucgcauaucuauuuacuggacuaucgugaaaccaggugacauucuggugaucaauuccaacgggaaucuaaucgcaccgagaggauacuucaagaugaggacaggcaaaagcucgauuaugcggucugaugcccccauaggcaccuguaucuccgagugcauuacuccuaacgggucaaucccaaaugacaagcccuuucagaacgucaauaaaauaacauauggagcuuguccuaaguacguuaagcagaacacccucaaacuggccacggguaugcgcaaugugccagaaaagcagacccgaggccuuuucggggcgauugcaggauuuaucgagaacggcugggaagguaugguagaugggugguauggcuucagacaccaaaauagugagggaacaggccaggccgcugaccugaaaagcacucaggccgcaaucgaucaaauuaacgggaaguugaauagggugaucgagaaaaccaacgaaaaguuccaccagauugagaaagaauuuuccgaggucgaaggacggauacaggaccucgagaaguacguggaggauacaaagaucgaccuguggucuuauaaugcugaauuacugguugcccucgagaaccagcauacuauugaucuuaccgacagcgaaaugaacaaacuguucgagaagacacgucgccaauugagagaaaaugcggaggauauggguaacggcugcuuuaggaucuaccacaaaugugacaaugccugcaucgggucaauucggaacggaaccuaugaccaugauguguaccgagacgaggcacuaaauaaccgcuuccagauaaagggcgucgaacugaaaagugguuacaaggauuggauccucuggauuuccuuugcuaucagcugcuuccugcuuugugugguacuguugggguuuauuaugugggccugccagaagggcaauaucagauguaacauaugcaucuga

SEQ ID NO: 122705 - RNA, 1701 nt, Artificial Sequence; identical to SEQ ID NO: 122048
  derived and/or modified sequence opt3 from hemagglutinin__InfluenzaA__ABD15449

SEQ ID NO: 122706 - RNA, 1701 nt, Artificial Sequence
  derived and/or modified sequence opt3 from hemagglutinin__InfluenzaA__ABD15460
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccauaucagauacuagauggggagaauuguacccucaucgacgcucugcuuggagauccgcagugcgacggcuuucaaaacaaaaagugggaucuguucguggaaagaagcaaagccuacuccaauuguuaucccuacgacgucccugauuaugcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucacuuaaaauacaaguauccagcacugaaugugaccaugcccaacaaugagaaauuugauaaacuuuacauuuggggcguccaucacccuggcacagacagugaucagaucagcuuguacgcccaggcuucugggcguauuacuguguccaccaagagaucacaacagacaguaaucccaaacauaggaagcaggccccggguucgcgacgugaguucuagaauuuccaucuauuggaccauugucaagccuggugacauccugcuaaucaacagcacgggcaaucucauugccccaaggggguacuucaagauacggucgggaaaaucuuccaucaugcgcucagaugcgccgauuggcaaguguaacagugagugcaucacucccaaugguagcauaccuaacgacaaaccauuucagaaugugaaccgaauuacauauggggcaugucccagauacgugaagcagaauacccugaaacuugccacuggaaugaggaacgucccugaaaagcaaacacggggcaucuucggcgcuaucgccggguuuauugagaauggaugggaagguaugguugauggcugguauggguuccgucaucagaacuccgagggaaccggccaggcagcugaccugaaaucuacgcaagccgcgaucaaucagauuaacgguaaguugaaucgccucauagggaagaccaacgagaaauuucaccagaucgaaaaggaguucagcgaaguggagggcaggauucaggaucuggaaaaauacguagaggacacaaagaucgauuuauggucauauaaugccgagcugcucguggcacuugaaaaccaacacacuaucgaccugaccgauagugagaugaacaaauuguucgaaagaacaaagaagcagcuacgggagaaugcugaagacaugggaaacggcugcuuuaaaauuuaccauaagugugauaaugccugcauaggguccauccgaaacggaacuuacgaccacgacgucuaucgcgaugaggcucugaauaacagauuccagauuaaagguguggagcucaagagcggcuacaaagacuggauccuguggauuucuuuugccaucucaugcuuccuucuguguguugcauugcucggguuuauaaugugggccugccagaagggaaauaucagguguaacauuugcaucuga

SEQ ID NO: 122707 - RNA, 1701 nt, Artificial Sequence; identical to SEQ ID NO: 122048
  derived and/or modified sequence opt3 from hemagglutinin__InfluenzaA__ABD15471

SEQ ID NO: 122708 - RNA, 1701 nt, Artificial Sequence; identical to SEQ ID NO: 122048
  derived and/or modified sequence opt3 from hemagglutinin__InfluenzaA__ABD15482

SEQ ID NO: 122709 - RNA, 1701 nt, Artificial Sequence; identical to SEQ ID NO: 122706
  derived and/or modified sequence opt3 from hemagglutinin__InfluenzaA__ABD15493

SEQ ID NO: 122710 - RNA, 1701 nt, Artificial Sequence; identical to SEQ ID NO: 122259
  derived and/or modified sequence opt3 from hemagglutinin__InfluenzaA__ABD15526

SEQ ID NO: 122711 - RNA, 1701 nt, Artificial Sequence; identical to SEQ ID NO: 122468
  derived and/or modified sequence opt3 from hemagglutinin__InfluenzaA__ABD15537

SEQ ID NO: 122712 - RNA, 1701 nt, Artificial Sequence; identical to SEQ ID NO: 122468
  derived and/or modified sequence opt3 from hemagglutinin__InfluenzaA__ABD15548

SEQ ID NO: 122713 - RNA, 1701 nt, Artificial Sequence; identical to SEQ ID NO: 122486
  derived and/or modified sequence opt3 from hemagglutinin__InfluenzaA__ABD15559

SEQ ID NO: 122714 - RNA, 1701 nt, Artificial Sequence; identical to SEQ ID NO: 122468
  derived and/or modified sequence opt3 from hemagglutinin__InfluenzaA__ABD15570

SEQ ID NO: 122715 - RNA, 1701 nt, Artificial Sequence; identical to SEQ ID NO: 122486
  derived and/or modified sequence opt3 from hemagglutinin__InfluenzaA__ABD15581

SEQ ID NO: 122716 - RNA, 1701 nt, Artificial Sequence; identical to SEQ ID NO: 122468
  derived and/or modified sequence opt3 from hemagglutinin__InfluenzaA__ABD15592

SEQ ID NO: 122717 - RNA, 1701 nt, Artificial Sequence; identical to SEQ ID NO: 122468
  derived and/or modified sequence opt3 from hemagglutinin__InfluenzaA__ABD15603

SEQ ID NO: 122718 - RNA, 1701 nt, Artificial Sequence; identical to SEQ ID NO: 122468
  derived and/or modified sequence opt3 from hemagglutinin__InfluenzaA__ABD15614

SEQ ID NO: 122719 - RNA, 1701 nt, Artificial Sequence
  derived and/or modified sequence opt3 from hemagglutinin__InfluenzaA__ABD15625
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuucccagauaagcauuuacuggaccaucgucaagccuggugacauucugcuaaucaacucgacgggcaaucucaucgccccaagaggguauuucaagauuaggucuggaaaauccucaauaaugcggagugaugcgccgaucggcaaguguaacagcgagugcauuacucccaaugguuccaucccuaacgacaaaccauuucagaaugugaaccgcauaacauacggggcauguccccgauaugugaagcaaaauacccugaaacuugccacuggaaugagaaacgucccugaaaagcagacaaggggcauuuucggcgcuaucgccggguuuaucgagaauggaugggaagguaugguugauggcugguacggguuccggcaccagaacucugagggaaccggccaagcagcugaccugaaaagcacgcaggccgcgauuaaucagaucaacgguaaguugaaucgucucauugggaagaccaacgagaaauuucaccagauagaaaaggaguucucagaaguggagggccgcauccaagaucugguaaaauauguggaagacacaaagauugauuuauggaguuacaaugccgagcugcucgucgcacuugagaaccagcauacuaucgaccugaccgauuccgaaaugaacaaauuguucgagagaacaaagaagcagcuaagggaaaaugcugaggacaugggaaacggcugcuuuaaaaucuaucacaagugugauaaugccugcauugggagcauacggaacggaacuuacgaccaugacguguaccgagaugaagcucugaauaaccgcuuccagaucaaagguguugagcucaagucuggcuauaaagacuggauucuguggaucucauuugccauuaguugcuuccuucuguguguggcauugcucggguuuaucaugugggccugccaaaagggaaauauaagauguaacaucugcauuuga

SEQ ID NO: 122720 - RNA, 1701 nt, Artificial Sequence; identical to SEQ ID NO: 122486
  derived and/or modified sequence opt3 from hemagglutinin__InfluenzaA__ABD15636

SEQ ID NO: 122721 - RNA, 1701 nt, Artificial Sequence; identical to SEQ ID NO: 122666
  derived and/or modified sequence opt3 from hemagglutinin__InfluenzaA__ABD15680

SEQ ID NO: 122722 - RNA, 1701 nt, Artificial Sequence
  derived and/or modified sequence opt3 from hemagglutinin__InfluenzaA__ABD15691
augaagaccaucauugcccugagcuacauacucugccuuguguucgcucagaaacugcccgucaacgacaaguccacagcaacuuuguguuuaggccaccaugccguuccuaaugggacgcuggugaaaaccaucacaaacgaucacauugagguaacuaaugcgaccgaauuggugcaaucuucaccaacaggaagaaucugcgacaguccgcaucagauucucgauggugagaacuguacccugaucgacgcccuucugggcgauccccacugcgacggguuucagaauaaggaaugggauuuguucgucgagaggagcacugcuuauuccaacuguuacccuuaugacgugccagauuacgcaucucuccggucgcugguugccucaagcggaacacuggaauuuaauaacgagaguuucaauuggaccggcguggcucagaacgguacguccucugcaugcaaacgccgaagcauaaaguccuuuuucucacgucucaauugguuacaucaacugaaguauaaauaccccgcccuuaacgucacuaugccuaauaacgagaaguuugacaaauuguauaucuggggagugcaccacccaaguaccgauagcgaccagauuucucuguacgcucaggccuccgggagaguaacaguuucaacuaagaggagccagcaaaccgugauccccaauauuggcagucggccuuggguccgcggcgugucuuccagaaucagcauauacuggacaauugugaaaccaggggauauccuacucauuaacucgaccggaaaccugaucgcgccgagggguuauuucaagauccggucuggcaaguccucaauuaugcgcaguaaugcacccauagggaaauguaacagcgaaugcaucacgccuaauggauccauuccaaacgacaagcccuuucagaaugucaaccgaaucacuuacggcgccuguccuagauauguuaaacagaauacacuuaagcuggcuaccgguaugaggaacgugccagagaaacagacucgggggauauucggagccauugcaggcuuuaucgaaaauggcugggaggggaugguagacggaugguacgguuuccgucaucaaaacucugagggcacagggcaggcugccgaucuaaagagcacccaggcggccaucaaucaaauuaacggaaaacucaaucgccugaucgaaaagacgaacgagaaguuucaccagauugaaaaagaguucucagaaguggagggcagaauacaggacuuagagaaguaugucgaagauaccaaaaucgaccuguggaguuacaaugcagagcuccuuguggcucuggaaaaccagcauacaauugauuugacugacuccgagaugaacaagcuauucgaaaggacccggaaacaacugcgagagaaugccgaggauauggguaacgggugcuuuaagaucuaucacaagugugacaaugcuugcaucggcagcauucgcaacggaacauacgaucacgacguuuacagagaugaagcccucaauaacagguuccagauaaaaggcguggagcugaagucuggguauaaagacuggauccuuuggauuucauuugcaaucaguugcuuccuguugugugucgugcuccugggauuuauuaugugggccugccagaaggguaauauccgguguaacauaugcaucuga

SEQ ID NO: 122723 - RNA, 1701 nt, Artificial Sequence
  derived and/or modified sequence opt3 from hemagglutinin__InfluenzaA__ABD15702
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaccucccuguacgcucaggccccaggccgugugacaguaucaacuaagagaagccaacagaccguuauccccaacauugggaguaggccuugggugcggggagucucuucccgcaucagcauuuacuggacaaucgugaaaccaggugauauacuacucauuaauuguaccggcaaccugaucgcgccgagaggguauuucaagauuaggucgggaaagucuuccaucaugcggucagacgcaaguaucggcaaaugcaauagcgaauguauuacgcccaacgguuccauaccuaaugacaagccauuucagaacgugaaucgcaucacuuacggggccugcccccgauaugucaaacagaacacacuuaagcuggcuaccggaaugagaaauguuccugagaaacaaacuaggggcauuuucggcgccaucgcaggguuuauagaaaacggaugggaggguaugguggauggcugguacggguuccggcaccagaauagcgagggaacaggccaggcugccgacuugaagucuacccaagcggccauuaaccagaucaaugguaaacucaaccgucugaucgaaaagacgaaugagaaguuucaucagauugaaaaagaguucucagaaguagaggggcgcauccaggauuuagagaaguauguggaagacaccaaaauugaucuguggaguuacaacgcagagcuccuugucgcucuggaaaaccaacacacaauagacuugacugauuccgagaugaauaagcuauucgaaagaaccaaaaagcagcugagggagaacgccgaggacaugggcaauggauguuuuaagaucuaucauaaaugcgauaacgcuugcauuggcagcauccggaaugggacauacgaccacgauguguaccgagacgaagcccucaacaaucgcuuccagaucaagggaguugagcugaaaucugguuauaaggacuggauucuuuggauaucauuugcaaucaguuguuuccuguugugcgugguccuccugggcuuuauuaugugggccugucagaaagggaacaucagaugcaauauuuguaucuga

SEQ ID NO: 122724 - RNA, 1701 nt, Artificial Sequence
  derived and/or modified sequence opt3 from hemagglutinin__InfluenzaA__ABD15724
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacguggcuaugcccaauaacgagaaguuugacaaauuguauauauggggcguccaucacccuagcacggauucugaccagaucucccuguacgcccaggcgccaggccgugugacuguaucaaccaagagaagccaacagacaguuauucccaacaucgggaguaggccuugggugcggggagucucuucccgcauuagcaucuacuggacuauagugaaaccaggugauauucuacucaucaauuguaccggcaaccugauugcaccgagaggguauuucaagaucaggucgggaaagucuuccaucaugcggucagacgccaguauuggcaaaugcaauagcgaauguauaacacccaacgguuccaucccuaaugacaagccauuucagaacgugaaucgcauuaccuacggggcuugcccccgauaugucaaacagaacacgcuuaagcuggccacuggaaugagaaauguuccugagaaacaaacaaggggcaucuucggcgcaauagcuggguuuauugaaaacggaugggaggguaugguggauggcugguacggguuccggcaccaaaauucugagggaaccggccaggccgcggacuugaaaagcacucaggccgcaaucaaccagaucaaugguaaacucaaccgucugauugaaaagacaaaugagaaguuucaucagaucgaaaaagaguucucagaaguagaggggcgcauucaggauuuagagaaguauguggaagacaccaaaauagaucuguggaguuacaacgcugagcuccuugucgcccuggaaaaccaacacacgaucgacuugaccgauuccgagaugaauaagcuauucgaaagaacaaagaagcagcugagggagaacgcugaggacaugggcaauggauguuuuaagauuuaucauaaaugcgauaacgccugcaucggcagcauccggaaugggacuuacgaccacgauguguaccgagacgaagcacucaacaaucgcuuccagauuaagggaguugagcugaaaucugguuauaaggacuggauacuuuggaucucauuugccauuaguuguuuccuguugugcgugguccuccugggcuuuaucaugugggcuugucagaaagggaacauuagaugcaauaucuguauauga

SEQ ID NO: 122725 - RNA, 1701 nt, Artificial Sequence
  derived and/or modified sequence opt3 from hemagglutinin__InfluenzaA__ABD15746
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcaucuccagcagaauaucgauuuacuggacaaucgugaagccuggggauauucuacucaucaacucuaccggaaaucugaucgcgccaagggguuauuucaaaauucgguccggcaagucaaguauaaugcgcagcaacgcaccgaucgggaaguguaauuccgaaugcauuacgcccaacggaucuaucccuaaugacaaaccauuucagaacgugaaucgaauaacuuacggcgccugucccagauaugucaagcagaacacacuuaaacuggcuaccgguaugaggaauguuccugagaagcagacucgggggauuuucggagccaucgcaggcuuuaucgaaaacggcugggaggggaugguggacggaugguacgguuuccgucaucaaaauagcgagggcacagggcaggcugccgauuugaaaucaacccaggcggccauuaaccaaaucaauggaaagcucaaccgccugauugagaaaacgaaugaaaaguuucaccagauagaaaaggaguucagugaaguagagggcagaauccaggacuuagagaaauauguggaagauaccaagauugaccugugguccuacaacgcagagcuccuugucgcucuggaaaaccagcauacaaucgauuugacugacagcgagaugaauaaacuauucgaaaggacccggaagcaacugcgagagaacgccgaggaaauggguaaugggugcuuuaaaaucuaucacaagugugauaacgcuugcauuggcucuauacgcaauggaacauacgaccacgauguguacagagacgaggcccucaacaauagguuccagaucaagggcguugaacugaaaucaggguauaaggauuggauucuuuggaucaguuuugcaauuagcugcuuccuguugugugugguccuccugggauuuaucaugugggccugccagaaagguaacauacgguguaauaucugcauuuga

SEQ ID NO: 122726 - RNA, 1701 nt, Artificial Sequence
  derived and/or modified sequence opt3 from hemagglutinin__InfluenzaA__ABD15757
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacuuaaacuggcuaccgguaugaggaaugugccugagaagcagacucgggggauauucggagccauugcaggcuuuaucgaaaacggcugggaggggaugguagacggaugguacgguuuccgucaucaaaauagcgagggcacagggcaggcugccgauuugaaaucaacccaggcggccaucaaccaaauuaauggaaagcucaaccgccugaucgagaaaacgaaugaaaaguuucaccagauugaaaaggaguucagugaaguggagggcagaauacaggacuuagagaaauaugucgaagauaccaagaucgaccugugguccuacaacgcagagcuccuuguggcucuggaaaaccagcauacaauugauuugacugacagcgagaugaauaaacuauucgaaaggacccggaagcaacugcgagagaacgccgaggaaauggguaaugggugcuuuaaaaucuaucacaagugugauaacgcuugcaucggcucuauucgcaauggaacauacgaccacgauguuuacagagacgaggcccucaacaauagguuccagauaaagggcguggaacugaaaucaggguauaaggauuggauccuuuggauuaguuuugcaaucagcugcuuccuguugugugucgugcuccugggauuuauuaugugggccugccagaaagguaacauccgguguaauauaugcaucuga

SEQ ID NO: 122727 - RNA, 1701 nt, Artificial Sequence; identical to SEQ ID NO: 122666
  derived and/or modified sequence opt3 from hemagglutinin__InfluenzaA__ABD15779

SEQ ID NO: 122728 - RNA, 1701 nt, Artificial Sequence; identical to SEQ ID NO: 122666
  derived and/or modified sequence opt3 from hemagglutinin__InfluenzaA__ABD15790

SEQ ID NO: 122729 - RNA, 1701 nt, Artificial Sequence; identical to SEQ ID NO: 122666
  derived and/or modified sequence opt3 from hemagglutinin__InfluenzaA__ABD16292

SEQ ID NO: 122730 - RNA, 1701 nt, Artificial Sequence; identical to SEQ ID NO: 122649
  derived and/or modified sequence opt3 from hemagglutinin__InfluenzaA__ABD16303

SEQ ID NO: 122731 - RNA, 1701 nt, Artificial Sequence; identical to SEQ ID NO: 122649
  derived and/or modified sequence opt3 from hemagglutinin__InfluenzaA__ABD16325

SEQ ID NO: 122732 - RNA, 1701 nt, Artificial Sequence
  derived and/or modified sequence opt3 from hemagglutinin__InfluenzaA__ABD16336
augaagaccaucauugcccugagcuacacacucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacagucuucaaguaccgguggcaucugcgacagcccacaccagauucuagauggggagaauuguacucucaucgacgcucugcuuggagauccgcagugcgacggcuuucaaaacaaaaagugggaucuguucguggaaagauccaaagccuauucuaauuguuaccccuaugacgucccugauuacgcaucguugaggucacucauagccagcagugguacacuggaguuuaacaaugaauccuucaacuggaccggggugacgcagaauggaacuucuagcgcuugcaagcggcgcuccaacucaaguuucuucagccgacugaauuggcucacccauuuaaaguuuaaauauccagcacugaacguuacaaugcccaauaacgaggaguucgacaaacuuuacaucuggggcgugcaccauccuggcacuuauaacgaucagauuucuuuguacgcccaggcuuccgggcguaucaccgucucaacaaagagaagccaacagaccgugauuccaaauaucggaaguaggccccggguacgcgacauaccuucuagaauuuccaucuacuggacgauuguuaagccaggugauauccugcuaaucaacagcacuggcaaucucauugccccgaggggguauuuuaaaauacggucgggaaagucuuccaucaugcgcucagacgcgcccauuggcaaguguaacagugaaugcaucacaccuaaugguagcauaccaaacgacaaacccuuccagaaugugaaccgaauuaccuacggggcauguccuagauaugucaagcagaauacucugaaacuugccacaggaaugaggaacgugccagagaagcaaacccggggcaucuuuggcgcuaucgccggguucauugaaaauggaugggaggguaugguggauggcugguacggguuucgucaccagaacuccgagggaaucggccaggcagcugaccugaaaucuacgcaagccgcgauugaucagauaaaugguaaguugaaccgccucaucgggaaaaccaaugaaaaguuccaccagauugagaaggaauuuagcgaggucgaaggcagaauccaggaccuggagaaauauguugaggauacaaagaucgacuuauggucauacaacgccgaacugcucguggcacuugagaaccaacauacuauugaucugaccgacagugaaaugaauaaauuguuugagaggacaaagaaacagcuacgggaaaacgcugaggauaugggaaauggcugcuucaagauauaucacaagugugacaacgccugcaucggguccauucgaaauggaacuuacgaucaugacguauaccgcgacgaggcucugaacaauagauuucagaucaaagguguggaacucaagagcggcuauaaagauuggauucuguggaucucuuucgccauaucaugcuuucuucugugugucgcauugcucggguucaucaugugggccugccagaagggaaacauuagguguaauaucugcauuuga

SEQ ID NO: 122733 - RNA, 1701 nt, Artificial Sequence; identical to SEQ ID NO: 122649
  derived and/or modified sequence opt3 from hemagglutinin__InfluenzaA__ABD16347

SEQ ID NO: 122734 - RNA, 1701 nt, Artificial Sequence
  derived and/or modified sequence opt3 from hemagglutinin__InfluenzaA__ABD16358
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggguacgcgacauuccuucuagaaucuccauuuacuggaccaucguuaagccaggugauauccugcuaauuaacagcacgggcaaucucauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccugaaacuugccacuggaaugaggaacgugccagagaagcaaacacggggcaucuuuggcgcuauugccggguucaucgaaaauggaugggaggguaugguggauggcugguacggguuucgucaccagaacuccgagggaauuggccaggcagcugaccugaaaucuacccaagccgcgauagaucagaucaaugguaaguugaaccgccucauugggaaaacgaaugaaaaguuccaccagaucgagaaggaauuuagcgaggucgaaggcagaauccaggaccuggagaaauauguugaggauaccaagauugacuuauggucauacaacgccgaacugcucguggcacuugagaaccaacauacaauagaucugacugacuuggaaaugaauaaacuauuugagaggaccaagaaacagcugcgggaaaacgcugaggauaugggaaauggcugcuucaagaucuaucacaagugugacaacgccugcauugggaguauccgaaauggaacauacgaucaugacguauaccgcgacgaggcucucaacaauagauuucagauuaaagguguggaacugaaguccggcuauaaagauuggauccuuuggaucagcuucgccauaucuugcuuucuguugugugucgcacuccugggguucauuaugugggccugccagaagggaaacaucagguguaauauuugcaucuga

SEQ ID NO: 122735 - RNA, 1701 nt, Artificial Sequence; identical to SEQ ID NO: 122649
  derived and/or modified sequence opt3 from hemagglutinin__InfluenzaA__ABD16472

SEQ ID NO: 122736 - RNA, 1701 nt, Artificial Sequence; identical to SEQ ID NO: 122649
  derived and/or modified sequence opt3 from hemagglutinin__InfluenzaA__ABD16483

SEQ ID NO: 122737 - RNA, 1701 nt, Artificial Sequence; identical to SEQ ID NO: 122646
  derived and/or modified sequence opt3 from hemagglutinin__InfluenzaA__ABD16494

SEQ ID NO: 122738 - RNA, 1701 nt, Artificial Sequence; identical to SEQ ID NO: 122649
  derived and/or modified sequence opt3 from hemagglutinin__InfluenzaA__ABD16505

SEQ ID NO: 122739 - RNA, 1701 nt, Artificial Sequence
  derived and/or modified sequence opt3 from hemagglutinin__InfluenzaA__ABD16516
augaagaccaucauugcccugagcuacauacucugcaugguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacagguggcauuugcgacagcccacaccagauccuggauggggagaauuguacccuaauagacgcucuccugggagauccgcagugcgacggcuuucaaaacaaaaagugggaucuuuucaucgaaagauccaaagccuauucuaauuguuaccccuaugacgugccugauuacgcaucgcugaggucauuggucgccagcagugguacucucgaguuuaacaaugaauccuucaacuggacaggggugacccagaauggaacgucuagcgcuugcaagcggcgcuccaacaauucauuuuucagucgacugaacuggcugacucaucucaaguuuaaauauccagcauuaaauguuaccaugcccaacaacgagaaguucgacaaacuguacauuuggggcgugcaccauccuggcacagauaaugaccagaucagccuuuaugcccaggcuucugggcguauuacugucuccaccaagagaucacaacagacagugaucccaaacauaggaagcaggccccggguacgcgauauuccuaguagaaucucuauuuacuggaccaucguuaaaccaggugacaucuugcugauuaauuccacgggcaaccuaauagccccgaggggguacuuuaagauccggagcggaaagucgucuauuaugcgcuccgacgcgcccaucgauaaauguaauucagagugcauaacuccuaacggcaguauuccaaaugacaagcccuuccagaacgugaaucgaaucacauauggugcauguccuagauacgucaaacagaacacccucaagcuggccacugggaugaggaaugugccagaaaaacaaacacggggaaucuuuggcgcuauugccggcuucaucgagaacgggugggaaggaaugguggaugguugguauggcuuucgucaccagaauagcgaggggauuggacaggcagcugaccuuaaguccacccaagccgcgauaaaccagaucaauggcaaacugaaccgcuugauugguaagacgaacgagaaguuccaccagaucgaaaaagaguucucugaagucgaggggagaauccaggaucucgaaaaguacguugaggacaccaaaguggaucuguggagcuauaaugccgaguuacugguagcacucgaaaaccaacauacaauugaccuuacugauucagagaugaauaagcuguuugaaaggaccaaaaagcaguugcgggagaacgcugaagacaugggcaauggaugcuucaagauauaccacaaaugugauaacgccugcaucggcaguauucgaaaugggacauaugaccaugacguguaccgcgaugaggcucuaaacaauagauuucagaucaagggagucgagcugaaauccgguuacaaggacuggauucucuggaucagcuucgccauaucuugcuuucugcuuuguguggcacuguugggcuucaucaugugggccugccagaaagggaacauuagguguaauaucugcauuuga

SEQ ID NO: 122740 - RNA, 1701 nt, Artificial Sequence
  derived and/or modified sequence opt3 from hemagglutinin__InfluenzaA__ABD16527
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagguauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugaucaugcaucguugaggucacucguggccagcaguggcacucuggaauuuaacaaugaguccuucgacuggacagguguuacccagaacgggacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggaguccaucacccuggcacagacagcgaucagauuucuuuguaugcccaggcuuccggccguaucacugugucaaccaagagaagccaacagacaguaauuccaaacaucgggaguaggccccggguucgcgacgugucuuccagaauaagcauuuacuggaccaucgucaagccuggagacauucugcuaaucaacucgacggguaaucucaucgccccaaggggcuacuucaagauucggucugggaaauccucaauaaugcgcagugaugcgccgaucggaaaguguaacagcgaaugcauuacucccaauggcuccaucccuaacgacaaaccauuucagaaugugaaccgaauaacauauggugcaugucccagauacgugaagcagaauacccugaaacuugccacugggaugaggaacgucccugagaagcaaacacggggaauuuucggcgcuaucgccggcuuuaucgaaaaugggugggagggaaugguugaugguugguauggcuuccgucaccagaacucugaggggaccggacaggcagcugaccugaaaagcacgcaagccgcgauuaaucagaucaacggcaaguugaaucgccucauugguaagaccaacgaaaaauuucaucagauagagaaggaguucucagaaguggaagggagaauccaggaucuggagaaauacguagaggacacaaagauugauuuauggaguuauaaugccgaacugcucguggcacuugagaaccaacacacuaucgaccugaccgauuccgaaaugaacaaauuguucgagaggacaaagaagcagcuacgggaaaaugcugaggacaugggcaacggaugcuuuaaaaucuaccauaagugugauaaugccugcauuggcagcauacgaaacgggacuuaugaccacgacgucuaccgcgaugaggcucugaauaacagauuccagaucaaaggaguggaacucaagucugguuacaaagacuggauucuguggaucucauuugccauuaguugcuuccuucuguguguugcauugcucggcuuuaucaugugggccugccagaaggggaauauaaggugugauaucugcauuuga

SEQ ID NO: 122741 - RNA, 1701 nt, Artificial Sequence; identical to SEQ ID NO: 122532
  derived and/or modified sequence opt3 from hemagglutinin__InfluenzaA__ABD16538

SEQ ID NO: 122742 - RNA, 1701 nt, Artificial Sequence
  derived and/or modified sequence opt3 from hemagglutinin__InfluenzaA__ABD16549
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggguacgcgacauuccuucuagaaucuccauuuacuggaccaucguuaagccaggugauauccugcuaauuaacagcacgggcaaucucauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccugaaacuugccacuggaaugaggaacgugccagagaagcaaacacggggcaucuuuggcgcuauugccggguucaucgaaaauggaugggaggguaugguggauggcugguacggguuucgucaccagaacuccgagggaauuggccaggcagcugaccugaaaucuacccaagccgcgauagaucagaucaaugguaaguugaaccgccucauugggaaaacgaaugaaaaguuccaccagaucgagaaggaauuuagcgaggucgaaggcagaauccaggaccuggagaaauauguugaggauaccaagauugacuuauggucauacaacgccgaacugcucguggcacuugagaaccaacauacaauagaucugacugacagugaaaugaauaaauuguuugagaggaccaagaaacagcuacgggaaaacgcugaggauaugggaaauggcugcuucaagaucuaucacaagugugacaacgccugcauuggguccauccgaaauggaacauacgaucaugacguauaccgcgacgaggcucugaacaauagauuucagauuaaagguguggaacucaagagcggcuauaaagauuggauccuguggauaucuuucgccaucucaugcuuucuucugugugucgcauugcucggguucauugugugggccugccagaagggaaacaucagguguaauauuugcaucuga

SEQ ID NO: 122743 - RNA, 1701 nt, Artificial Sequence; identical to SEQ ID NO: 122646
  derived and/or modified sequence opt3 from hemagglutinin__InfluenzaA__ABD16560

SEQ ID NO: 122744 - RNA, 1701 nt, Artificial Sequence
  derived and/or modified sequence opt3 from hemagglutinin__InfluenzaA__ABD16571
augaagaccaucauugcccugagcuacauauucugccucguggucgcucagaaacuucccggcaacgacaauuccacagcaacucuguguuuggggcaccaugccguuccuaacggaacgaucgugaagaccauuacaaaugaucaaaucgagguaacuaacgcgaccgaauuagugcagucuucaaguacagguagaauuugcaauagcccacacaggauccuggacggcaaaaacuguacccuaauagaugcucuccugggggacccgcauugcgauuccuuucagaauaaggagugggaccuuuucgucgaacggucuaaagccuauucgaacuguuaccccuaugaugugccugacuacgcaucacugcgcagcuugguugccaguuccggaacucucgaguuuaucaaugaagauuucaacuggacaggcguggcucagucuggugggagcuaugcaugcaagcgaggauccgucaauucauuuuucagucgucugaacuggcugcacgagagcgaguacaaguauccagcccucaaugugaccaugcccaacaauggcaaauuugacaaguuauacauuuggggcguacaucacccuucuacggauagagaacaaacuaaccuguacguuagggcuuccgggcgggugaccgucucaacaaaacgcagccagcagacugugaucccaaacauuggaaguagacccugggugaggggucuuucuucccggaucagcauauauuggaccauugucaagccuggcgacaucuugcugauuaauucgacagggaaccuaaucgccccacgcggauacuucaaaauccgaaccggcaagucuuccauuaugagaucagaugcgccgauagguacguguaguagcgagugcaucacucccaauggguccauuccuaacgacaagccauuucagaauguuaacaggaucacauauggagcauguccccgguacgugaaacaaaauacccucaagcuggccacuggcaugcguaacguaccugaaaaacagacacgcggcauauucggggcuauugccggauuuaucgagaaugguugggagggcaugguggacgggugguauggauucagacaccagaacucugaaggcaccggucaggcagcugaucuuaagagcacgcaagccgcgaucgaccagauuaaugggaaacugaacagguugaucgagaagaccaaugaaaaauuucaucagauugagaaggaguucucagaagucgagggccggauacaagaucucgaaaaguacguggaggacacaaaaaucgaucuguggaguuauaacgccgaauuacugguugcacucgagaaucagcacacuauugaccuuaccgauuccgaaaugaacaagcuguucgagaaaacacgaaagcaguugcgcgagaacgcugaagacaugggaaauggcugcuuuaaaaucuaccauaagugugauaacgccugcaucgggagcauuagaaauggaacuuacgaccacgauguguauagggacgaggcucuaaacaaucgguuccagauaaagggugucgaacugaaaucuggcuacaaggacuggauccucuggauuucauuugccaucaguugcuuccugcuuugugugguacuguugggguuuauuaugugggcaugccaaaaaggaaacauccgcuguaauauaugcaucuga

SEQ ID NO: 122745 - RNA, 1701 nt, Artificial Sequence
  derived and/or modified sequence opt3 from hemagglutinin__InfluenzaA__ABD16718
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuauagaacgguccaaagccuucucuaauuguuaucccuacgacgugccugauuaugcaucguugcgcucacucgucgccagcaguggcacucuggaguuuaucaacgaagguuucaauuggacaggggugacccaguccggaggcucuuacgcuugcaagcgaggcagcguuaacuccuuuuucucacgucugaauuggcucuaugagagugaguacaaguauccagcauuaaacgugacgaugcccaauaacgggaaauuugacaagcuguacauuuggggaguccaccauccuaucacugaaaaagagcaaaccaaucuuuacgugagagccagcgguaggguaacaguuucuacuaagcggucccagcagaccgugauuccaaacaucggcucacgccccugggucagaggguugagcaguaggauaucuauuuauuggacaaucgugaaaccuggagauauucugcuaaucaacuccaccggcaaucucaucgcuccacgggguuacuucaagauucgcacgggaaagagcucgauaaugcgaucugacgccccgaucgggacuuguuccucagaaugcauuacacccaacggcaguaucccuaaugauaaaccauuucagaacgugaauaagauaaccuauggcgcgugucccagauacgucaaacaaaacacucugaaacuugcaacagggaugaggaauguuccugagaagcagacccggggaauuuucggugccaucgcuggcuuuaucgagaacgggugggaaggaaugguggacggcugguaugguuuccgucaccagaauagcgaggggacgggccaggccgcagaccugaaguccacccaagcugccauugaucagaucaacggaaaauugaaucgccucauugaaaagacaaacgagaaguuccaccagauagaaaaagaguuuucugagguagaaggcagaauccaagaccuggagaaguacguggaagauacuaaaauugacuuauggagcuauaaugcggagcugcucgucgcccuugaaaaccagcauaccaucgaucugacagacucagagaugaauaaguuguucgagaaaacuaggaagcagcuacgggaaaacgcagaggauauggggaacggaugcuuuaagaucuaccacaaaugugacaaugcuugcauugguaguauacgaaacggcaccuacgaucaugacguguaucgcgaugaagcccugaauaacagauuccagaucaaggggguugagcucaaauccggauacaaggacuggauucuguggaucagcuuugcuauuucuugcuuccuucuguguguggucuugcucggcuuuaucaugugggccugccaaaaagguaauauaagguguaacaucugcauuuga

SEQ ID NO: 122746 - RNA, 1701 nt, Artificial Sequence
  derived and/or modified sequence opt3 from hemagglutinin__InfluenzaA__ABD16729
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccagaacggaggcuccuacacgugcaagcgaggcucugugaauagcuuuuucucccgucugaacuggcucuaugagucagagaguaaguacccagucuuaaaugugacuaugcccaacaaugggaaauuugacaagcuguauaucuggggaguacaccauccuagcaccgauaaagaacaaacaaaccuuuacguuagagcuucugguaaggugacugucuccaccaaaaggucacagcagacagugauuccaaacaucggcagccggcccugggugcgcggguugaguucuagaauuuccaucuacuggaccauagucaagccuggagacauucugcuaaucaauagcacgggcaaccucauugcaccaagggguuauuucaagauccggacugggaaaucgucuaucaugcgcuccgaugccccgauuggaacauguucaagugagugcauaacccccaauggcagcaucccuaacgacaagccauuucagaauguuaacaaaauuacuuacggcgcuuguccccgauaugugaagcaaaauacacugaaacuugccaccgggaugagaaacguaccugaaaagcagacgaggggaaucuucggugcgauagcaggcuuuauugagaaugggugggagggaaugguggacggcugguacgguuuccggcaccagaacuccgaagggaccggccaggccgcugaucugaaaucuacacaagccgcaaucgaccagaucaauggaaaguugaaccgucucauugagaagacuaaugaaaaauuccaccagaucgagaaggaauuuagcgaggucgagggccgcauucaagaucuggaaaaauauguggaggacaccaagauagauuuauggucauacaacgcugaacugcucguugcccuugagaaucagcauacaaucgaccugacugauagugaaaugaacaaauuguucgagaagaccagaaagcagcuaagggagaacgcggaagacauggggaauggaugcuuuaaaauuuaucacaagugugauaacgccugcaucgguuccauccggaauggcacauacgaccaugauguguaccgagacgaggcacugaacaaucgcuuccagauuaaaggggucgaacucaagagcggauauaaagacuggauacuguggaucucuuuugcuauuucaugcuuccuucugugugugguauugcucggcuuuaucaugugggccugccaaaaggguaacauuagauguaauaucugcauauga

SEQ ID NO: 122747 - RNA, 1701 nt, Artificial Sequence
  derived and/or modified sequence opt3 from hemagglutinin__InfluenzaA__ABD16751
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacacucuucaaguacagguaagaucugcgauaauccacauagaauacuagacggcaucaacuguacccucauagaugcucugcuuggggacccgcacugcgauggauuccagaaugagaaaugggaccuguuuguggaaaggagcaaggccuucuccaacuguuaucccuacgaugucccugacuaugcaucuuugcggucgcucguggccucaagcggcacucuggaguuuaucaaugaagguuucaacuggacagggguuacccagaauggaggcaguuccgcuugcaaacgcggcccagauaacggguuuuucucucgacugaauuggcucuacaagagcggauccacguaucccgugcagaacgucacuaugccuaauaacgacaacucagauaaguuauacauuuggggugugcaucacccaaguaccgacaaagagcaaacagaccuguauguacaggcaagcggcaagguuacugugucuaccaaacguucccagcagacagucauccccaauguggggucaagaccuugggugaggggacuuagcagucgggucucuauuuacuggaccaucguuaagccaggcgauauauuggugauuaacuccaaugguaaccugaucgccccgcgcggguacuuuaaaaugagaacgggaaagagcucgauuaugaggucugacgcucccaucggcacuuguuccucagagugcaucacaccuaauggcaguauuccaaacgauaagcccuuccaaaauguaaacaaaauaaccuauggggccuguccuaaguacgugaaacagaauacucuaaagcucgcgacaggaaugcggaacgucccagaaaaacagacccgcgguaucuuuggcgcaauugccggguucaucgagaauggaugggaaggcaugauagacgguugguauggguuucgacaccagaacagcgagggcacgggacaagcugccgaucugaaguccacccaggcagcuauugaccagaucaauggcaaacuuaacagagugaucgagaagacaaaugaaaaguuccaucaaauugagaaagaguucucugaaguugaagggaggauccaggaucuggagaaguacguggaggacacuaaaauugauuuguggagcuauaacgccgaacuccuggucgcguuagagaaccagcacaccauagaccugacagauucagaaaugaauaagcucuuugagaaaacucggcgucagcuucgcgaaaacgccgaggacaugggaaaugguugcuucaagaucuaccauaagugugacaacgcaugcauuggcaguaucagaaaugggaccuaugaucacgacguguacagggaugaggcucugaacaaucgguuucaaaucaaaggaguagaauugaaguccggcuacaaagacuggauucuauggauuagcuucgccaucucuugcuuucugcucuguguugugcugcuugguuucauuaugugggcuugccagaaggggaacauccgauguaauauuugcaucuga

SEQ ID NO: 122748 - RNA, 1701 nt, Artificial Sequence; identical to SEQ ID NO: 122609
  derived and/or modified sequence opt3 from hemagglutinin__InfluenzaA__ABD16762

SEQ ID NO: 122749 - RNA, 1701 nt, Artificial Sequence; identical to SEQ ID NO: 122321
  derived and/or modified sequence opt3 from hemagglutinin__InfluenzaA__ABD17323

SEQ ID NO: 122750 - RNA, 1701 nt, Artificial Sequence; identical to SEQ ID NO: 122578
  derived and/or modified sequence opt3 from hemagglutinin__InfluenzaA__ABD38134

SEQ ID NO: 122751 - RNA, 1698 nt, Artificial Sequence; identical to SEQ ID NO: 122317
  derived and/or modified sequence opt3 from hemagglutinin__InfluenzaA__ABD60779

SEQ ID NO: 122752 - RNA, 1701 nt, Artificial Sequence
  derived and/or modified sequence opt3 from hemagglutinin__InfluenzaA__ABD60790
augaagaccaucauugcccugagcuacauauucugccucgugcuuggccaggacuuucccgggaacgauaauuccacagcuacucuguguuugggacaccaugcagucccuaacgguacguuaguuaaaaccaucacaaaugaccaaauugaggugacuaacgccaccgaacugguacagucuucaaguacaggcaagaucugcaauaacccacacaggauucuagaugggaucgacuguacccucauagaugcgcugcuuggagacccgcauugcgauggcuuccagaaugagacuugggaccuguuuguggaaagaagcaaggcuuucuccaacuguuaucccuacgaugucccugacuaugccucuuugcggucgcucguggcaucaagcgguacacuggaguuuaucaaugaaggguucaccuggacgggaguuacucagaacggcggcaguaaugccugcaaacgcgggccagauuccggauuuuucucucgacugaacuggcucuacaaaagcgguuccaccuaucccguguuaaaugucacaaugccuaacaaugacaacuuugauaagcuguacauuuggggcgugcaccauccaucaacugaccaagagcagaccagucuuuauguacaggcuagcgggcguguuacagugucuaccaagagaucccagcaaacgaucauucccaacaucggaucaaggccuuggguccggggcuugagcagucgcauaucuauuuacuggacuaucgugaaaccaggugacauucugaucaucaauuccaacgggaaucuaauugcaccgagaggauacuucaagaugaggacaggcaaaagcucgauaaugcggucugaugcccccaucggcaccuguauuuccgagugcaucacuccuaacgggucaauaccaaaugacaagcccuuucagaacgugaauaaaauuacauauggagcuuguccuaaguacgucaagcagaacacccucaaacuggccacggguaugcgcaauguuccagaaaagcagacccgaggcaucuucggggcgaucgcaggauuuauugagaacggcugggaagguaugaucgaugggugguauggcuucagacaccaaaauagugagggaacaggccaggccgcugaccuuaaaagcacucaggccgcaauugaucaaauaaacgggaagcugaauaggaucauugagaaaaccaacgaaaaguuccaccagaucgagaaagaauuuuccgagguggaaggacggauccaggacuuggagaaguacguagaggauacaaagauugaccucuggucuuauaaugcugaacuguuaguggcccuggagaaccagcauacuauagaucucaccgacagcgaaaugaacaaacuuuucgagaagacacgucgccaacugagagaaaaugcggaggauauggguaacggcugcuuuaaaaucuaccacaagugugacaaugccugcauugggucaaucaggaacggaaccuaugaccaugaugucuaccgggacgaggcauugaauaaccgauuccagauuaaaggcguggaacuaaagagugguuacaaggauuggauccuguggauauccuuugcuaucagcugcuuccuccuguguguugugcuucugggguuuauuaugugggccugccagaaaggcaauauccgcuguaacauuugcaucuga

SEQ ID NO: 122753 - RNA, 1701 nt, Artificial Sequence
  derived and/or modified sequence opt3 from hemagglutinin__InfluenzaA__ABD60801
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagacucugcgacagcccacacaggauccuggauggcaaaaauuguacccuuauugacgcucuguugggggauccgcauugcgacggauuucagaacaaggagugggaucucuucguggaacgguccaaagccuauucuaauuguuaccccuaugacgucccugauuacgcaucgcugcgcucacugguggccagcaguggcacucucgaguuuaucaacgaagacuucaauuggacagguguugcucaggaugggggauccuaugcaugccgacguggcucugugaacagcuuuuucuccagauuaaauuggcugcacaagcuagaguacaaguauccagccuugaacgucaccaugcccaauaacggcaaauuugacaagcuguacauauggggagugcaucacccuucaacggauagugaccaaacuagccuauacguaagggcuucugggcggguuaccguguccacaaaacgcucacagcagacugucaucccaaauauugguagcagacccugggugaggggccagaguucucggauguccaucuauuggaccauugugaagccuggggacauccuccugauaaacagcacaggaaaccuuauugccccacgcggcuacuucaaaauccgaaaugguaagucgucuauuaugagauccgaugcgccgaucgggaacuguucaagugagugcaucacccccaauggaagcauuccuaacgacaagccauuucaaaaugucaacaggauaacguauggcgcauguccccgguacguuaaacagcacacucugaaguuggccacaggcaugcguaaugugccugaaaaacagacccgcgggaucuucggagcuauugccgguuuuaucgagaacggcugggaagggaugguagauggaugguauggcuucagacaucaaaauuccgaggguacugggcaggcagcugaccucaagucuacacaggccgcgauagaucagauuaacggcaaacugaauagguuaaucgagaagaccaacgaaaaauuucaccaaaucgagaaggaguucagcgaaguggaaggacggauucaggaccuggagaaguacgucgaggauacgaaaaucgaccucuggucauauaaugccgaacuucugguggcauuggagaaccagcauaccauugaucuaacagacagugaaaugaauaagcuguucgagcgaacucgcaaacagcucagagaaaacgcugaggauaugggcaacgggugcuuuaagauauaccacaaaugugacaaugccugcaucggauccauuaggaacgguaccuacgaccacgauguuuaucgggacgaggcucugaauaaccgcuuccaaaucaagggcguggaacuuaagagcggguacaaagauuggauccuguggauuucuuuugccauaucaugcuucuugcucugugucgugcuguuaggauuuaucaugugggcaugccagaagggcaauauuagauguaacaucugcauuuga

SEQ ID NO: 122754 - RNA, 1701 nt, Artificial Sequence
  derived and/or modified sequence opt3 from hemagglutinin__InfluenzaA__ABD60812
augaagaccaucauugcccugagcuacauacucugccuuaucuucgcucagaaacugcccggcaacgacaauuccacagcaacuuuguguuuagggcaccaugccgugccuaacggaacgauugucaagaccaucacaaaugaucaaauugagguuacuaacgcgaccgaacuggugcagucuucaaguacagguggcaucugcgacagcccacaccagauacuagauggggagaauuguacccucaucgacgcucugcuuggagauccgcagugcgacggcuuucaaaacaaaaagugggaucuguucguagaaagauccaaagccuauucuaauuguuaccccuaugacgugccugauuacgcaucguugaggucacucgucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagauaaugaccagaucuuuuuguaugcccaggcuagcgggcguauuacugucucuaccaagagaucccaacagacagugaucccaucaauaggaagcaggccccggguacgcaacauuccuaguagaaucucuauuuacuggaccaucguuaaaccaggugauauccugcuaauuaauuccacgggcaaccucauagccccgaggggguacuucaagauccggagcggaaagucgucuauuaugcgcuccgacgcgcccaucggcaaauguaauucagagugcauaacuccuaacgguaguauuccaaaugacaagcccuuucagaacgugaaucgaaucacauauggggcauguccuagauacgucaaacagaacacccugaaacuugccacuggaaugaggaaugugccagaaaagcaaacacggggcaucuucggcgcuauugccggguuuaucgagaacggaugggaagguaugguggauggcugguauggguuccgucaccagaauagcgagggaauuggccaggcagcugaccugaaguccacccaagccgcgauaaaccagaucaaugguaaauugaaccgccucauugggaagacgaacgagaaguuccaccagaucgaaaaagaguuuucugaagucgagggcagaauccaggaucuggaaaaguacguugaggacaccaaaauugauuuauggagcuauaaugccgagcugcucguggcacuugaaaaccaacauacaauagaccugacugauucagagaugaauaaguuguucgaaaggaccaaaaagcagcuacgggagaacgcugaagacaugggaaauggcugcuuuaagaucuaccacaaaugugauaacgccugcauugggaguauccgaaauggaacauaugaccaugauguauaccgcgacgaggcucugaacaauagauuccagauuaaggguguggagcucaaauccggcuacaaggacuggauccuguggaucagcuuugccauaucuugcuuccuucugugugucgcauugcucggguuuauuaugugggccugccagaaaggaaacaucagguguaauauuugcaucuga

SEQ ID NO: 122755 - RNA, 1701 nt, Artificial Sequence; identical to SEQ ID NO: 122649
  derived and/or modified sequence opt3 from hemagglutinin__InfluenzaA__ABD60823

SEQ ID NO: 122756 - RNA, 1701 nt, Artificial Sequence
  derived and/or modified sequence opt3 from hemagglutinin__InfluenzaA__ABD60845
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggaccagaaugguacgucuagcgcuugcaagcgccgauccacuaaaucauuuuucagucgucucaacugguuacaucaacugaaguauaaguacccagcacuuaaugucaccaugcccaacaaugagaaauuugauaaguuguauauauggggagugcaccacccuagcacagacucugaucagaucucccuguacgcccaggcuucagggagaguaacuguuagcaccaaaaggagucagcaaacagugaccccaaacauuggcucucggcccuggguccgcggcguguccagcagaaucucgauuuacuggacgaucgugaagccuggggacauacuacucauuaacucuacuggaaaucugaucgccccaagggguuauuucaaaauucgguccggcaagucaaguaucaugcgcagcaacgcgcuuaucgggaaguguaauuccgaaugcauuacaccgaacggaucuauacccaaugacaaaccuuuucagaacgucaaucgaaucaccuacggcgcauguccaagauauguuaagcagaacacucugaaauuggccacagguaugaggaaugugcccgagaagcagacccgggggauuuucggagcuaucgccggcuuuauagaaaacggcugggaggggaugguagauggaugguacgguuuccgucaucaaaauagcgagggcacggggcaggcagcugaccucaaaucaacccaggccgcgauuaaccaaaucaauggaaagcugaaccgcuuaaucgagaaaacaaaugaaaaguuucaccagauugaaaaggaguucagugaaguggagggcagaauccaggaucuggagaaauaugucgaagacacuaagauugaucucugguccuacaacgccgagcuucugguggcauuggaaaaccagcauaccauagaccuaacagauagcgagaugaauaaacuguucgaaaggacucggaagcaacuccgagagaacgcugaggacauggguaaugggugcuuuaaaaucuaucacaagugugauaacgccugcauuggcucuauccgcaauggaaccuacgaccacgauguuuacagagacgaagcucugaacaauagguuccagaucaagggcguggagcuuaaaucaggguauaaggacuggauucuguggauaaguuuugccaucagcugcuucuugcucugugucgugcuguuaggauuuauuaugugggcaugccagaaagguaacauccgguguaauauuugcaucuga

SEQ ID NO: 122757 - RNA, 1698 nt, Artificial Sequence
  derived and/or modified sequence opt3 from hemagglutinin__InfluenzaA__ABD60878
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcaagucuuacgcaaacaauaaagaaaaggagguucuaguacucuggggcgugcaucacccuccaaacaucggggaucagaaagcccuguaccacacugaaaacgcuuaugucuccguggugucaagccauuacagucgccgauucacccccgagauagcaaagcguccuaaggucagagaccaggaaggaaggaucaauuauuacuggacacuucuggagccaggugauacuauuaucuuugaggccaacggcaauuugauugcuccgcgguaugccuucgcgcucucucgcggguuuggauccggcaucauaaccagcaacgcacccauggacgaaugugaugccaaaugccagacaccucaaggugcuauuaauucgucucugccauuccagaacguucaccccgugaccaucggggaguguccuaaguacguaagauccgccaaauuaaggauggugacgggacugcggaauauuccaucaauccagagucgcggccucuuuggcgcaaucgcuggguucauugaaggagguuggacuggcauggucgacgggugguauggauaccaucaccagaacgagcaaggcagcgguuacgccgcggaucagaaguccacacagaaugccauaaacgggaucaccaauaaagugaacucuguuauugaaaagaugaauacucaguuuacagcagugggcaaagaguucaacaaacuugagcgaagaauggaaaaucugaacaagaaagucgacgauggauucuuggacaucuggaccuauaacgcugagcuacuggugcuccuggaaaaugagaggacgcuugacuuucacgauagcaacguaaagaaucuguacgaaaaaguuaagucacaauugaaaaacaaugccaaggagauaggcaacgggugcuucgaguuuuaucauaaguguaauaacgaaugcauggagagugugaaaaauggaaccuacgacuaucccaaguacuccgaagagagcaaacucaaccgggagaagauugauggugucaaacuggaaucuaugggcguguaucagaucuuagcuaucuacucaacagucgccaguagccuggugcuacucguuucccugggggcaauuucuuucuggaugugcucgaauggaagccuucagugucguaucugcauuuga

SEQ ID NO: 122758 - RNA, 1698 nt, Artificial Sequence
  derived and/or modified sequence opt3 from hemagglutinin__InfluenzaA__ABD60889
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuaugccuucgcgcucucuagaggguuuggauccggcaucauaaccagcaacgcacccauggacgaaugugaugccaagugccagacaccucaaggugcuauuaauucgucucugccauuccagaacguucaccccgugaccaucggggaguguccuaaauacguaagguccgccaaguuacggauggugacgggacugcgcaauauuccaucaauccagagucgaggccucuuuggcgcaaucgcuggguucauugaaggagguuggacuggcauggucgacgggugguauggauaccaucaccagaacgagcaaggcagcgguuacgccgcggaucagaaauccacacagaaugccauaaacgggaucaccaauaaggugaacucuguuauugaaaagaugaauacucaguuuacagcagugggcaaagaguucaacaaacuugagagaaggauggaaaaucugaacaagaaggucgacgauggauucuuggacaucuggaccuauaacgcugagcuacuggugcuccuggaaaaugagcggacgcuugacuuucacgauagcaacguuaaaaaucuguacgaaaagguaaaaucacaauugaagaacaaugccaaagagauaggcaacgggugcuucgaguuuuaucauaaguguaauaacgaaugcauggagagugugaagaauggaaccuacgacuaucccaaauacuccgaagagagcaagcucaaccgugagaaaauugauggugucaagcuggaaucuaugggcguguaucagaucuuagcuaucuacucaacagucgccaguagccuggugcuacucguuucccugggggcaauuucuuucuggaugugcucgaauggaagccuucagugucgcaucugcauuuga

SEQ ID NO: 122759 - RNA, 1698 nt, Artificial Sequence
  derived and/or modified sequence opt3 from hemagglutinin__InfluenzaA__ABD60900
augaaggugaaaagacugguccuccuuugcaccuucacagccacuuacgcugacacgaucuguauuggcuaucacgcaaacaauagcaccgauacaguugacacugugcuggagaagaacguaaccgugacacauuccgucaauuuguuagaagauucucacaacgggaaacugugccuacucaagggaauagcgccccugcagcuugguaauuguucaguggccggcuggauccuggggaacccugagugcgaauugcucauuaguaaagagagcugguccuacaucguugaaaccccaaauccggagaacggaacuuguuaucccggcuacuuugcugacuaugaggaacugagggagcaacugucuucggugagcucauucgaacgguuugagauuuucccuaaggagaguuccuggccaaaucauacagucaccggugugucugccagcugcucccacaacgggaagucaaguuuuuaccgcaaucucuuauggcugacgggcaaaaacggacuuuaucccaauuugagcaagucuuacgcaaacaauaaagaaaaggagguacugguucuauggggcgugcaucacccuccaaacaucggggaucagaaagcccucuaccacacugaaaacgcuuaugucuccguggugucaagccauuacagucgacguuucacccccgagauagcaaagagaccuaaggucagggaccaggaaggacggaucaauuauuacuggacacugcuugagccaggugauacuauuaucuuugaggccaacggcaaucugauugcuccgcgcuaugccuucgcguugucuagaggguuuggauccggcaucauaaccagcaacgcacccauggacgaaugugaugccaaaugccagacaccucaaggugcuauuaauucgucucucccauuccagaacguucaccccgugaccaucggggaguguccuaaguacguaagguccgccaaacugcggauggugacgggauuacgcaauauuccaucaauccagagucgaggccuguuuggcgcaaucgcuggguucauugaaggagguuggacuggcauggucgacgggugguauggauaccaucaccagaacgagcaaggcagcgguuacgccgcggaucagaaguccacacagaaugccauaaacgggaucaccaauaaagugaacucuguuauugaaaagaugaauacucaguuuacagcagugggcaaagaguucaacaagcucgagagaaggauggaaaaucuuaacaagaaagucgacgauggauuccuggacaucuggaccuauaacgcugaguugcuagugcugcucgaaaaugagcggacgcuggacuuucacgauagcaacguaaagaaucuuuacgaaaaaguuaagucacaacugaaaaacaaugccaaggagauaggcaacgggugcuucgaguuuuaucauaaguguaauaacgaaugcauggagagugugaaaaauggaaccuacgacuaucccaaguacuccgaagagagcaaauugaaccgugagaagauugauggugucaaacucgaaucuaugggcguguaucagauccuggcuaucuacucaacagucgccaguagcuuagugcugcuaguuucccucggggcaauuucuuucuggaugugcucgaauggaagccugcagugucgcaucugcauuuga

SEQ ID NO: 122760 - RNA, 1698 nt, Artificial Sequence
  derived and/or modified sequence opt3 from hemagglutinin__InfluenzaA__ABD60911
augaaggccaaacugauggugcuccuuugcaccuucacagcuacuuacgcagacacgaucuguauuggcuaucacgccaacaauagcaccgauacagucgacacuguucuggagaagaacgugaccguaacacauuccgugaauuuguuagaagauucucacaacgggaaacugugccuacucaagggaauagcgccccugcagcuugguaauuguucagucgcuggcuggauccuggggaacccugagugcgaauugcucauuaguaaagagagcugguccuacaucguggaaaccccaaauccggagaacggaacuuguuaucccggcuacuuugccgacuaugaggaacugagagagcaacugucuucgguuagcucauucgaaagguuugagauuuucccuaaggagaguuccuggccaaaucauacagugaccggugucucugcaagcugcucccacaacgggaagucaaguuuuuaccggaaucucuuauggcugacgggcaaaaacggacuuuaucccaauuugagcaagucuuacgccaacaauaaagaaaaggaggugcugguacuauggggcguucaucacccuccaaacaucggggaucagcgcgcucucuaccacacugaaaacgcauauguguccgucgugucaagccauuacagucgacguuucacccccgagauagccaaaagaccuaaggugagggaccaggaaggacggaucaauuauuacuggacacugcuugagccaggugauacuauuaucuuugaggcuaacggcaaucugauugccccgugguaugcguucgcauugucucgcggguuuggauccggcaucauaaccagcaacgcccccaugggugaaugugacgcuaagugccagacaccucaaggggccauuaauucgucucucccauuccagaacguccaccccguuaccaucggagaguguccuaaauacgugagauccgcaaagcugaggaugguaacgggcuuacggaauauuccaucaauccagagucgcggccuguuuggggcuaucgccggauucauugaagguggcuggacugggaugguggauggaugguauggcuaccaucaccagaacgagcaagguagcggguacgcggccgaccagaaauccacacagaaugcaauagauggcaucaccaacaaggucaauucuauuaucgaaaagaugaacacucaguuuacagcugugggaaaagaguucaauaaacucgagcgaagaauggaaaaccuuaauaagaagguugacgauggcuuccuggacauauggaccuauaacgccgaguugcuagugcugcucgaaaacgagaggacgcuggacuuucacgauagcaaugucaaaaaccuuuacgaaaaggugaaaucacaacugaagaauaacgcuaaagagauugggaauggaugcuucgaguuuuaucauaaguguaacaaugaaugcauggagaguguaaagaacgguaccuacgacuaucccaaauacuccgaagagagcaaguugaaucgggagaaaaucgauggcguuaagcucgaaucuauggggguguaucagauccuggccauuuacucaacagucgcaaguagcuuagugcugcuagucucccucggagccaucucuuucuggaugugcucgaacggcagccugcagugucguauuugcauauga

SEQ ID NO: 122761 - RNA, 1701 nt, Artificial Sequence; identical to SEQ ID NO: 122048
  derived and/or modified sequence opt3 from hemagglutinin__InfluenzaA__ABD60922

SEQ ID NO: 122762 - RNA, 1701 nt, Artificial Sequence
  derived and/or modified sequence opt3 from hemagglutinin__InfluenzaA__ABD60933
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucgucuccaagaagucuuggucguauaucgcagagaccccaaacucagaaaauggaacauguuacccgggcuauuucgccgauuacgaggagcugagggaacaacugagcaguguguccucuuuugagcgguucgaaauuuuucccaaagagcgcagcuggccuaagcauaacguuacccgaggugugacugcuuccugcucacacaaagggaagaguagcuucuaucguaaucucuuauggcugacagagaaaaacggaucuuacccaaaucuuuccaagucauaugucaacaauaaggaaaaagagguguugguacuguggggcguucaucaccccagcaacaucgaagaccagaagaccauauacagaaaagagaaugcauacgugagugucgugucuuccaacuauaacaggcgguuuacgccugaaaucgccgagcgcccaaaggugagaggccaggcugggaggauuaauuacuauuggacucuacucgagcccggagauaccaucauuuucgaagccaacgguaaucugaucgcgccuuggcacgcauuugcccuuaaccggggcuucgggagcggaauaauuacaucgaaugcuucuauggacgagugugauacuaaaugccagaccccacaaggcgccaucaacuccucacugccguuucagaauauucaucccgucacaaucggugaauguccuaaguacguucgcaguaccaaauugcgaauggugacggggcucagaaacaucccaagcauucaguccaggggacuguucggcgcaauagcuggcuuuaucgaagggggauggacugguaugauugacggcugguauggguaccaccaucagaaugaacaaggaucuggcuaugccgcggaucaaaagagcacacagaacgccaucaaugguauaaccaacaagguaaauucagugauugagaaaaugaacacucaguucacagcagucgggaaggaguuuaauaaauuagaaaagcggauggagaaccugaacaaaaagguggacgauggcuuccucgacaucuggaccuacaaugcugaacuucugguuuugcuagagaacgaacguacgcuggacuuccacgauaguaaugugaagaaccucuacgagaaagucaagucccagcugaaaaauaacgccaaggagaucggaaauggcugcuuugaguucuaucacaaauguaacaaugagugcauggaaagcgugaagaacgggaccuacgacuaucccaaguacucugaggagucaaaacuuaaucgcgaaaagauugauggaguaaaacuggagaguauggguguuuaucagaucuuggcuauuuacagcacaguggccuccucucucguccuguuagugucgcugggcgcaaucagcuuuuggaugugcuccaacgggucacuacaguguagaauaugcauuuga

SEQ ID NO: 122763 - RNA, 1701 nt, Artificial Sequence
  derived and/or modified sequence opt3 from hemagglutinin__InfluenzaA__ABD60944
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcauaacgugacccgagguguuacugcuuccugcucacacaaagggaagaguagcuuuuaucguaaucucuuauggcugacagagaaaaacggaucuuacccaaaucuuuccaagucauaugugaacaauaaggaaaaagaggucuuggugcuguggggcguacaucaccccagcaacaucgaagaccagaagaccauauacagaaaagagaaugcauacguuaguguggucucuuccaacuauaacaggcgguucacgccugaaaucgccgagcgcccaaaggugagaggccaggcugggaggauuaauuacuauuggacucuacucgagcccggagauaccaucauuuuugaagccaacgguaaucugaucgcgccuugguacgcauucgcccuuagccggggcuuugggucgggaauaauuacaucuaacgcuuccauggacgagugugauacuaaaugccagaccccacaaggcgccaucaauucaagucugccguuccagaacgugcaccccgucacaauuggugaauguccuaaguauguucgcagcaccaaauugcgaauggugacggggcucagaaauaucccauccauccagucuaggggacuguuuggcgcaauugcuggcuucauagaagggggauggacugguaugaucgacggcugguacggguaucaucaccagaacgagcaaggaagcggcuacgccgcggaucagaagucaacacagaaugccauuaacgguaucaccaauaagguaaacagugugauagagaaaaugaauacucaguuuacagcagucgggaaggaguucaacaaauuagaaaagcggauggagaaucugaacaaaaagguggacgauggcuuccucgacauuuggaccuacaacgcugaacuucugguuuugcuagagaaugaacguacgcuggacuuucaugauuccaacgugaagaaucucuaugagaaagucaagagccaacugaaaaacaaugccaaggagaucggaaacggcugcuucgaauuuuaccacaaauguaauaacgagugcauggaaucugugaagaaugggaccuaugacuaccccaaguauucagaggagaguaaacuuaaccgcgaaaagaucgauggaguaaaacuggagagcauggguguuuaccagauuuuggcuaucuauuccacaguggccucuucgcucguccuguuagugagccugggcgcaauuuccuucuggaugugcucaaaugggagucuacaguguagaauaugcaucuga

SEQ ID NO: 122764 - RNA, 1701 nt, Artificial Sequence
  derived and/or modified sequence opt3 from hemagglutinin__InfluenzaA__ABD60955
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaauagcuccccugcagcuugguaauuguucagucgccggcuggauccuggggaacccuaaaugcgagaguuuguuuagcaaggaauccuggucuuacauugcagagacaccaaauccggaaaacggaaccuguuaucccggcuacuucgccgacuaugaggagcucagggaacaacugucgucagugagcaguuuugagcgguucgaaaucuuuccuaaggaguccucuuggccaaaucauacuguuacaaaaggugugaccacgagcugcucccacaacgggaagucaaguuucuaccgcaaucugcucugguuaacugagaaaaacggacuguaucccaaucuuagcaagucuuacgucaacaauaaagaaaaggagguguugguacuguggggcguucaucacccuuccaacauucgagaucagcgugcuaucuaccacaccgaaaacgcauaugugucagucgugagcagucauuacucuagaagguuuacaccagagauagccaagcggcccaaagugcgcgaccaggaaggcagaaucaauuauuacuggacucuacucgagccuggggauaccauuaucuucgaggcuaacggaaaucugauugccccaugguaugcguuugcacuuuccagggguuucggcagcgggaucauaacaucgaacgccucuauggacgaaugugaugcuaagugccagaccccgcaaggagccauuaauuccucacugcccuuucagaacguccacccuguuacgaucggcgaguguccaaaauacgugcggaguacuaaguugcgcaugguaacaggucuccgaaauauucccagcauccaguccagagggcuguucggagcaaucgcuggcuuuauugaaggcggguggaccggaaugauagacgguugguauggcuaccaucaccagaacgagcaagggucuggauacgccgcggaucagaaaagcacucagaaugccaucaacggcauuacaaauaaggugaacucagucaucgaaaagaugaauacccaguucacggcaguggguaaggaguucaacaaguuagagaggcggauggaaaaucugaacaaaaagguugacgauggguuucucgacauauggaccuauaacgcugagcuucugguguugcuagaaaauggccguacacuggacuuccacgauaguaacgucaaaaaucucuacgagaaggugaaaucccaacugaagaacaaugccaaggaaauuggaaacggcugcuuugaguucuaucauaaauguaauaacgagugcauggaaagcguaaagaaugggacuuacgacuauccuaaauacucugaggaaucaaaacuuaaccgcggaaaaaucgaugguguuaagcuggagaguaugggcguguaucagaucuuggcuauuuacagcaccgucgccuccucucucgugcuguuagucucgcugggggcaaucagcuuuuggaugugcuccaauggaucacuacaguguagaauuugcauauga

SEQ ID NO: 122765 - RNA, 1701 nt, Artificial Sequence; identical to SEQ ID NO: 122048
  derived and/or modified sequence opt3 from hemagglutinin__InfluenzaA__ABD61260

SEQ ID NO: 122766 - RNA, 1701 nt, Artificial Sequence; identical to SEQ ID NO: 122048
  derived and/or modified sequence opt3 from hemagglutinin__InfluenzaA__ABD61271

SEQ ID NO: 122767 - RNA, 1701 nt, Artificial Sequence; identical to SEQ ID NO: 122302
  derived and/or modified sequence opt3 from hemagglutinin__InfluenzaA__ABD61282

SEQ ID NO: 122768 - RNA, 1701 nt, Artificial Sequence; identical to SEQ ID NO: 122532
  derived and/or modified sequence opt3 from hemagglutinin__InfluenzaA__ABD61293

SEQ ID NO: 122769 - RNA, 1701 nt, Artificial Sequence; identical to SEQ ID NO: 122754
  derived and/or modified sequence opt3 from hemagglutinin__InfluenzaA__ABD61304

SEQ ID NO: 122770 - RNA, 1701 nt, Artificial Sequence; identical to SEQ ID NO: 122666
  derived and/or modified sequence opt3 from hemagglutinin__InfluenzaA__ABD61315

SEQ ID NO: 122771 - RNA, 1701 nt, Artificial Sequence; identical to SEQ ID NO: 122088
  derived and/or modified sequence opt3 from hemagglutinin__InfluenzaA__ABD61337

SEQ ID NO: 122772 - RNA, 1701 nt, Artificial Sequence
  derived and/or modified sequence opt3 from hemagglutinin__InfluenzaA__ABD61348
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaauaacaaaccauuucagaaugucaaccgaaucacuuacggcgccugucccagauauguuaagcagaauacacuuaaacuggcuaccgguaugaggaacgugccugagaagcagacucgggggauauucggagccauugcaggcuuuaucgaaaauggcugggaggggaugguagacggaugguacgguuuccgucaucaaaacagcgagggcacagggcaggcugccgacuugaaaucaacccaggcggccaucaaucaaauuaacggaaagcucaaucgccugaucgagaaaacgaacgaaaaguuucaccagauugaaaaggaguucagugaaguggagggcagaauacaggauuuagagaaauaugucgaagacaccaagaucgaucugugguccuacaacgcagagcuccuuguggcucuggaaaaucagcauacaauugacuugacugauagcgagaugaacaaacuauucgaaaggacccggaagcaacugcgagagaaugccgaggacauggguaacgggugcuuuaaaaucuaucacaagugugauaaugcuugcaucggcucuauucgcaacggaacauacgaccacgauguuuacagagacgaagcccucaauaacagguuccagauaaagggcguggagcugaaaucaggguauaaggauuggauccuuuggauuaguuuugcaaucagcugcuuccuguugugugucgugcuccugggauuuauuaugugggccugccagaaagguaauauccgguguaacauaugcaucuga

SEQ ID NO: 122773 - RNA, 1701 nt, Artificial Sequence; identical to SEQ ID NO: 122088
  derived and/or modified sequence opt3 from hemagglutinin__InfluenzaA__ABD61359

SEQ ID NO: 122774 - RNA, 1701 nt, Artificial Sequence; identical to SEQ ID NO: 122726
  derived and/or modified sequence opt3 from hemagglutinin__InfluenzaA__ABD61370

SEQ ID NO: 122775 - RNA, 1701 nt, Artificial Sequence; identical to SEQ ID NO: 122666
  derived and/or modified sequence opt3 from hemagglutinin__InfluenzaA__ABD61381

SEQ ID NO: 122776 - RNA, 1701 nt, Artificial Sequence
  derived and/or modified sequence opt3 from hemagglutinin__InfluenzaA__ABD61392
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggggcuccaacaagucauuuuucagucgccucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccagggcgagugaccguaucaacaaagcguagccaacagacuguuauucccaacaucggaaguagaccuugggugaggggugucucuucccggauuagcaucuacuggaccauagugaaaccaggcgauauucuacucaucaauuguacagggaaccugauugcgccgcgcggauauuucaagaucagaucgggcaagucuuccaucaugaggucagacgcaaguauugguaaaugcaauagcgaauguauaacccccaacggguccaucccuaaugacaagccauuucagaacgugaaucggauuacguacggagccugcccccgcuaugucaaacagaacacucuuaagcuggcuacaggcaugcgaaauguuccugagaaacaaaccagaggcaucuucggggccauagcaggauuuauugaaaacgguugggagggcaugguggaugggugguacggauucaggcaccagaauagcgagggcacuggucaggcugccgacuugaagucuacacaagcggccaucaaccagaucaaugggaaacucaaccggcugauugaaaagaccaaugagaaguuucaucagaucgaaaaagaguucucagaaguagagggccguauucaggauuuagagaaguauguggaagacacgaaaauagaucuguggaguuacaacgcagagcuccuugucgcucuggaaaaccaacacaccaucgacuugacagauuccgagaugaauaagcuauucgaacgcacuaaaaagcagcugagagagaacgccgaggacaugggaaauggcuguuuuaagauuuaucauaaaugcgauaacgcuugcaucgggagcaucaggaauggaaccuacgaccacgauguguaccgggacgaagcccucaacaaucgauuccagauuaaggguguugagcugaaaucuggcuauaaggacuggauacuuuggaucucauuugcaauuaguuguuuccuguugugcgugguccuccugggguuuaucaugugggccugucagaaaggaaacauucgcugcaauaucuguauauga

SEQ ID NO: 122777 - RNA, 1701 nt, Artificial Sequence; identical to SEQ ID NO: 122756
  derived and/or modified sequence opt3 from hemagglutinin__InfluenzaA__ABD61403

SEQ ID NO: 122778 - RNA, 1701 nt, Artificial Sequence
  derived and/or modified sequence opt3 from hemagglutinin__InfluenzaA__ABD61529
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacgcuugcaagcgaggcagcgugaacuccuuuuucucacgucugaauuggcucuaugagagugagagcaaguacccagucuuaaacgugacgaugcccaauaacgggaaauuugacaagcuguauaucuggggaguacaccauccuucuacugauaaagaacaaaccaaucuuuacguuagagcauccgguagggugacagucucaacuaagcggagccagcagaccgugauuccaaacaucggcagucgccccugggugagaggguugucuuccaggauuagcaucuacuggacaauagucaaaccuggagacauucugcuaaucaacucgaccggcaaucucauugccccacgggguuauuucaagauccgcacggggaagucuuccaucaugcgaucagaugcuccgauuggaacuuguaguagcgagugcauaacacccaacggcuccaucccuaaugacaaaccauuucagaacguuaauaagauuaccuacggcgccugucccagauaugugaaacaaaacacucugaagcuggcgacagggaugaggaauguaccugaaaaacagacccggggaaucuucggugcaauagccggcuuuauugagaacgggugggagggaaugguggacggcugguacgguuuccgucaccaaaauucugaagggacgggccaggcugccgaucuuaagagcacccaggcagcuaucgaccagaucaacggacgcuugaauagacucauugagaaaacaaacgaaaaguuccaccagaucgagaaggaauuuucagaggucgagggcaggauucaagaucuggaaaaauauguggaggacacuaagauagauuuauggaguuacaaugccgaacugcucguugcgcuugagaaccagcauaccaucgaccugacagauuccgaaaugaauaaauuguucgagaagacucggaaacagcuacgagagaacgccgaagacauggggaacggaugcuuuaagauuuaucacaagugugauaaugcaugcaucgguagcauccgcaacggcaccuacgaccaugauguguacagagacgaggcucugaauaacagguuccagauuaaaggggucgaacucaagucuggauauaaagacuggauacuguggaucucauuugccauuaguugcuuccuucugugugugguauugcucggcuuuaucaugugggcuugccaaaaggguaauauucgguguaacaucugcauauga

SEQ ID NO: 122779 - RNA, 1698 nt, Artificial Sequence; identical to SEQ ID NO: 122757
  derived and/or modified sequence opt3 from hemagglutinin__InfluenzaA__ABD61540

SEQ ID NO: 122780 - RNA, 1701 nt, Artificial Sequence
  derived and/or modified sequence opt3 from hemagglutinin__InfluenzaA__ABD61757
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacagaauacuagacggcaucaacuguacccucauagaugcucugcuuggggacccgcauugcgauggauuccagaaugagaaaugggaccuguuuguggaaaggagcaaggccuucuccaacuguuaucccuacgaugucccugacuaugcaucuuugcggucgcucguggccucaagcggcacucuggaguuuaucaaugaagguuucaacuggacagggguuacccagaauggaggcaguuccgcuugcaaacgcggcccagauaacggguuuuucucucgacugaauuggcucuacaagagcggauccacguaucccgugcaaaacgucacuaugccuaauaacgacaacucagauaaguuauacauuuggggugugcaccauccaaguaccgacaaagagcagacagaccuguauguacaggcaagcggcaagguuacugugucuaccaaacguucccagcaaacagucauccccaauguggggucaagaccuugggugaggggacuuagcagucgggucucuauuuacuggaccaucguuaagccaggcgauauauuggugauuaacuccaaugguaaccugaucgccccgcgcggguacuuuaaaaugagaacgggaaagagcucgauuaugaggucugacgcucccaucggcacuuguuccucagagugcaucacaccuaauggcaguauuccaaacgauaagcccuuccagaauguaaacaaaauaaccuauggggccuguccuaaguacgugaaacagaauacucuaaagcucgcgacaggaaugcggaacgucccagaaaaacagacccgcgguaucuuuggcgcaauugccggguucaucgagaauggaugggaaggcaugauagacgguugguauggguuucgacaccaaaacagcgagggcacgggacaggcugccgaucugaaguccacccaggcagcuauugaccaaaucaauggcaaacuuaacagagugaucgagaagacaaaugaaaaguuccaccagauugagaaagaguucucugaaguugaagggaggauccaggaucuggagaaguacguggaggacacuaaaauugauuuguggagcuauaacgccgaacuccuggucgcguuagagaaccagcauaccauagaccugacagauucagaaaugaauaagcucuuugagaaaacucggcgucaacuucgcgaaaacgccgaggacaugggaaaugguugcuucaagaucuaccacaagugugacaacgcaugcauuggcaguaucagaaaugggaccuaugaucaugacguguacagggaugaggcucugaacaaucgguuucagaucaaaggaguagaauugaaguccggcuacaaagacuggauucuauggauuagcuucgccaucucuugcuuucugcucuguguugugcugcuugguuucauuaugugggcuugccagaaggggaacauccgauguaauauuugcaucuga

SEQ ID NO: 122781 - RNA, 1701 nt, Artificial Sequence
  derived and/or modified sequence opt3 from hemagglutinin__InfluenzaA__ABD61777
augaagaccaucauugcccugagcuacauauucugccucggcuuugcucagaaacuucccgggaacgacaauuccacagcaacucuguguuugggacaccaugccgugccuaacgguacguuagucaagaccaucacaaaugaucaaauugagguuacuaacgcgaccgaacuggugcagucuucaaguacaggcagaaucugcgacagcccacacaggauucuagaugggaaaaauuguacccucaucgacgcucugcuuggagauccgcauugcgacggcuuccagaacgagaagugggaucuguuuguagaacgguccaaagccuucucuaauuguuaucccuacgacgugccugauuaugcaucguugcgcucacucgucgccagcagugguacucuggaguuuauaaacgaaggguucaauuggacaggagugacccaguccggcggcucuuacgcuugcaagcgagggagcguuaacuccuuuuucucacgucugaauuggcucuaugagagugagagcaaguacccagcauuaaacgugacgaugcccaauaacggaaaauuugacaagcuguauaucugggguguccaccauccuucuacugauaaagaacaaaccaaucuuuacgugagagccuccggcaggguaacaguuucaacuaagcggagccagcagaccgugauuccaaacaucgggagucgccccugggucagaggauugucuuccaggauuagcaucuacuggacaauagugaaaccuggcgacauucugcuaaucaacucgaccgguaaucucauugcuccacggggguauuucaagauccgcacgggaaagucuuccaucaugcgaucagaugccccgauuggcacuuguaguagcgagugcauaacacccaacggcuccaucccuaaugacaaaccauuucagaacgugaauaagauuaccuacggggcgugucccagauaugucaaacaaaacacucugaagcuggcaacaggaaugaggaauguuccugaaaaacagacccgggguaucuucggcgccauagcuggguuuauugagaacggaugggagggcaugguggacgguugguacggguuccgucaccaaaauucugaaggcacgggacaggccgcagaucuuaagagcacccaggcugccaucgaccagaucaacggcaaauugaaucgccucauugagaagacaaacgaaaaguuccaccagaucgagaaagaauuuucagagguagaggggaggauucaagaucuggaaaaguauguggaggacacuaaaauagauuuauggaguuacaaugcggaacugcucgucgcccuugagaaccagcauaccaucgaccugacagauuccgaaaugaauaaguuguucgagaaaacuagaaagcagcuacgggagaacgcagaagacaugggaaacgguugcuuuaagauuuaucacaaaugugauaaugcuugcaucggcagcauccgaaacgggaccuacgaccaugauguguaccgcgacgaggcccugaauaacagauuccagauuaagggaguugaacucaaaucuggcuauaaggacuggauacuguggaucucauuugcuauuaguugcuuccuucuguguguggucuugcucgguuuuaucaugugggccugccaaaaagggaauauuagguguaacaucugcauauga

SEQ ID NO: 122782 - RNA, 1701 nt, Artificial Sequence
  derived and/or modified sequence opt3 from hemagglutinin__InfluenzaA__ABD77598
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaccaacaggaagaaucugcgacaguccgcaucagauucucgauggugagaauuguacccugaucgacgcucuacugggcgauccccacugcgacggguuucagaacaaagaaugggauuuguucgucgagaggagcacugccuauuccaauuguuacccuuaugacgugccagauuacgcaucucuccggucgcugguugccucaagcggaacacuggaauuuaacaaugagaguuucaacuggaccggcguggcucagaaugguacguccucugcaugcaagcgccgaagcauaaaauccuuuuucucacgucucaacugguuacaucaacugaaguauaaguaccccgcccuuaaugucacuaugccuaacaaugagaaauuugacaaguuguauaucuggggagugcaccacccaaguaccgauagcgaccagauuucucuguacgcucaggccuccgggagaguaacaguuucaacuaaaaggagccagcaaaccgugauccccaacauuggcagucggccuuggguccgcggcgugucuuccagaaucagcauauacuggacaauugugaagccaggggauauccuacucauuaacucgaccggaaaucugaucgcgccgagggguuauuucaaaauccggucuggcaaguccucaauuaugcgcaguaacgcacccauagggaaguguaauagcgaaugcaucacgccuaacggauccauuccaaaugacaaacccuuucagaacgucaaucgaaucacuuacggcgccuguccuagauauguuaagcagaacacacuuaaacuggcuaccgguaugaggaaugugccagagaagcagacucgggggauauucggagccauugcaggcuuuaucgaaaacggcugggaggggaugguagacggaugguacgguuuccgucaucaaaauucugagggcacagggcaggcugccgauuugaaaagcacccaggcggccaucaaccaaauuaauggaaagcucaaccgccugaucgagaaaacgaaugaaaaguuucaccagauugaaaaggaguucucagaaguggagggcagaauacaggacuuagagaaauaugucgaagauaccaagaucgaccuguggaguuacaacgcagagcuccuuguggcucuggaaaaccagcauacaauugauuugacugacuccgagaugaauaaacuauucgaaaggacccggaagcaacugcgagagaacgccgaggauauggguaaugggugcuuuaaaaucuaucacaagugugacaacgcuugcaucggcagcauucgcaauggaacauacgaucacgacguuuacagagaugaagcccucaacaauagguuccagauaaagggcguggagcugaaaucuggguauaaggacuggauccuuuggauuucauuugcaaucaguugcuuccuguugugugucgugcuccugggauuuauuaugugggccugccagaaagguaacauccgguguaauauaugcaucuga

SEQ ID NO: 122783 - RNA, 1701 nt, Artificial Sequence; identical to SEQ ID NO: 122666
  derived and/or modified sequence opt3 from hemagglutinin__InfluenzaA__ABD77609

SEQ ID NO: 122784 - RNA, 1701 nt, Artificial Sequence; identical to SEQ ID NO: 122666
  derived and/or modified sequence opt3 from hemagglutinin__InfluenzaA__ABD77620

SEQ ID NO: 122785 - RNA, 1701 nt, Artificial Sequence; identical to SEQ ID NO: 122666
  derived and/or modified sequence opt3 from hemagglutinin__InfluenzaA__ABD77631

SEQ ID NO: 122786 - RNA, 1701 nt, Artificial Sequence; identical to SEQ ID NO: 122666
  derived and/or modified sequence opt3 from hemagglutinin__InfluenzaA__ABD77642

SEQ ID NO: 122787 - RNA, 1701 nt, Artificial Sequence; identical to SEQ ID NO: 122666
  derived and/or modified sequence opt3 from hemagglutinin__InfluenzaA__ABD77653

SEQ ID NO: 122788 - RNA, 1698 nt, Artificial Sequence; identical to SEQ ID NO: 122757
  derived and/or modified sequence opt3 from hemagglutinin__InfluenzaA__ABD77708

SEQ ID NO: 122789 - RNA, 1698 nt, Artificial Sequence
  derived and/or modified sequence opt3 from hemagglutinin__InfluenzaA__ABD77719
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggaggugcuaguucucuggggcgugcaucacccuccaaacaucggggaucagcgcgcccuguaccacacugaaaacgcuuaugucuccguggugucaagccauuacagucgacguuucacccccgagauagcaaaaagaccuaaggucaggaaucaggaaggacggaucaacuauuacuggacacuucuggagccaggugacacuauuaucuuugaggccaauggcaacuugauugcuccgcgcuaugccuucgcgcucucuagaggguuuggauccggcaucauaaccagcaaugcacccauggaugaaugugacgccaagugccagacaccucaaggugcuauuaacucgucucugccauuccagaauguucaccccgugaccaucggggaguguccuaaauacguaagguccgccaaguuacggauggugacgggacugcgcaacauuccaucaauccagagucgaggccucuuuggcgcaaucgcuggguucauugaaggagguuggacuggcauggucgaugggugguauggauaccaucaccagaaugagcaaggcagcgguuacgccgcggaccagaaauccacacagaacgccauaaaugggaucaccaacaagguaaauucuguuauugaaaagaugaacacucaguuuacagcagugggcaaagaguucaauaaacuugagagaaggauggaaaaccugaacaagaaggucgaugacggauucuuggauaucuggaccuauaaugcugagcuacuggugcuccuggaaaacgagcggacgcuugacuuucacgacagcaauguuaaaaaccuguacgaaaagguaaaaucacaauugaagaauaacgccaaagagauaggcaaugggugcuucgaguuuuaucauaaguguaacaaugaaugcauggagagugugaagaacggaaccuacgauuaucccaaauacuccgaagagagcaagcucaaucgugagaaaauugacggugucaagcuggaaucuaugggcguguaucagaucuuagcuaucuacucaacagucgccaguagccuggugcuacucguuucccugggggcaauuucuuucuggaugugcucgaacggaagccuucagugucgcaucugcauuuga

SEQ ID NO: 122790 - RNA, 1698 nt, Artificial Sequence; identical to SEQ ID NO: 122757
  derived and/or modified sequence opt3 from hemagglutinin__InfluenzaA__ABD77730

SEQ ID NO: 122791 - RNA, 1701 nt, Artificial Sequence; identical to SEQ ID NO: 122666
  derived and/or modified sequence opt3 from hemagglutinin__InfluenzaA__ABD77752

SEQ ID NO: 122792 - RNA, 1701 nt, Artificial Sequence; identical to SEQ ID NO: 122666
  derived and/or modified sequence opt3 from hemagglutinin__InfluenzaA__ABD77763

SEQ ID NO: 122793 - RNA, 1701 nt, Artificial Sequence
  derived and/or modified sequence opt3 from hemagglutinin__InfluenzaA__ABD77774
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugauaacauugagguaacuaaugcgaccgaacuugugcaaucuucaaguacaggaagaaucugcgacagcccacaccagauucucgauggugagaacuguacccugaucgacgcucuacugggcgauccgcauugcgacggguuucagaauaaagaaugggauuuguucgucgagagguccacugccuauucuaacuguuaccccuaugacgugccugauuacgcaucgcuccggucacugguugccagcaguggaacacuggaauuuaauaacgaguccuucaauuggaccggcguggaccagaacgguacgucuagcgcuugcaagcgccgauccaauaaaucauuuuucagucgucucaacugguuacaccaacugaaguauaaguacccagcacuuaaugucacuaugcccaacaacgagaaauuugauaaguuguauauauggggagugcaucacccuagcaccgacucugaucagaucucccuguacgcccaggcuucagggagaguaacaguuagcacuaaaaggagucagcaaaccgugauuccaaauaucggcucucggcccuggguccgcggcguguccagcagaauuucgaucuacuggacaauagugaagccuggggacauucuacucaucaacucuaccggaaaucugauugccccaagggguuauuucaaaauccgguccggcaagucaaguaucaugcgcagcaacgcgccgauugggaaguguaauuccgaaugcauaacgcagaacggaucuauccccaaugacaaaccuuuucagaacgucaaucgaauuacuuacggcgcauguccaagauauguuaagcagaacacacuuaaacuggccaccgguaugaggaaugugcccgagaagcaaacucgggggaucuucggagcuauagccggcuuuauugaaaacggcugggaggggaugguagauggaugguacgguuuccgucaccagaauagcgagggcacagggcaggcagcugacuugaaaucaacccaagccgcgaucaaccagaucaauggaaagcucaaccgccugauugagaaaacgaacgaaaaguuucaucagaucgaaaaggaguucagugaaguggagggcaggauucaggauuuagagaaauaugucgaagacaccaagauagaucugugguccuacaaugccgagcuccuuguggcacuggaaaaccaacacacaaucgacuugacugauagcgagaugaauaaacuauucgaaagaacccggaagcagcugcgagagaacgcugaggacauggguaaugggugcuuuaaaauuuaucauaagugugauaacgccugcaucggcucuauccgcaauggaacauacgaccacgauguuuacagagacgaagcucucaacaauagguuccagauuaagggcguggagcugaaaucaggguauaaggacuggauacuuuggaucaguuuugccauuagcugcuuccuguugugugucgugcuccugggauuuaucaugugggcaugccagaaagguaacauucgguguaauaucugcauauga

SEQ ID NO: 122794 - RNA, 1701 nt, Artificial Sequence; identical to SEQ ID NO: 122793
  derived and/or modified sequence opt3 from hemagglutinin__InfluenzaA__ABD77785

SEQ ID NO: 122795 - RNA, 1701 nt, Artificial Sequence
  derived and/or modified sequence opt3 from hemagglutinin__InfluenzaA__ABD77807
augaaggccaaacugcucauccuucugugcgcuuugagcgcaaccgacgccgauacaauuuguauaggcuaccacgcgaacaauuccacugacacgguggauaccgucuuagagaagaacguuacagugacucauucuguaaaucugcuagaagacucacacaacgggaaacucugcagacugaagggaaucgcuccccuucagcuggguaaauguaauauugccggcuggaucuuggggaacccugagugcgaaagucuccugagcaagagguccuggucuuauauugcagagaccccaaauucggaaaacggaacauguuacccgggcgauuucgccgacuaugaggagcugcgggaacaacucucaagcgugaguuccuuugagcgcuucgaaaucuuucccaaggagcgaucuuggccuaaacauaauauaacccguggugucacugcugcaugcagccacgccgggaaguccucauucuacaaaaacuuacuguggcuuacagagaccaauggaaguuauccaaaguugagcaaaucuuacgugaacaauaaggaaaaggagguucuggugcuauggggcguccaucaccccuccaacaucgaagaucagaaaacgcucuauagaaaggagaaugcuuacgugucaguaguuagcaguaacuacaacaggcgguuuacuccugaaauugccgagcgcccaaaagugagaggccaggcggggaggaugaauuauuacuggacccugcuugagcccggagacacaaucauuuucgaagcaaacgguaaucugaucgccccuugguaugcuuuugccuugucucggggcuucggguccggaauaauuacuagcaacgcaucgauggaugagugugacaccaagugccagacaccacaaggcgcuaucaauucuucccucccguuucagaacauucaccccgucaccaucggugaauguccuaaauacgugaagucaacgaaacugcgcauggugacuggguuacgaaauaucccaaguauucagagcagaggacuguucggcgccauagcgggcuuuaucgaagggggauggacagguaugauugauggcugguauggguaccaucaccagaacgaacaaggauccggcuaugccgcagaccagaagucuacccagaaugcuaucaacgguauaacuaauaaggucaacagcguuauugagaaaaugaauacacaguucaccgccguggggaaggaguuuaacaaacucgaaaagaggauggagaaucuuaacaaaaagguagaugacggcuuccuggacaucuggacguacaacgcugaauugcuagugcugcucgagaaugaacggacccuggauuuccaugacucaaacgucaagaaucuuuacgagaaagugaagaaccaacugcguaauaacgccaaagagaucggaaauggcugcuuugaguucuaucacaaguguaacaaugagugcauggaaaguguuaaaaacgggacauacgauuaucccaaguacuccgaggagagcaaguugaaucgcgagaaaauugacggagugaagcucgaaucuaugggugucuaucagauccuggcaauuuacucaacuguggccaguagcuuaguacugcuaguuucccucggcgcuauaucuuuuuggaugugcucgaacgggagccugcaguguagaaucugcauuuga

SEQ ID NO: 122796 - RNA, 1701 nt, Artificial Sequence
  derived and/or modified sequence opt3 from hemagglutinin__InfluenzaA__ABD77818
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagagcuccuggccuaagcauaccgugacucgcgguguuacagcuucaugcagucacaaagggaaaagcucuuuuuaucgaaaccucuuauggcugaccgagaaaaauggauccuacccaaaccuuucaaagagcuaugugaauaacaaggaaaaagaggucuuggugcuguggggcguacaucaccccaguaauaucgaagaccagaagacgauauaccguaaagagaacgcauacguuucuguggucuccagccacuauaauagaagguucacuccugaaaucgccaagcggccaaaagugcgcgaucaggagggcagaauuaacuacuauuggacccuacucgagcccggggacacaaucauuuuugaagcuaacggaaaucugaucgccccuugguacgcguucgcacuuucgagggguuuuggcucugggauaauuacuuccaacgccucaauggaugagugugacgcuaagugccagaccccacaaggagccaucaauaguagccugccguuccagaacgugcaucccgucacaauuggcgaauguccuaaauauguucgguccaccaaguugcgcauggugacgggucuccgaaauaucccaucuauccagagcagagggcuguuuggagcaauugcuggcuucauagagggcggguggacuggaaugaucgaugguugguacggcuaucaccaucagaacgaacaagggucaggauacgccgcggaccagaagaguacacagaaugccauuaacggcaucaccaauaaaguaaacuccgugauagagaagaugaauacucaguuuacagcagucgguaaagaguucaacaaguuagaaaagaggauggagaaucugaacaagaagguggaugacggguuccucgacauuuggaccuacaaugcugaacuucugguuuugcuagagaacgaacggacgcuggauuuucacgacagcaacgugaaaaaucucuaugagaaggucaaaucucaacugaagucaaacgccaaagagaucggcaauggaugcuucgaauuuuaccacaaguguaacaaugagugcauggaaagugugaagaacggcaccuaugauuaccccaaauauagcgaggaguccaaacuuaaucgugaaaagaucgacgggguaaagcuggagucuaugggaguuuaccagauuuuggcuaucuauucgacaguggccagcucccucguccuguuagugucacugggugcaauuaguuucuggaugugcucuaacggcagccuacagugucgcauaugcaucuga

SEQ ID NO: 122797 - RNA, 1701 nt, Artificial Sequence
  derived and/or modified sequence opt3 from hemagglutinin__InfluenzaA__ABD77829
augaagaccaucauugcccugagcuacauacucuaucuuguguucgcucagaaacugcccggcaacgacaauuccacagcaacuuugugcuuagggcaccaugccgucccuaacggaacgcugguuaagaccaucacaaaugaucaaauugaggugacuaacgcgaccgagcuaguacagucuucaaguacagguagacucugugacagcccacacaggauccuggauggcaaaaauugcacccuuauugacgcucuguugggggauccgcauugugacggauuucagaacaaggaaugggaucucuucguggaacgguccaaagccuacucugacugcuaucccuacgaugucccugacuaugcaucgcugcgcucacugguggccagcaguggcacucucgaguuuacaaaugaagguuucaacuggaccgggguugcucagaauggaacguccuacgcauguaagcgaggcucugugaaguccuuuuucucccguuuaaacuggcugcacaaacuugaguauaaguacccagccuugaaugucacuaugcccaacaaugauaaauuugacaagcuguacaucuggggcgugcaucacccuucaaccgauagugaccaaacaagccuauauguacaggcuucugggagaguuacuguguccaccaaaaggucacagcagacagucauaccaaacaucggaagccggcccugggugcgcggugugaguucuagaauuuccaucuacuggaccauugucaagccuggcgacauccuccugauaaauagcacggggaaccuuauugccccaaggggauauuucaagauccggucgggcaaaucuuccauuaugcgcucagaugcgccgaucgguaacugcaauagugaguguaucacucccaacgggagcauuccuaaugacaagccauuucaaaacguuaaucgaauaacauacggagcaugccccagauaugugaaacagaacacccugaaguuggccacuggcaugaggaauguaccugaaaaacagacacggggcaucuucggggcuauugccggauuuaucgagaacgguugggaaggcaugguggaugggugguacggauuccgucaccagaauagcgagggcaccggucaagcagcugaccucaagucuacgcaggccgcgauaaaccagauuaaugggaaacugaaccgcuuaaucgagaagaccaaugaaaaguuucaucaaaucgagaaagaguucagcgaagucgaaggcaggauucaggaucuggagaaguauguggaggacacaaaaaucgaucucuggucauacaacgccgaacuucugguugcauuggagaaucagcacacuauugaccuaaccgauagugaaaugaacaagcuguucgagagaacacggaaacagcuccgagaaaacgcugaggacaugggaaauggcuguuuuaagauauaccauaagugcgauaacgccuguaucggguccauucgcaauggaacuuaugaccacgacguguacagagaugaggcucugaacaauagguuccaaaucaaaggugucgaacuuaagagcggcuauaaagacuggauccuguggauuucuuuugccauaucaugcuucuugcucugcgugguacuguuaggguuuaucaugugggcaugucagaagggaaacauucggugcaauaucuguauuuga

SEQ ID NO: 122798 - RNA, 1701 nt, Artificial Sequence
  derived and/or modified sequence opt3 from hemagglutinin__InfluenzaA__ABD77862
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucugacuguuaccccuaugaugucccugacuacgcaucgcuccgcucacugguggccagcaguggcacucuggaguuuacaaaugaagguuucaacuggaccgggguugcucaggauggaacguccuaugcaugcaagcgaggcucugucaagagcuuuuucucccgucucaauugguuacacaaacuggaguacaaguauccagcccuuaacgugacuaugcccaauaacgacaaauuugauaaguuguacauauggggcgugcaucacccuucaaccgacagugaccaaacaagcaucuacguacaggcuucugggagaguuacuguguccaccaaaaggucacagcagacagucauuccaaauaucggaagccggcccugggugcgcggugugaguucuagaauuuccaucuauuggaccauagucaagccuggcgauauucugcuaaucaacagcacggggaaucucauugccccaaggggauacuucaagauccggucgggcaaaucuuccaucaugcgcucagacgcgccgauugguaacuguaacagugagugcauaacucccaaugggagcaucccuaacgauaagccauuucaaaauguuaaccgaauuacauauggagcaugucccagauacgugaaacagaauacccugaaacuugccacuggcaugaggaacguaccugaaaagcagacacggggcaucuucggggcuauagccggauuuauugagaaugguugggaaggcaugguggacgggugguauggauuccgucaccagaacuccgagggcaccggucaagcagcugaucugaagucuacgcaggccgcgaucaaucagaucaacgggaaauugaaucgccucauugagaagaccaacgaaaaguuucaucaaaucgagaaagaguucagcgaagucgaaggcaggauucaggaccuggagaaguacguggaggauacaaaaauagacuuauggucauauaaugccgaacugcucguugcacuugagaaccagcacacuaucgaucugaccgacagugaaaugaauaaguuguucgagagaacacggaaacagcuacgagaaaacgcugaggauaugggaaacggcugcuuuaagauuuaccauaagugugacaaugccugcaucggguccauccgcaacggaacuuacgaccacgauguguauagagacgaggcucugaauaacagguuccaaauuaaaggugucgaacucaagagcggcuacaaagauuggauacuguggaucucuuuugccauuucaugcuuccuucugugugugguauugcucggguuuaucaugugggcaugccagaagggaaauauucgguguaacaucugcauauga

SEQ ID NO: 122799 - RNA, 1701 nt, Artificial Sequence
  derived and/or modified sequence opt3 from hemagglutinin__InfluenzaA__ABD77884
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacaggguucuucaacaggcagaaucugcgacaguccacacaggauucucgaugggaaaaauuguacccugaucgacgcucugcugggagauccgcauugcgacggcuuucagaacaaggaaugggauuuguucguggaacggagcaaagccuauuccaauuguuaccccuaugacgucccugauuacgcaucucuccgcucgcugguggccucaagcgguacucuggaguuuaacaaugaaaguuucaacuggacagggguugcucagaauggaaccuccuaugcaugcaagcgacguucugugaaguccuuuuucuccagacucaacugguuacacaaacuggaguacaaguauccagcccuuaaugucacgaugcccaacaaugacaaauuugauaaguuguacauauggggcgugcaucacccuucaacugacagugaucaaaccagccuguacguacaggcuucuggcaggguuacaguguccacuaaacggucacagcagaccgucaucccaaacauugggagccgccccugggugagaggagugaguucuaggaucuccauuuauuggacaaucgucaagccuggugacauacuacucauuaacagcaccggcaaucugaucgccccacggggguacuucaagauucgcucgggaaaaucuuccaucaugcgaucagacgcgccgaucgauaacuguaauagugagugcauuacgcccaacggcagcauaccuaaugacaagccauuucaaaacguuaauagaaucacuuauggugcaugucccagguacgugaaacagaacacacuuaagcuggccaccgggaugcggaauguaccugaaaaacagacucguggaauuuucggcgcuaucgccggcuuuauagagaacgggugggaaggaaugguggaugguugguauggcuuccgccaccagaauagcgaggggacaggacaagcagcugacuugaagucuacccaggccgcgauuaaccagaucaauggcaaacucaacagacugaucgagaagacgaaugaaaaguuucaucaaauugagaaagaguucagcgaagucgaagguaggauccaggauuuagagaaguacguggaggacaccaaaauugaucuguggucauauaacgccgaacuccuuguugcacuggagaaccagcacacaauagacuugacugauagugaaaugaauaagcuauucgagcggacccgaaaacagcugcgcgaaaacgcugaggacauggggaauggcugcuuuaagaucuaccauaagugugauaacgccugcauuggauccaucagaaauggcacauacgaccacgacguguauagggaugaggcucucaacaaucgguuccaaaucaaaggggucgaacuuaagagcggauacaaagacuggauucuuuggauaucuuuugccaucucaugcuuccuguugugugugguacuccuggguuuuauuaugugggcaugccagaagggcaacauccgcuguaauauuugcaucuga

SEQ ID NO: 122800 - RNA, 1701 nt, Artificial Sequence
  derived and/or modified sequence opt3 from hemagglutinin__InfluenzaA__ABD77895
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuaacaaugaauccuucaacuggacagguguugcucagaaugggaccucuuaugcaugcaagcgacguagcgugaaguccuuuuucucaagacucaacugguuacacaaacuggaguacaaguauccagcccuuaaugucacgaugcccaacaaugacaaauuugauaaguuguacauauggggagugcaucacccuaguacugacagcgaucaaaccucucuguacguacaggcuuccggcaggguuacagugucaacuaaacggagccagcagaccgucaucccaaacauuggcagucgccccugggugagagggaucucuuccaggauuagcaucuauuggacaauagugaagccuggagacauucuacucaucaacucgaccgguaaucugauugccccacggggcuacuucaagauccgcucugggaaauccucaaucaugcgaagugacgcgccgauugauaacuguaauagcgagugcauaacgcccaacggauccaucccuaaugacaagccauuucaaaacgucaauagaauuacuuauggcgcaugucccagguacguuaaacagaacacacuuaagcuggccaccgguaugcggaaugugccugaaaaacagacucgugggaucuucggagcuauagccggcuuuauugagaacggcugggaagggaugguagauggaugguaugguuuccgccaccagaauagcgagggcacagggcaagcagcugacuugaagucuacccaggccgcgaucaaccagaucucaggaaaacucaauagacugauugagaagacgaacgaaaaguuucaucaaaucgagaaagaguucagugaaguggaaggcaggauucaggauuuagagaaguacgucgaggacaccaaaauagaucugugguccuauaaugccgaacuccuuguggcacuggagaaccagcacacaaucgacuugacugauagcgaaaugaacaagcuauucgagcggacccgaaaacagcugcgcgaaaaugcugaggacauggguaacgggugcuuuaagauuuaccauaagugugauaaugccugcaucggcucuaucagaaacggaacauacgaccacgacguuuauagggaugaggcucucaauaaccgguuccaaauuaaaggcguggaacugaagucaggguacaaagacuggauacuuuggaucaguuuugccauuagcugcuuccuguugugugucgugcuccugggauuuaucaugugggcaugccagaaggguaauauucgcuguaacaucugcauauga

SEQ ID NO: 122801 - RNA, 1701 nt, Artificial Sequence; identical to SEQ ID NO: 122799
  derived and/or modified sequence opt3 from hemagglutinin__InfluenzaA__ABD77906

SEQ ID NO: 122802 - RNA, 1698 nt, Artificial Sequence
  derived and/or modified sequence opt3 from hemagglutinin__InfluenzaA__ABD77917
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcaagucuuacgcaaacaauaaagaaaaggaggugcuaguucucuggggcgugcaucacccuccaaacaucgggaaccagaaagcccuguaccacacugaaaaugcuuaugucuccguggugucaagccauuacagucgccgauucacccccgagauagcaaagcguccuaaggucagagaucaggaaggaaggaucaacuauuacuggacacuucuggagccaggugacacuauuaucuuugaggccaauggcaacuugauugcuccgcgguaugccuucgcgcucucucgcggguuuggauccggcaucauaaccagcaaugcacccauggaugaaugugacgccaaaugccagacaccucaaggugcuauuaacucgucucugccauuccagaauguucaccccgugaccaucggggaguguccuaaguacguaagauccgccaaauuaaggauggugacgggacugcggaacauuccaucaauccagagucgcggccucuuuggcgcaaucgcuggguucauugaaggagguuggacuggcauggucgaugggugguauggauaccaucaccagaaugagcaaggcagcgguuacgccgcggaccagaaguccacacagaacgccauaaaugggaucaccaacaaaguaaauucuguuauugaaaagaugaacacucaguuuacagcagugggcaaagaguucaauaaacuugagcgaagaauggaaaaccugaacaagaaagucgaugacggauucuuggauaucuggaccuauaaugcugagcuacuggugcuccuggaaaacgagaggacgcuugacuuucacgacagcaauguaaagaaccuguacgaaaaaguuaagucacaauugaaaaauaacgccaaggagauaggcaaugggugcuucgaguuuuaucauaaguguaacaaugaaugcauggagagugugaaaaacggaaccuacgauuaucccaaguacuccgaagagagcaaacucaaucgggagaagauugacggugucaaacuggaaucuaugggcguguaucagaucuuagcuaucuacucaacagucgccaguagccuggugcuacucguuucccugggggcaauuucuuucuggaugugcucgaacggaagccuucagugucguaucugcauuuga

SEQ ID NO: 122803 - RNA, 1698 nt, Artificial Sequence
  derived and/or modified sequence opt3 from hemagglutinin__InfluenzaA__ABD77928
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcaagucuuacgcaaacaauaaagaaaagaaaguucuaguacucuggggcgugcaucacccuccaaacaucggggaucagaaggcccuguaccacacugagaacgcuuaugucuccguggugucaagccauuacagucgccgauucacccccgaaauagcaaagcguccuaaagucagagaccaggagggaaggaucaauuauuacuggacacuucuggaaccaggugauacuauuaucuuugaggccaacggcaauuugauugcuccgcgguaugccuucgcgcucucucgcggguuuggauccggcaucauaaccagcaacgcacccauggacgagugugaugccaagugccagacaccucaaggugcuauuaauucgucucugccauuccagaacguucaccccgugaccaucggggaauguccuaaauacguaagauccgccaaguuaaggauggugacgggacugcggaauauuccaucaauccagagucgcggccucuuuggcgcaaucgcuggguucauugagggagguuggacuggcauggucgacgggugguauggauaccaucaccagaacgaacaaggcagcgguuacgccgcggaucagaaauccacacagaaugccauaaacgggaucaccaauaaggugaacucuguuauugagaaaaugaauacucaguuuacagcagugggcaaggaguucaacaaacuugaacgaagaauggagaaucugaacaaaaaggucgacgauggauucuuggacaucuggaccuauaacgcugaacuacuggugcuccuggagaaugaaaggacgcuugacuuucacgauagcaacguuaaaaaucuguacgagaagguaaaaucacaauugaagaacaaugccaaggaaauaggcaacgggugcuucgaguuuuaucauaaauguaauaacgagugcauggaaagugugaagaauggaaccuacgacuaucccaaauacuccgaggaaagcaagcucaaccgggagaaaauugauggugucaagcuggagucuaugggcguguaucagaucuuagcuaucuacucaacagucgccaguagccuggugcuacucguuucccugggggcaauuucuuucuggaugugcucgaauggaagccuucagugucguaucugcauuuga

SEQ ID NO: 122804 - RNA, 1698 nt, Artificial Sequence; identical to SEQ ID NO: 122758
  derived and/or modified sequence opt3 from hemagglutinin__InfluenzaA__ABD77939

SEQ ID NO: 122805 - RNA, 1698 nt, Artificial Sequence; identical to SEQ ID NO: 122758
  derived and/or modified sequence opt3 from hemagglutinin__InfluenzaA__ABD77950

SEQ ID NO: 122806 - RNA, 1698 nt, Artificial Sequence; identical to SEQ ID NO: 122757
  derived and/or modified sequence opt3 from hemagglutinin__InfluenzaA__ABD77961

SEQ ID NO: 122807 - RNA, 1698 nt, Artificial Sequence; identical to SEQ ID NO: 122758
  derived and/or modified sequence opt3 from hemagglutinin__InfluenzaA__ABD77983

SEQ ID NO: 122808 - RNA, 1698 nt, Artificial Sequence; identical to SEQ ID NO: 122758
  derived and/or modified sequence opt3 from hemagglutinin__InfluenzaA__ABD77994

SEQ ID NO: 122809 - RNA, 1698 nt, Artificial Sequence; identical to SEQ ID NO: 122757
  derived and/or modified sequence opt3 from hemagglutinin__InfluenzaA__ABD78005

SEQ ID NO: 122810 - RNA, 1698 nt, Artificial Sequence; identical to SEQ ID NO: 122757
  derived and/or modified sequence opt3 from hemagglutinin__InfluenzaA__ABD78016

SEQ ID NO: 122811 - RNA, 1698 nt, Artificial Sequence; identical to SEQ ID NO: 122758
  derived and/or modified sequence opt3 from hemagglutinin__InfluenzaA__ABD78027

SEQ ID NO: 122812 - RNA, 1698 nt, Artificial Sequence; identical to SEQ ID NO: 122758
  derived and/or modified sequence opt3 from hemagglutinin__InfluenzaA__ABD78038

SEQ ID NO: 122813 - RNA, 1701 nt, Artificial Sequence; identical to SEQ ID NO: 122793
  derived and/or modified sequence opt3 from hemagglutinin__InfluenzaA__ABD78049

SEQ ID NO: 122814 - RNA, 1698 nt, Artificial Sequence; identical to SEQ ID NO: 122312
  derived and/or modified sequence opt3 from hemagglutinin__InfluenzaA__ABD78060

SEQ ID NO: 122815 - RNA, 1698 nt, Artificial Sequence
  derived and/or modified sequence opt3 from hemagglutinin__InfluenzaA__ABD78071
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuauuacuggacacuucuggaaccaggcgauacuauuaucuuugaggccaacgggaauuugauugcuccgugguaugccuucgcgcucucuggaggcuuugguuccgggaucauaaccagcaacgcacccaugggagagugugacgccaagugccagacaccucaaggcgcuauuaauucgucucugccauuccagaacguucaccccgugaccaucggcgaauguccuaaguacguacgcuccgccaaauuaagaauggugacggggcugaggaauauuccaucaauccagagucggggacucuuuggugcaaucgcuggcuucauugaagggggauggacuggcauggucgaugguugguauggguaccaucaccagaacgaacaaggcagcggauacgccgcggaccagaaguccacacagaaugccauaaacggcaucaccaauaaagugaacucuguuauugagaagaugaauacucaguuuacagcaguggggaaagaguucaacaagcuagagcgccgaauggagaaucugaacaaaaaggucgaugacggauucuuggauaucuggaccuauaacgcugaacuacuggugcuccuggagaaugaaagaacgcuugacuuucacgacagcaacguaaagaaucuguacgagaaaguuaagucacaauugaaaaacaaugccaaggaaauagguaacggcugcuucgaguuuuaucauaaauguaauaacgagugcauggaaagugugaagaaugggaccuacgauuaucccaaguacuccgaggaaagcaaacucaacagggagaagauugacggagucaaacuggagucuaugggcguguaucagaucuuagcuaucuacucaacagucgccaguagccuggugcuacucguuucccugggugcaauuucuuucuggaugugcucgaaugggagccuucagugucggaucugcauuuga

SEQ ID NO: 122816 - RNA, 1698 nt, Artificial Sequence
  derived and/or modified sequence opt3 from hemagglutinin__InfluenzaA__ABD78093
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuauuacuggacacuucuggaaccaggcgauacuauuaucuuugaggccaacgggaauuugauugcuccgugguaugccuucgcgcucucucgcggauuuggcuccgguaucauaaccagcaacgcacccaugggggagugugacgccaagugccagacaccucaaggagcuauuaauucgucucugccauuccagaacguucaccccgugaccaucggcgaauguccuaaguacguaagauccgccaaauuaaggauggugacgggccugcggaauauuccaucaauccagagucgcgggcucuuuggagcaaucgcugguuucauugagggcggguggacuggaauggucgauggcugguaugguuaccaucaccagaacgaacaagggagcggcuacgccgcggaccagaaguccacacagaaugccauaaacggaaucaccaauaaagugaacucuguuauugagaagaugaauacucaguuuacagcagugggcaaagaguucaacaagcuagaacgaagaauggagaaucugaacaaaaaggucgaugacggguucuuggauaucuggaccuauaacgcugaacuacuggugcuccuggagaaugaaaggacgcuugacuuucacgacagcaacguaaagaaucuguacgagaaaguuaagucacaauugaaaaacaaugccaaggaaauaggaaacgguugcuucgaguuuuaucauaaauguaauaacgagugcauggaaagugugaagaauggcaccuacgauuaucccaaguacuccgaggaaagcaaacucaaccgggagaagauugacggggucaaacuggagucuaugggaguguaucagaucuuagcuaucuacucaacagucgccaguagccuggugcuacucguuucccugggcgcaauuucuuucuggaugugcucgaaugguagccuucagugucguaucugcauuuga

SEQ ID NO: 122817 - RNA, 1701 nt, Artificial Sequence
  derived and/or modified sequence opt3 from hemagglutinin__InfluenzaA__ABD78115
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucugacuguuaccccuaugaugucccugacuacgcaucgcuccgcucacugguggccagcaguggcacucuggaguuuacaaaugaagguuucaacuggaccgggguugcucaggauggaacguccuaugcaugcaagcgaggcucugucaagagcuuuuucucccgucucaauugguuacacaaacuggaguacaaguauccagcccuuaacgugacuaugcccaauaacgacaaauuugauaaguuguacauauggggcgugcaucacccuucaaccgacagugaccaaacaagccuguacguacaggcuucugggagaguuacuguguccaccaaaaggucacagcagacagucaucccaaauauuggaagccggcccugggugcgcggugugaguucuagaaucuccauuuauuggaccaucgucaagccuggcgauauacuacucauuaacagcacggggaaucugaucgccccaaggggauacuucaagauucggucgggcaaaucuuccaucaugcgcucagacgcgccgaucgguaacuguaacagugagugcauuacucccaaugggagcauaccuaacgauaagccauuucaaaauguuaaccgaaucacauauggagcaugucccagauacgugaaacagaauacccuuaagcuggccacuggcaugaggaacguaccugaaaaacagacacggggcauuuucggggcuaucgccggauuuauagagaaugguugggaaggcaugguggacgggugguauggauuccgucaccagaacuccgagggcaccggucaagcagcugauuugaagucuacgcaggccgcgauuaaucagaucaacgggaaacucaaucgccugaucgagaagaccaacgaaaaguuucaucaaauugagaaagaguucagcgaagucgaaggcagaauccaggacuuagagaaguacguggaggauacaaaaauugaccuguggucauauaaugccgaacuccuuguugcacuggagaaccagcacacuauagauuugaccgacagugaaaugaauaagcuauucgagaggacacggaaacagcugcgagaaaacgcugaggauaugggaaacggcugcuuuaagaucuaccauaagugugacaaugccugcauuggguccauccgcaacggaacuuacgaccacgauguguauagaaaugaggcucucaacaauagguuccaaaucaaaggugucgaacuuaagagcggcuacaaagacuggauucuuuggauaucuuuugccaucucaugcuuccuguugugugugguacuccugggguuuauuaugugggcaugccagaagggaaacauccgguguaauauuugcaucuga

SEQ ID NO: 122818 - RNA, 1701 nt, Artificial Sequence
  derived and/or modified sequence opt3 from hemagglutinin__InfluenzaA__ABD78126
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucugacuguuaccccuaugaugucccugacuacgcaucgcuccgcucacugguggccagcaguggcacucuggaguuuacaaaugaagguuucaacuggaccgggguugcucaggauggaacguccuaugcaugcaagcgaggcucugucaagagcuuuuucucccgucucaauugguuacacaaacuggaguacaaguauccagcccuuaacgugacuaugcccaauaacgacaaauuugauaaguuguacauauggggcgugcaucacccuucaaccgacagugaccaaacaagccuguacguacaggcuucugggagaguuacuguguccaccaaaaggucacagcagacagucaucccaaauauuggaagccggcccugggugcgcggugugaguucuaucauuuccaucuauuggaccauagucaagccuggcgauauucuacucaucaacagcacggggaaucugauugccccaagaggauacuucaagaucaggucgggcaaaucuuccaucaugcggucagacgcgccgauugguaacuguaacagugagugcauaacucccaaugggagcaucccuaacgauaagccauuucaaaauguuaaccgcauuacauauggagcauguccccgauacgugaaacagaauacccuuaagcuggccacuggcaugagaaacguaccugaaaaacagacaaggggcaucuucggggcuauagccggauuuauugagaaugguugggaaggcaugguggacgggugguauggauuccggcaccagaacuccgagggcaccggucaagcagcugauuugaagucuacgcaggccgcgaucaaucagaucaacgggaaacucaaucgucugauugagaagaccaacgaaaaguuucaucaaaucgagaaagaguucagcgaagucgaaggccgcauucaggacuuagagaaguacguggaggauacaaaaauagaccuguggucauauaaugccgaacuccuuguugcacuggagaaccagcacacuaucgauuugaccgacagugaaaugaauaagcuauucgagagaacaaggaaacagcugcgggaaaacgcugaggauaugggaaacggcugcuuuaagauuuaccauaagugugacaaugccugcaucggguccauccgaaacggaacuuacgaccacgauguguaucgcgacgaggcucucaauaacagauuccaaauuaaaggugucgaacuuaagagcggcuacaaagauuggauacuuuggaucucuuuugccauuucaugcuuccuguugugugugguacuccugggguuuaucaugugggcaugccagaagggaaauauuagguguaacaucugcauauga

SEQ ID NO: 122819 - RNA, 1701 nt, Artificial Sequence
  derived and/or modified sequence opt3 from hemagglutinin__InfluenzaA__ABD79032
augaagaccaucauugcccugagcuacauauucugccucgugcuuggccaggacuuucccgggaacgauaauuccacagcuacucuguguuugggacaccaugcagucccuaacgguacguuaguuaaaaccaucacaaaugaccaaauugaggugacuaacgccaccgaacugguacagucuucaaguacaggcaagaucugcaauaacccacacaggauucuagaugggaucgacuguacccucauagaugcgcugcuuggagacccgcauugcgauggcuuccagaaugagacuugggaccuguuuguggaaagaagcaaggcuuucuccaacuguuaucccuacgaugucccugacuaugccucuuugcggucgcucguggcaucaagcgguacacuggaguuuaucagugaaggguucaccuggacgggaguuacucagaauggcggcuccaacgccugcaaacgcgggccagauauuggauuuuucucucgacugaauuggcucuacaaaagcgguuccaccuaucccguguuaaacgucacaaugccuaauaacgacaauuuugauaagcuguacaucuggggcgugcaccauccaucaacugaccaagagcagaccagucuuuauguacaggcuagcgggcguguuacagugucuaccaagagaucccagcaaacgauuauccccaacauaggaucaaggccuuggguccggggcuugagcagucgcauuucuaucuacuggacuauugugaaaccaggugacauccuggugaucaacuccaaugggaaccuaauugcaccgagaggauacuucaagaugaggacaggcaaaagcucgauaaugcggucugaugcccccaucggcaccuguauuuccgagugcaucacuccuaaugggucaauaccaaacgacaagcccuuucagaaugucaacaaaauuacauauggagcuuguccuaaguacguuaagcagaauacccucaaacuggccacggguaugcgcaacgugccagaaaagcagacccgaggccuuuucagugcgaucgcaggguuuaucgagaauggaugggaaggcaugauugaugguugguauggguucagacaccaaaacagcgagggcacaggacaggccgcugaccugaaauccacucaggccgcaaucgaucaaauuaauggcaaguugaacaggguaauagagaaaaccaaugaaaaguuccaccagaucgagaaagaauuuucugagguggaagggcggauucaggaccucgagaaguacgucgaggauacaaagaucgaccuguggagcuauaacgcugaauuacugguggcccucgagaaucagcauacuaucgaucuuaccgacucagaaaugaacaaacuguucgagaagacacgucgccaauugagagaaaacgcggaggauaugggaaaugguugcuuuaaaauuuaccacaagugugacaacgccugcauaggcaguaucaggaaugggaccuaugaccaugauguuuaccgggacgaggcacuaaacaaucgauuccagauuaaaggaguggaacugaaguccggcuacaaggauuggauccucuggauuagcuuugcuaucucuugcuuccugcuuugugucgugcuguuggguuuuauaaugugggccugccagaaagggaacauccgcuguaauauuugcaucuga

SEQ ID NO: 122820 - RNA, 1701 nt, Artificial Sequence
  derived and/or modified sequence opt3 from hemagglutinin__InfluenzaA__ABD79112
augaaggccaaacugcucauccuucugugcgcuuugagcgcaaccgacgccgauacaauuuguauaggcuaccacgcgaacaauuccacugacacgguggauaccgucuuagagaagaacguuacagugacucauucuguaaaucugcuagaagacucacacaacgggaaacucugcagacugaagggaaucgcuccccuucagcuggguaaauguaauauugccggcuggaucuuggggaacccugagugcgaaagucuccugagcaagagguccuggucuuauauugcagagaccccaaauucggaaaacggagccuguuacccgggcgauuucgcugacuaugaggagcugcgggaacaacucucaagcgugaguuccuuugagcgcuucgaaaucuuucccaagggucgaucuuggccugagcauaauauagauaucggggucacagcagccugcagccacgcuggaaaauccucauucuacaagaacuuacuguggcuuaccgagaaagacggcaguuauccaaauuugaacaagagcuacgugaauaaaaaggaaaaggagguucugauucuauggggcgugcaucaucccccuaacaucgaaaaucagaaaacucucuaucguaaggagaacgccuacgucucugugguauccucaaacuacaauagaagguuuacaccagaaauugcggagcggcccaaaguucgcgggcaggcaggaagaaucaacuauuacuggacccugcuugagccuggugauacgauaauuuucgaagccaauggcaaccugaucgcuccaugguaugccuuugcauugaauagggggauuggaagcggcaucaucaccaguaacgcuucuauggacgagugugauacuaagugccagacaccgcaaggugccauuaauuccagccuccccuuccagaacauacacccuuuuacuaucggggaauguccaaaauacgugcggucgaccaagcugcgcauggucacaggauuacgaaauauucccucuauccaguccagaggccuguucggcgcgauagccggguuuauugagggagguugggacggcaugaucgaugggugguauggauaccaccaccagaacgaacaaggcucagguuaugcagcugaccagaaaaguacccagaaugccaucaacgggauuacgaauaaggugaacagcgugaucgagaagaugaauacucaguucacagcugucggcaaagaguuuaacaagcucgagaaaaggauggaaaaccuuaauaagaaaguugacgauggauuccuggacauuuggaccuacaacgccgaauugcuagugcugcucgagaaugaacggacucuggauuuccaugacuccaacguaaagaaucuuuacgagaaggugaaaaaccaacugcguaauaacgcaaaggagauaggcaaugggugcuuugaguucuaucacaaauguaacaaugaaugcauggaaucugucaagaacggaacauacgauuauccuaaauuuagcgaggagucaaaguugaaucgcgaaaagaucgacggugugaaacucgagaguaugggcguuuaccagauucuggccaucuauuccaccguggcuagcucuuuaguccugcuagugucacucggggcgaucaguuucuggaugugcagcaacggaucccugcaguguagaauuugcauauga

SEQ ID NO: 122821 - RNA, 1701 nt, Artificial Sequence
  derived and/or modified sequence opt3 from hemagglutinin__InfluenzaA__ABD79123
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcaaaaauuguacccugaucgacgcccuucugggggauccgcauugcgacggauuucagaacaaggagugggauuuguucguggaaagguccacugcuuauucuaauuguuaccccuaugacgucccugauuacgcaucgcuccggucacugguggccagcaguggcacacuggaguuuaccaaagaagguuucaacuggacggggguugcucaagacggaacuuccuaugcaugcaagcgcggcucugucaagagcuuuuucucccgacucaauugguuacacaaacuggaguacaaguauccagcccuuaacgugaccaugcccaauaacgauaaauuugacaaguuguacauauggggcgugcaucacccuucaacagauagugaccagacuagccuguacguacaggcuucugggcguguuaccguguccacaaaaagaucacagcaaaccgucaucccaaauauuggaagcaggcccugggugcggggugugaguucucgcaucuccauuuauuggacgaucgucaagccuggcgacauacuacucauuaacagcacugggaaucugaucgccccaagaggauacuucaagauuaggucgggcaaaucuuccaucaugcggucagaugcgccgaucgacaacuguaacagugagugcauuacacccaaugguagcauauccaacgauaagccuuuucagaauguuaaccgcaucaccuauggggcauguccacgauacgugaaacagaauacucuuaagcuggccacaggaaugagaaacguacccgaaaaacagaccaggggcauuuucggcgcuaucgccggguuuauagagaauggaugggaagguaugguggacggcugguauggguuccggcaccaaaacucugagggaacgggccaggcagcugaucuaaagagcacccaggccgcgauuaaucaaaucaacgguaaacucaaucgucugaucgagaagacaaacgaaaaguuucaucagauugagaaagaguucucagaagucgaagggcgcauccaggacuuagagaaguacguggaggauacuaaaauugaccuguggaguuauaaugccgaacuccuuguugcacuggagaaccagcacaccauagauuugacagacuccgaaaugaauaagcuauucgagagaacuaggaaacaacugcgggaaaacgcugaggauaugggcaacggaugcuuucgaaucuaccauaagugugacaaugccugcauuggcagcauccgcaacgggaccuacgaccacgauguguauagagacgaggcucucaauaacagguuccagaucaagggagucgaacugaaaucugguuacaaggauuggauucuuuggauaucauuugccaucaguugcuuccuguugugugugguacuccugggcuuuauuaugugggcaugccagaaagggaauauccgguguaacauuugcaucuga

SEQ ID NO: 122822 - RNA, 1701 nt, Artificial Sequence
  derived and/or modified sequence opt3 from hemagglutinin__InfluenzaA__ABD79134
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcaaaaauuguacccugaucgacgcucuacugggggauccgcauugcgacggauuucagaacaagaaaugggauuuguucguggagagguccacugccuauucuaauuguuaccccuaugacgucccugauuacgcaucgcuccggucacugguggccagcaguggcacacuggaauuuaccaaggaggguuucaacuggacggggguugcucaagacggaacuuccuaugcaugcaagcgcggcucugugaaauccuuuuucagccgacucaauugguuacacaagcuggaauacaaauauccagcccuuaacgucaccaugcccaauaacgauaaguuugacaaauuguacauauggggcgugcaucacccuucaacagauagugaccagacuagccuguacguacaggcuucugggcguguuaccguguccacaaagagaucacagcaaaccgucaucccaaauauuggaagcaggcccugggugcggggugugaguucucgcaucuccauuuauuggacgaucgucaagccuggcgacauacuacucauuaacagcacugggaaucugaucgccccaagaggauacuucaaaauuaggucgggcaagucuuccaucaugcggucagaugcgccgaucgacaacuguaacagugagugcauuacacccaaugguagcauauccaacgauaaaccuuuucagaauguuaaccgcaucaccuauggggcauguccacgauacgugaagcagaauacucuuaaacuggccacaggaaugagaaacguacccgagaagcagaccaggggcauuuucggcgcuaucgccggguuuauagaaaauggaugggaggguaugguggacggcugguauggguuccggcaccaaaacucugaaggaacgggccaggcagcugauuugaaaagcacccaggccgcgauuaaucaaaucaacgguaagcucaaucgucugaucgagaagacaaacgagaaauuucaucagauugaaaaggaguucucagaagucgaggggcgcauccaggacuuagaaaaauacguggaggauacuaagauugaccuguggaguuauaaugccgagcuccuuguugcacuggaaaaccagcacaccauagauuugacagacuccgagaugaauaaacuauucgaaagaacuaggaagcaacugcgggagaacgcugaagauaugggcaacggaugcuuuaagaucuaccauaaaugugacaaugccugcauuggcagcauccgaaacgggaccuacgaccacgauguguaucgcgacgaggcucucaauaacagauuccagaucaagggagucgagcugaaaucugguuacaaggauuggauucuuuggauaucauuugccaucaguugcuuccuguugugugugguacuccugggcuuuauuaugugggcaugccagaaagggaauaucagguguaacauuugcaucuga

SEQ ID NO: 122823 - RNA, 1701 nt, Artificial Sequence
  derived and/or modified sequence opt3 from hemagglutinin__InfluenzaA__ABD79145
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcaaaaauuguacccugaucgacgcccuucugggggauccgcauugcgacggauuucagaacaaggagugggauuuguucguggaaagguccacugcuuauucuaauuguuaccccuaugacgucccugauuacgcaucgcuccggucacugguggccagcaguggcacacuggaguuuaccaaagaagguuucaacuggacggggguugcucaagacggaacuuccuaugcaugcaagcgcggcucugucaagagcuuuuucucccgacucaauugguuacacaaacuggaguacaaguauccagcccuuaacgugaccaugcccaauaacgauaaauuugacaaguuguacauauggggcgugcaucacccuucaacagauagugaccagacuagccuguacguacaggcuucugggcguguuaccguguccacaaaaagaucacagcaaaccgucaucccaaauauuggaagcaggcccugggugcggggugugaguucucgcaucuccauuuauuggacgaucgucaagccuggcgacauacuacucauuaacagcacugggaaucugaucgccccaagaggauacuucaagauuaggucgggcaaaucuuccaucaugcggucagaugcgccgaucgacaacuguaacagugagugcauuacacccaaugguagcauauccaacgauaagccuuuucagaauguuaaccgcaucaccuauggggcauguccacgauacgugaaacagaauacucuuaagcuggccacaggaaugagaaacguacccgaaaaacagaccaggggcauuuucggcgcuaucgccggguuuauagagaauggaugggaagguaugguggacggcugguauggguuccggcaccaaaacucugagggaacgggccaggcagcugaucuaaagagcacccaggccgcgauuaaucaaaucaacgguaaacucaaucgucugaucgagaagacaaacgaaaaguuucaucagauugagaaagaguucucagaagucgaagggcgcauccaggacuuagagaaguacguggaggauacuaaaauugaccuguggaguuauaaugccgaacuccuuguugcacuggagaaccagcacaccauagauuugacagacuccgaaaugaauaagcuauucgagagaacuaggaaacaacugcgggaaaacgcugaggauaugggcaacggaugcuuuaagaucuaccauaagugugacaaugccugcauuggcagcauccgaaacgggaccuacgaccacgauguguaucgcgacgaggcucucaauaacagauuccagaucaaaggagucgaacugaagucugguuacaaagauuggauucuuuggauaucauuugccaucaguugcuuccuguugugugugguacuccugggcuuuauuaugugggcaugccagaaggggaauaucagguguaacauuugcaucuga

SEQ ID NO: 122824 - RNA, 1701 nt, Artificial Sequence; identical to SEQ ID NO: 122823
  derived and/or modified sequence opt3 from hemagglutinin__InfluenzaA__ABD79156

SEQ ID NO: 122825 - RNA, 1701 nt, Artificial Sequence; identical to SEQ ID NO: 122039
  derived and/or modified sequence opt3 from hemagglutinin__InfluenzaA__ABD79167

SEQ ID NO: 122826 - RNA, 1701 nt, Artificial Sequence; identical to SEQ ID NO: 122823
  derived and/or modified sequence opt3 from hemagglutinin__InfluenzaA__ABD79178

SEQ ID NO: 122827 - RNA, 1701 nt, Artificial Sequence
  derived and/or modified sequence opt3 from hemagglutinin__InfluenzaA__ABD79189
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcaaaaauuguacccugaucgacgcucuacugggggauccgcauugcgacggauuucagaacaaggagugggauuuguucguggaaagguccacugccuauucuaauuguuaccccuaugacgucccugauuacgcaucgcuccggucacugguggccagcaguggcacacuggaguuuaccaaagaagguuucaacuggacggggguugcucaagacggaacuuccuaugcaugcaagcgcggcucugucaagagcuuuuucucccgacucaauugguuacacaaacuggaguacaaguauccagcccuuaacgugaccaugcccaauaacgauaaauuugacaaguuguacauauggggcgugcaucacccuucaacagauagugaccagacuagccuguacguacaggcuucugggcguguuaccguguccacaaaaagaucacagcaaaccgucaucccaaauauuggaagcaggcccugggugcggggugugaguucucgcaucuccauuuauuggacggucguuaagccuggcgacauccuacucauaaacagcacugggaaucugauugccccaagaggauacuucaagaucaggucgggcaaaucuuccauuaugcggucagaugcgccgaucgacaguuguaacagcgagugcaucacacccaacgguuccauuucuaaugauaagccuuuucagaacgugaaucgcauaaccuauggggcauguccacgauacguaaaacagaacacucuuaagcuggccacaggaaugagaaaugugcccgaaaaacagaccaggggcaucuucggcgcuauugccggguuuaucgagaacggaugggaagguauggucgacggcugguauggguuccggcaccaaaauagcgagggaacgggccaggcagcugauuugaagucaacccaggccgcgauaaaccaaauuaaugguaaacucaaccgucugaucgagaagacaaaugaaaaguuucaucagaucgagaaagaguucagugaaguggaagggcgcauucaggacuuagagaaguacguugaggauacuaaaaucgaccugugguccuauaacgccgaacuccuuguggcacuggagaaucagcacaccauugauuugacagacagcgaaaugaacaagcuauucgagagaacuaggaaacaacugcgggaaaaugcugaggauaugggcaacggaugcuuuaagauauaccauaagugugacaacgccugcaucggcucuauucgaaaugggaccuacgaccacgaugucuaucgcgacgaggcucucaacaauagauuccagaucaaaggaguggaacugaagucagguuacaaagauuggauccuuuggauuaguuuugccauaagcugcuuccuguuguguguaguucuccugggcuuuaucaugugggcaugccagaaggggaacauuagguguaauaucugcauuuga

SEQ ID NO: 122828 - RNA, 1701 nt, Artificial Sequence; identical to SEQ ID NO: 122823
  derived and/or modified sequence opt3 from hemagglutinin__InfluenzaA__ABD79200

SEQ ID NO: 122829 - RNA, 1701 nt, Artificial Sequence
  derived and/or modified sequence opt3 from hemagglutinin__InfluenzaA__ABD79211
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcaaaaauuguacccugaucgacgcccuucugggggauccgcauugcgacggauuucagaacaaggagugggauuuguucguggaaagguccacugcuuauucuaauuguuaccccuaugacgucccugauuacgcaucgcuccggucacugguggccagcaguggcacacuggaguuuaccaaagaagguuucaacuggacggggguugcucaagacggaacuuccuaugcaugcaagcgcggcucugucaagagcuuuuucucccgacucaauugguuacacaaacuggaguacaaguauccagcccuuaacgugaccaugcccaauaacgauaaauuugacaaguuguacauauggggcgugcaucacccuucaacagauagugaccagacuagccuguacguacaggcuucugggcguguuaccguguccacaaaaagaucacagcaaaccgucaucccaaauauuggaagcaggcccuggauccggggugugaguucucgcauuuccaucuauuggacgauagugaagccuggcgacauucuacucaucaacagcacugggaaucugauugccccaagaggauacuucaagaucaggucgggcaaaucuuccaucaugcggucagaugcgccgauugacaacuguaacagugagugcauaacacccaaugguagcaucuccaacgauaagccuuuucagaaugucaaccgcauuaccuauggggcauguccacgauacguuaaacagaauacucuuaagcuggccacaggaaugagaaacgugcccgaaaaacagaccaggggcaucuucggcgcuauagccggguuuauugagaauggaugggaagguaugguagacggcugguauggguuccggcaccaaaacucugagggaacgggccaggcagcugaucuaaagagcacccaggccgcgaucaaucaaaucaacgguaaacucaaucgucugauugagaagacaaacgaaaaguuucaucagaucgagaaagaguucucagaaguggaagggcgcauucaggacuuagagaaguacgucgaggauacuaaaauagaccuguggaguuauaaugccgaacuccuuguggcacuggagaaccagcacaccaucgauuugacagacuccgaaaugaauaagcuauucgagagaacuaggaaacaacugcgggaaaacgcugaggauaugggcaacggaugcuuuaagauuuaccauaagugugacaaugccugcaucggcagcauccgaaacgggaccuacgaccacgauguuuaucgcgacgaggcucucaauaacagauuccagauuaaaggaguggaacugaagucugguuacaaagauuggauacuuuggaucucauuugccauuaguugcuuccuguugugugucgugcuccugggcuuuaucaugugggcaugccagaaggggaauauuagguguaacaucugcauauga

SEQ ID NO: 122830 - RNA, 1701 nt, Artificial Sequence; identical to SEQ ID NO: 122039
  derived and/or modified sequence opt3 from hemagglutinin__InfluenzaA__ABD79222

SEQ ID NO: 122831 - RNA, 1701 nt, Artificial Sequence; identical to SEQ ID NO: 122039
  derived and/or modified sequence opt3 from hemagglutinin__InfluenzaA__ABD79233

SEQ ID NO: 122832 - RNA, 1701 nt, Artificial Sequence
  derived and/or modified sequence opt3 from hemagglutinin__InfluenzaA__ABD79244
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacugguacagucuucaaguacagguagaaucugcgacagcccacaccagauucucgauggcaaaaauuguacccugaucgacgcccuucugggggauccgcauugcgacggauuuaagaacaaagagugggauuuguucguggaaagguccacugcuuauucuaauuguuaccccuaugacgucccugauuacgcaucgcuccggucacugguggccagcaguggcacacuggaguuuaccaacgaagguuucaauuggacggggguugcucaggacggaacuuccuaugcaugcaagcgcggcucugugaaguccuuuuucucccgacucaacugguuacacaaacuggaguacaaguauccagcccuuaaugucaccaugcccaacaaugauaaauuugacaaguuguacauauggggcgugcaucacccuucaacagauagugaccaaacuagccuguacguacaggcuucugggcguguuaccguguccacaaaaagaucacagcagaccgucaucccaaacauuggaagcaggcccugggugcggggugugaguucucgcaucuccauuuauuggacgaucgucaagccuggcgacauacuacucauuaauagcacugggaaccugaucgccccaagaggauacuucaagauuaggucgggcaaaucuuccaucaugcggucagaugcgccgaucgacaacuguaauagugagugcauuacacccaacgguagcauaccuaaugauaagccauuucaaaacguuaaucgcaucaccuauggggcauguccccgauacgugaaacagaacacucuuaagcuggccacaggaaugagaaauguaccugaaaaacagaccaggggcauuuucggcgcuaucgccggguuuauagagaacggaugggaagguaugguggacggcugguauggguuccggcaccagaauagcgagggaacgggccaagcagcugauuugaagucuacccaggccgcgauuaaccagaucaaugguaaacucaaccgucugaucgagaagacaaaugaaaaguuucaucaaauugagaaagaguucagcgaagucgaagggcgcauccaggacuuagagaaguacguggaggauacuaaaauugaccuguggucauauaacgccgaacuccuuguugcacuggagaaucagcacaccauagauuugacagacagugaaaugaacaagcuauucgagagaacuaggaaacagcugcgggaaaacgcugaggauaugggcaauggaugcuuuaagaucuaccauaagugugacaacgccugcauuggcuccauccgaaaugggaccuacgaccacgauguguaucgcgacgaggcucucaacaauagauuccaaaucaaaggagucgaacuaaagagcgguuacaaagauuggauucuuuggauaucuuuugccaucucaugcuuccuguugugugugguacuccugggcuuuauuaugugggcaugccagaaggggaacaucagguguaauauuugcaucuga

SEQ ID NO: 122833 - RNA, 1701 nt, Artificial Sequence; identical to SEQ ID NO: 122259
  derived and/or modified sequence opt3 from hemagglutinin__InfluenzaA__ABD94734

SEQ ID NO: 122834 - RNA, 1701 nt, Artificial Sequence; identical to SEQ ID NO: 122646
  derived and/or modified sequence opt3 from hemagglutinin__InfluenzaA__ABD94745

SEQ ID NO: 122835 - RNA, 1701 nt, Artificial Sequence
  derived and/or modified sequence opt3 from hemagglutinin__InfluenzaA__ABD94767
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugauaacauugagguaacuaaugcgaccgaacuugugcaaucuucaaguacaggaagaaucugcgacagcccacaccagauucucgauggugagaacuguacccugaucgacgcucuacugggcgauccgcauugcgacggguuucagaauaaagaaugggauuuguucgucgagagguccacugccuauucuaacuguuaccccuaugacgugccugauuacgcaucgcuccggucacugguugccagcaguggaacacuggaauuuaauaacgaguccuucaauuggaccggcguggaccagaacgguacgucuagcgcuugcaagcgccgauccaauaaaucauuuuucagucgucucaacugguuacaccaacugaaguauaaguacccagcacuuaaugucacuaugcccaacaacgagaaauuugauaaguuguauauauggggagugcaucacccuagcaccgacucugaucagaucucccuguacgcccaggcuucagggagaguaacaguuagcacuaaaaggagucagcaaaaugugauuccaaacaucggcucucggcccuggguccgcggcguguccagcagaauuucgaucuacuggaccauagugaagccuggggacauucuacucaucaauucuacaggaaaccugauugccccaagggguuauuucaaaauccgguccggcaagucaaguaucaugcgcagcaaugcgccgauugggaaguguaacuccgaaugcauaacccccaauggaucuaucccuaacgacaaaccauuucagaaugucaaccgaauuacguacggcgcaugucccagauauguuaagcagaauacucuuaaacuggccacagguaugaggaacgugccugagaagcagacccgggggaucuucggagcuauagccggcuuuauugaaaauggcugggaggggaugguagauggaugguacgguuuccgucaccaaaacagcgagggcacugggcaggcagcugacuugaaaucaacacaggccgcgaucaaucaaaucaacggaaagcucaaccgccugauugagaaaaccaaugaaaaguuucaucagaucgaaaaggaguucagugaaguggagggcaggauucaggauuuagagaaauaugucgaagacacgaagauagaucugugguccuacaacgccgagcuccuuguggcacuggaaaaucagcacaccaucgacuugacagauagcgagaugaacaaacuauucgaaagaacucggaagcaacugcgagagaaugcugaggacauggguaacgggugcuuuaaaauuuaucauaagugugauaaugccugcaucggcucuauccgcaacggaaccuacgaccacgauguuuacagagacgaagcucucaauaacagguuccagauuaagggcguggagcugaaaucaggguauaaggacuggauacuuuggaucaguuuugccauuagcugcuuccuguugugugucgugcuccugggauuuaucaugugggcaugccagaaagguaauauucgguguaacaucugcauauga

SEQ ID NO: 122836 - RNA, 1698 nt, Artificial Sequence; identical to SEQ ID NO: 122816
  derived and/or modified sequence opt3 from hemagglutinin__InfluenzaA__ABD94778

SEQ ID NO: 122837 - RNA, 1698 nt, Artificial Sequence; identical to SEQ ID NO: 122816
  derived and/or modified sequence opt3 from hemagglutinin__InfluenzaA__ABD94789

SEQ ID NO: 122838 - RNA, 1701 nt, Artificial Sequence
  derived and/or modified sequence opt3 from hemagglutinin__InfluenzaA__ABD94822
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguagaauuugcgacagcccacacaggauccuagauggcgagaauuguacccucauagacgcucugcuuggggauccgcauugcgacggauuucagaacaaagaaugggaucuguucguggagcgguccaaggccuauucuaauuguuaccccuaugacgucccugauuacgcaucguugcgcucacucguggccagcaguggcacucuggaauuuaacaaugaguccuucaacuggacagguguugcucagaaugggaccucuuaugcaugcaaacgaagcuccaucaagucauuuuucagucgucugaacuggcuccaccaauuaaaguacaaauauccagcccugaaugugacgaugcccaacaaugacaaguuugauaaacuuuacauuuggggaguccaucacccuagcacugacucugaucagaccuccuuguacgcucaggccucaggcagagugacaguaagcacuaagaggagucagcaaaccguuaucccaaacauuggcucucggcccugggugcgcggggucuccagcagaaucucgauauauuggacaauugugaaaccuggagacauccugcuaauuaacucuaccgguaaucucaucgcgccaaggggcuacuucaagauccgguccgggaagucaaguauuaugcgcagcgacgcaccgauaggaaaauguaacuccgagugcaucacgcccaauggcucuauuccuaacgauaagccauuucagaaugugaaccgaaucacuuauggugccugucccagauacgucaaacagaauacacugaaacuugcuaccgggaugaggaacguuccugaaaagcagacucggggaauauucggcgccauugcaggcuuuaucgagaaugggugggaaggaaugguggacgguugguauggcuuccgucaccaaaacagcgaggggacaggacaggcugccgaucugaagucaacccaggcggccaucaaucaaauuaacggcaaauugaaucgccucaucgagaagacgaacgaaaaguuucaucagauugagaaagaguucagugaaguagaagguagaauacaggaccuggagaaguacguggaggauaccaaaaucgacuuaugguccuauaaugcagaacugcucgucgcucuugagaaccagcacacaauugaucugacugacagcgaaaugaacaaguuguucgagaggacccggaaacaacuacgagaaaaugccgaggauauggggaacggcugcuuuaagaucuaccauaagugugacaaugcuugcaucggaucuauucgcaacggcacauacgaucacgacguguauagagacgaggcccugaauaacagguuccagauaaaagggguugaacucaagucaggauacaaagauuggauccuguggauuaguuuugcaaucagcugcuuccuucuguguguggucuugcucgguuuuauuaugugggccugccagaagggcaauauccgguguaacauaugcaucuga

SEQ ID NO: 122839 - RNA, 1701 nt, Artificial Sequence
  derived and/or modified sequence opt3 from hemagglutinin__InfluenzaA__ABD94833
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucugacuguuaccccuaugaugucccugacuacgcaucgcuccgcucacugguggccagcaguggcacucuggaguuuacaaaugaagguuucaacuggaccgggguugcucaggauggaacguccuaugcaugcaagcgaggcucugucaagagcuuuuucucccgucucaauugguuacacaaacuggaguacaaguauccagcccuuaacgugacuaugcccaauaacgacaaauuugauaaguuguacauauggggcgugcaucacccuucaaccgacagugaccaaacaagccuguacguacaggcuucugggagaguuacuguguccaccaaaaggucacagcagacagucaucccaaauauuggaagccggcccugggugcgcggugugaguucuagaaucuccauuuauuggaccaucgucaagccuggcgauauacuacucauuaacagcacggggaaucugaucgccccaaggggauacuucaagauucggucgggcaaaucuuccaucaugcgcucagacgcgccgaucgguaacuguaacagugagugcauuacucccaaugggagcauaccuaacgauaagccauuucaaaauguuaaccgaaucacauauggagcaugucccagauacgugaaacagaauacccuuaagcuggccacuggcaugaggaacguaccugaaaaacagacacggggcauuuucggggcuaucgccggauuuauagagaaugguugggaaggcaugguggacgggugguauggauuccgucaccagaacuccgagggcaccggucaagcagcugauuugaagucuacgcaggccgcgauuaaucagaucaacgggaaacucaaucgccugaucgagaagaccaacgaaaaguuucaucaaauugagaaagaguucagcgaagucgaaggcagaauccaggacuuagagaaguacguggaggauacaaaaauugaccuguggucauauaaugccgaacuccuuguugcacuggagaaccagcacacuauagauuugaccgacagugaaaugaauaagcuauucgagaggacacggaaacagcugcgagaaaacgcugaggauaugggaaacggcugcuuuaagaucuaccauaagugugacaaugccugcauuggguccauccgcaacggaacuuacgaccacgauguguauagagacgaggcucucaauaacagguuccaaaucaaaggugucgaacuuaagagcggcuacaaagauuggauucuuuggauaucuuuugccaucucaugcuuccuguugugugugguacuccugggguuuauuaugugggcaugccagaagggaaauauccgguguaacauuugcaucuga

SEQ ID NO: 122840 - RNA, 1701 nt, Artificial Sequence
  derived and/or modified sequence opt3 from hemagglutinin__InfluenzaA__ABD94844
augaagaccaucauugcccugagcuacauacucugcaugguguucgcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuucagaacaaggagugggaucuguucguggaacgguccaaagccuauucuaauuguuaccccuaugacgucccugauuacgcaucguugcgcucacucguggccagcaguggcacucuggaguuuaacaaugaauccuucaacuggacagguguugcucagaaugggaccucuuaugcaugcaagcgacguagcgugaaguccuuuuucucaagacugaacuggcuccacaaauuagaguacaaguauccagcccugaaugucacgaugcccaacaaugacaaauuugauaagcuguacauauggggagugcaucacccuaguacugacagcgaucaaaccucuuuguacguacaggcuuccggcaggguuacagugucaacuaaacggagccagcagaccgucaucccaaacauuggcagucgccccugggugagaggggugucuuccaucauuagcaucuauuggacaauagucaagccuggagacauucugcuaaucaacucgaccgguaaucucauugccccaaggggcuacuucaagauccggucugggaaauccucaaucaugcgcagugacgcgccgauuggaaacuguaauagcgagugcauaacgcccaacggcuccaucccuaaugauaagccauuucaaaacguuaaucgaauuacuuauggugcaugucccagauacgugaaacagaacacacugaaacuugccaccgggaugaggaauguaccugaaaagcagacucggggaaucuucggcgcuauagccggcuuuauugagaacgggugggaaggaaugguggacgguugguauggcuuccgucaccaaaauucugaggggacaggacaggcagcugaucuuaagagcacccaggccgcgaucaaccagaucaauggcaaauugaaccgccucauugagaagacgaaugaaaaguuucaucaaaucgagaaagaguucucagaagucgaagguaggauucaggaccuggagaaguacguggaggauaccaaaauagacuuauggaguuauaacgccgaacugcucguugcacuugagaaccagcacacaaucgaucugacugacuccgaaaugaauaaguuguucgagagaacccggaaacagcuacgagaaaacgcugaggauauggggaauggcugcuuuaagauuuaccauaagugugacaacgccugcaucggaagcauccgcaauggcacauacgaucacgacguguauagagacgaggcucugaacaauagguuccaaauuaaaggggucgaacucaagucuggauacaaagauuggauacuguggaucucauuugccauuaguugcuuccuucugugugugguauugcucgguuuuaucaugugggcaugccagaagggcaacauucgguguaauaucugcauauga

SEQ ID NO: 122841 - RNA, 1701 nt, Artificial Sequence
  derived and/or modified sequence opt3 from hemagglutinin__InfluenzaA__ABD94855
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacaggguucuucaacaggcagaaucugcgacaguccacacaggauucucgaugggaaaaauuguacccugaucgacgcucugcugggagauccgcauugcgacggcuuucagaacaaggaaugggauuuguucguggaacggagcaaagccuauuccaauuguuaccccuaugacgucccugauuacgcaucucuccgcucgcugguggccucaagcgguacucuggaguuuaacaaugaaaguuucaacuggacagggguugcucagaauggaaccuccuaugcaugcaagcgaggcucugugaaguccuuuuucucccgucucaacugguuacacaaacuggaguacaaguauccagcccuuaaugucacgaugcccaacaaugacaaauuugauaaguuguacauauggggcgugcaucacccuucaacugacagugaucaaaccagccuguacguacaggcuucugggagaguuacaguguccacuaaaaggucacagcagaccgucaucccaaacauuggaagccggcccugggugcgcggugugaguucuagaaucuccauuuauuggacaaucgucaagccuggcgacauacuacucauuaacagcaccgggaaucugaucgccccaaggggauacuucaagauucggucgggcaaaucuuccaucaugcgcucagacgcgccgaucgauaacuguaauagugagugcauuacgcccaacgguagcauaccuaaugacaagccauuucaaaacguuaaucgaaucacuuauggggcaugucccagauacgugaaacagaacacacuuaagcuggccaccggaaugaggaauguaccugaaaaacagacucggggcauuuucggcgcuaucgccggguuuauagagaacggaugggaagguaugguggauggcugguauggguuccgucaccagaauagcgagggaacaggccaagcagcugacuugaagucuacccaggccgcgauuaaccagaucaaugguaaacucaaccgccugaucgagaagacgaaugaaaaguuucaucaaauugagaaagaguucagcgaagucgaagggagaauccaggauuuagagaaguacguggaggacaccaaaauugaucuguggucauauaacgccgaacuccuuguugcacuggagaaccagcacacaauagacuugacugauagugaaaugaauaagcuauucgagaggacccggaaacagcugcgagaaaacgcugaggacaugggcaauggaugcuuuaagaucuaccauaagugugauaacgccugcauuggcuccauccgcaaugggacauacgaccacgacguguauagagaugaggcucucaacaauagguuccaaaucaaaggagucgaacuuaagagcgguuacaaagacuggauucuuuggauaucuuuugccaucucaugcuuccuguugugugugguacuccugggcuuuauuaugugggcaugccagaaggggaacauccgguguaauauuugcaucuga

SEQ ID NO: 122842 - RNA, 1701 nt, Artificial Sequence
  derived and/or modified sequence opt3 from hemagglutinin__InfluenzaA__ABD94866
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacggcccacaccagauucuagaugggaaaaauuguacccucaucgacgcucugcuuggagauccgcauugcgacggcuuucagaacaaggagugggaucuguucguggaaagguccaaagccuauucuaauuguuaccccuaugacgucccugauuacgcaucguugcggucacucguggccagcagugguacucuggaguuuacaaacgaauccuucaauuggaccgggguugcucaaaacggaacgucuuaugcaugcaagcgcggcagcgugaaguccuuuuucucacgacugaauuggcuccacaaauuagaguacaaguauccagcccugaacgucacuaugcccaauaacgacaaauuugauaagcuguacauauggggcgugcaucacccuaguaccgacagcgaucagacaucuuuguacguacaguccucagggcguaucacuguuagcaccaaaagaagucagcaaacagugaccccaaauauuggaucuaggcccuggguccgggguguguccagccgcaucucgauuuauuggacgaucgugaagccuggcgacauacugcuaauuacuucuacagggaaccucaucgcuccaagaggauacuucaagauuaggcggggcaaauccucaaucaugcgcagugacgccccgaucgauaacuguaauagcgagugcauuacccccaacgguuccauaccuaaugacaagccauuucagaacgucaaucgaaucacuuauggggcgugucccagauacguuaaacagaacacacugaaacuugcaaccggaaugaggaaugugccugaaaagcagacgcggggcauuuucggcgccaucgcuggguuuauagagaacggaugggaagguaugguagauggcugguauggguuccgucaccaaaauucugagggaaccggccaggccgcagaccuuaagagcacacaggcugccauuaaccaaaucaaugguaaauugaaccgccucaucgagaagacuaaugaaaaguuucaucagauugagaaagaguucucagaaguggaagggagaauccaggaucuggagaaguacgucgaggacaccaaaauugauuuauggaguuauaacgcggaacugcucguggcccuugagaaucagcacacaauagaccugacugauuccgaaaugaacaaguuguucgagaggacccggaaacaacuacgagaaaacgcagaggacaugggcaauggaugcuuuaagaucuaccauaagugugauaacgcuugcauuggcagcauccgcaaugggacauacgaccacgacguuuauagagaugaggcccugaacaauagguuccagaucaaaggaguggaacucaagucugguuacaaagacuggauucuguggauaucauuugcuaucaguugcuuccuucugugugucguguugcucggcuuuauuaugugggccugccagaaggggaacauccgguguaauauuugcaucuga

SEQ ID NO: 122843 - RNA, 1701 nt, Artificial Sequence
  derived and/or modified sequence opt3 from hemagglutinin__InfluenzaA__ABD94877
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuaacaaugaauccuucaacuggacagguguugcucagaaugggaccucuuaugcaugcaagcgacguagcgugaaguccuuuuucucaagacucaacugguuacacaaacuggaguacaaguauccagcccuuaaugucacgaugcccaacaaugacaaauuugauaaguuguacauauggggagugcaucacccuaguacugacagcgaucaaaccucucuguacguacaggcuuccggcaggguuacagugucaacuaaacggagccagcagaccgucaucccaaacauuggcagucgccccugggugagaggggugucuuccaggaucagcauuuauuggacaaucgucaagccuggagacauacuacucauuaacucgaccgguaaucugaucgccccacggggcuacuucaagauucgcucugggaaauccucaaucaugcgaagugacgcgccgaucgauaacuguaauagcgagugcauuacgcccaacggauccauaccuaaugacaagccauuucaaaacguuaauagaaucacuuauggcgcaugucccagguacgugaaacagaacacacuuaagcuggccaccgguaugcggaauguaccugaaaaacagacucgugggauuuucggagcuaucgccggcuuuauagagaacggcugggaagggaugguggauggaugguaugguuuccgccaccagaauagcgagggcacagggcaagcagcugacuugaagucuacccaggccgcgauuaaccagaucaauggaaaacucaacagacugaucgagaagacgaaugaaaaguuucaucaaauugagaaagaguucucagaagucgaaggcaggauccaggauuuagagaaguacguggaggacaccaaaauugaucuguggaguuauaacgccgaacuccuuguugcacuggagaaccagcacacaauagacuugacugauuccgaaaugaauaagcuauucgagcggacccgaaaacagcugcgcgaaaacgcugaggacauggguaaugggugcuuuaagaucuaccauaagugugauaacgccugcauuggcagcaucagaaauggaacauacgaccacgacguguauagggaugaggcucucaacaaucgguuccaaaucaaaggcgucgaacugaagucuggguacaaagacuggauucuuuggauaucauuugccaucaguugcuuccuguugugugugguacuccugggauuuauuaugugggcaugccagaaggguaacauccgcuguaauauuugcaucuga

SEQ ID NO: 122844 - RNA, 1701 nt, Artificial Sequence
  derived and/or modified sequence opt3 from hemagglutinin__InfluenzaA__ABD94888
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacugguacagucuucaaguacagguagaaucugcgacagcccacacaggauucucgauggcaaaaauuguacccugaucgacgcccuucugggggauccgcauugcgacggauuuaagaacaaagagugggauuuguucguggaacgguccacugcuuauucuaauuguuaccccuaugacgucccugauuacgcaucgcuccgcucacugguggccagcaguggcacacuggaguuuaccaacgaagguuucaauuggacggggguugcucaggacggaacuuccuaugcaugcaagcgaggcucugucaagagcuuuuucucccgucucaacugguuacacaaacuggaguacaaguauccagcccuuaaugugaccaugcccaacaaugauaaauuugacaaguuguacauauggggcgugcaucacccuucaacagauagugaccagacuagccuguacguacaggcuucugggagaguuaccguguccacaaaaaggucacagcagaccgucaucccaaacauuggaagccggcccugggugcgcggugugaguucuagaaucuccauuuauuggacgaucgucaagccuggcgacauacuacucauuaauagcacugggaaccugaucgccccaaggggauacuucaagauucggucgggcaaaucuuccaucaugcgcucagaugcgccgaucgacaacuguaauagugagugcauuacacccaacgguagcauaccuaaugauaagccauuucagaacguuaaucgaaucaccuauggggcaugucccagauacgugaaacaaaacacucuuaagcuggccacaggaaugaggaauguaccugaaaaacagacccggggcauuuucggcgcuaucgccggguuuauagagaacggaugggaagguaugguggacggcugguauggguuccgucaccaaaauuccgagggaacgggccaggcagcugauuugaagucuacccaagccgcgauuaaccagaucaaugguaaacucaaccgccugaucgagaagacaaaugaaaaguuucaucagauugagaaagaguucagcgaagucgaagggagaauccaagacuuagagaaguacguggaggauacuaaaauugaccuguggucauauaacgccgaacuccuuguugcacuggagaaucagcacaccauagauuugacagacagugaaaugaacaagcuauucgagaggacucggaaacagcugcgagaaaacgcugaggauaugggcaauggaugcuuuaagaucuaccauaagugugacaacgccugcauuggcuccauccgcaaugggaccuacgaccacgauguguauagagacgaggcucucaacaauagguuccagaucaaaggagucgaacuaaagagcgguuacaaagauuggauucuuuggauaucuuuugccaucucaugcuuccuguugugugugguacuccugggcuuuauuaugugggcaugccaaaaggggaacauccgguguaauauuugcaucuga

SEQ ID NO: 122845 - RNA, 1701 nt, Artificial Sequence; identical to SEQ ID NO: 122823
  derived and/or modified sequence opt3 from hemagglutinin__InfluenzaA__ABD94899

SEQ ID NO: 122846 - RNA, 1701 nt, Artificial Sequence
  derived and/or modified sequence opt3 from hemagglutinin__InfluenzaA__ABD94910
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaaaauucuucaacagguagaaucugcgacaguccacacaggauucucgauggcaaaaacuguacccugaucgacgcucuacugggggauccgcauugcgacggauuucagaauaaggagugggauuuguucguggaacggagcaaagccuauuccaacuguuaccccuaugacgucccugauuacgcaucucuccgcucgcugguggccucaagcggcacucuggaguuuaauaacgaaaguuucaauuggacagguguugcucagaacgggaccuccuaugcaugcaagcgacguucugucaagagcuuuuucuccagacucaauugguuacacaaacuggaguacaaguauccagcccuuaacgugacgaugcccaauaacgacaaauuugauaaguuguacauauggggagugcaucacccuucaacugacagugaucagaccagccuguacguacaggcuucuggcaggguuacaguguccacuaaacggucacagcagaccgucaucccaaacauuggcagccgccccugggugagaggggugaguucuaggaucuccauuuauuggacaaucgucaagccuggagacauacuacucauuaauagcaccgguaaccugaucgccccacggggcuacuucaagauucgcucggggaaaucuuccaucaugcgaucagacgcgccgaucggaaauuguaacagugagugcauuacgcccaauggcagcauaccuaacgauaagccauuucaaaauguuaacagaaucacuuauggugcaugucccagguacgugaaacagaauacacuuaagcuggccaccgggaugcggaacguaccugaaaaacagacucguggaauuuucggcgcuaucgccggcuuuauagagaaugggugggaaggaaugguggacgguugguauggcuuccgccaccagaacuccgaggggacaggacaagcagcugauuugaagucuacccaggccgcgauuaaucagaucaacggcaaacucaauagacugaucgagaagacgaacgaaaaguuucaucaaauugagaaagaguucagcgaagucgaagguaggauccaggacuuagagaaguacguggaggauaccaaaauugaccuguggucauauaacgccgaacuccuuguugcacuggagaaucagcacacaauagauuugacugacagugaaaugaacaagcuauucgagcggacccgaaaacagcugcgcgaaaaugcugaggauauggggaacggcugcuuuagaaucuaccauaagugugacaaugccugcauuggauccaucaggaacggcacauacgaucacgacguguaucgggacgaggcucucaauaaccgcuuccaaaucaagggggucgaacugaaaagcggauacaaggauuggauucuuuggauaucuuuugccaucucaugcuuccuguugugugugguacuccuggguuuuauuaugugggcaugccagaaaggcaauaucagauguaacauuugcaucuga

SEQ ID NO: 122847 - RNA, 1701 nt, Artificial Sequence
  derived and/or modified sequence opt3 from hemagglutinin__InfluenzaA__ABD94921
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacggcccacaccagauucucgaugggaaaaauuguacccugaucgacgcucugcugggagauccgcauugcgacggcuuucagaacaaggaaugggauuuguucguggaaaggagcaaagccuauuccaauuguuaccccuaugacgucccugauuacgcaucucuccggucgcugguggccucaagcgguacucuggaguuuacaaacgaaaguuucaauuggaccgggguugcucaaaacggaacguccuaugcaugcaagcgcggcucugucaagagcuuuuucucccgacucaauugguuacacaaacuggaguacaaguauccagcccuuaacgugacuaugcccaauaacgacaaauuugauaaguuguacauauggggcgugcaucacccuucaaccgacagugaucagacaagccuguacguacagucuuccgggcguguuacugugucaaccaaaagaagccagcaaacagucaccccaaauaucggaaguaggcccugggugcggggugugucuucccgcauuagcaucuauuggacgauugucaagccuggcgacauccuacucauaaacucgacugggaaccugauugcuccaagaggauacuucaagaucaggcggggcaaaucuuccauuaugcgcucagacgccccgaucgauaauuguaacagugagugcaucacacccaaugguagcauuccuaacgacaagccauuucagaauguuaaccgaauaaccuauggggcgugucccagauacgugaaacagaauacucuuaagcuggcaacaggaaugaggaacguaccugaaaaacagacccggggcaucuucggcgccauugcuggguuuaucgagaauggaugggaagguaugguggauggcugguauggguuccgucaccaaaacuccgagggaacgggccaggccgcagacuugaagucuacccaggcugccauaaaucaaauuaacgguaaacucaaucgccugaucgagaagacaaacgaaaaguuucaucagaucgagaaagaguucagcgaagucgaagggaggauucaggauuuagagaaguacguggaggacacuaaaaucgaucuguggucauauaaugcggaacuccuuguugcccuggagaaccagcacaccauugacuugacagauagugaaaugaacaagcuauucgagagaacucggaaacaacugcgagaaaaugcagaggacaugggcaacggaugcuuuaagauauaccauaagugugauaaugcuugcaucggcuccauucgcaacgggaccuacgaccacgacguguauagagaugaggcccucaauaacagguuccagaucaaaggagucgaacuuaagagcgguuacaaagacuggauccuuuggauuucuuuugcuauaucaugcuuccuguugugugugguacuccugggcuuuaucaugugggccugccagaaggggaauauucgguguaacaucugcauuuga

SEQ ID NO: 122848 - RNA, 1701 nt, Artificial Sequence; identical to SEQ ID NO: 122823
  derived and/or modified sequence opt3 from hemagglutinin__InfluenzaA__ABD94932

SEQ ID NO: 122849 - RNA, 1698 nt, Artificial Sequence
  derived and/or modified sequence opt3 from hemagglutinin__InfluenzaA__ABD94943
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuaccggaauuuacuguggcuuaccggaaagaacggcuuguaucccaaucugagcaagucuuacgccaacaauaaaaagaaagaagugcuaauacucuggggcguacaucacccuccaaacaucggggaucagcgcacgcuguaccacacugagaacgcuuauguuuccguggucucaagccauuacagucgacguuucacccccgaaauuacaaagagaccuaaggugagggaccaggagggacggaucaauuauuacuggacucuucuggaaccaggugauaccauuaucuuugaggcaaacggcaauuugauagccccgugguaugcuuucgcccucucucgcggguuuggauccggcauuaucacaagcaacgcgcccauggacgagugugaugcaaaaugccagaccccucaaggugccauuaauucgucucugccauuccagaacgugcaccccgucacgaucggggaauguccuaaguacguuagauccgcuaaauuaaggauggugacuggacugcggaauaucccaucaauucagagucgcggccucuuuggcgccauagcaggguucaucgagggagguuggacaggcaugguagacgggugguauggauaccaucaccagaacgaacaaggcagcgguuacgcugccgaucagaaguccacccagaaugcgauuaacgggaucacuaauaaagugaacucugucauagagaagaugaauacacaguuuaccgccgugggcaaagaguucaacaaacuugaacgaagaauggagaaucugaacaagaaaguugacgauggauucuuggacauuuggacguauaacgcagaacuacuggugcuccuggagaaugaaaggacccuugacuuucacgauagcaacgucaagaaucuguacgagaaagugaagucacaauugaaaaacaaugcuaaggaaaucggcaacgggugcuucgaguuuuaucauaaguguaauaacgagugcauggaaaguguuaaaaauggaacauacgacuaucccaaguacuccgaggaaagcaaacucaaccgggagaagaucgaugguguaaaacuggacucuaugggcguguaucagauuuuagccaucuacucaacugucgcuaguagccuggugcuacucgucucccugggggccauuucuuucuggaugugcucgaauggaagccuucagugucguauaugcaucuga

SEQ ID NO: 122850 - RNA, 1701 nt, Artificial Sequence; identical to SEQ ID NO: 122649
  derived and/or modified sequence opt3 from hemagglutinin__InfluenzaA__ABD94954

SEQ ID NO: 122851 - RNA, 1698 nt, Artificial Sequence; identical to SEQ ID NO: 122758
  derived and/or modified sequence opt3 from hemagglutinin__InfluenzaA__ABD94965

SEQ ID NO: 122852 - RNA, 1698 nt, Artificial Sequence; identical to SEQ ID NO: 122757
  derived and/or modified sequence opt3 from hemagglutinin__InfluenzaA__ABD94987

SEQ ID NO: 122853 - RNA, 1698 nt, Artificial Sequence; identical to SEQ ID NO: 122757
  derived and/or modified sequence opt3 from hemagglutinin__InfluenzaA__ABD94998

SEQ ID NO: 122854 - RNA, 1698 nt, Artificial Sequence; identical to SEQ ID NO: 122757
  derived and/or modified sequence opt3 from hemagglutinin__InfluenzaA__ABD95009

SEQ ID NO: 122855 - RNA, 1698 nt, Artificial Sequence; identical to SEQ ID NO: 122758
  derived and/or modified sequence opt3 from hemagglutinin__InfluenzaA__ABD95020

SEQ ID NO: 122856 - RNA, 1698 nt, Artificial Sequence
  derived and/or modified sequence opt3 from hemagglutinin__InfluenzaA__ABD95031
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuuacagacuaugaggaacugagagagcaacucucuucggugagcucauucgaaagguuugagauuuucccuaaggagaguuccuggccaaaucauaccgucacgggugugucugcuagcugcucccacaacgggaagucaaguuuuuaccggaauuuacuguggcuuacuggcaaaaacggauuguaucccaaucugcgccgaagcuacgccaacaauaaggaaaaagagguucuaguacucuggggcgugcaucacccuccaaacaucggggaucagaaggcacuguaccacaccgaaaacgccuaugucucugugguguccucacauuacagccguagauucacacccgagauagcuaaaaggccuaagguccggggacaggaaggucgcaucaauuauuacuggacucuucuggagccaggcgacaccauuaucuuugaggcaaacgggaauuugauugccccgagauaugcuuucgcccucaguaggggauuuggcucugguaucauaacauccaacgcgcccauggaugaaugugacgcaaagugccagaccccucaaggggccauuaauagcucgcugccauuccagaacguucaccccgugacgaucggagaguguccuaaauacguacggucugcuaaguuacgcauggugacuggccugcgaaauauuccauccauccagucaagaggccucuuuggggccaucgcaggauucauugaagguggcuggacagggauggucgauggaugguauggcuaccaucaccagaacgagcaagguaguggguacgcugccgaccagaaaagcacccagaaugcgauaaacggcaucacuaauaaggugaacuccauuaucgaaaagaugaauacacaguuuaccgccguuggaaaagaguucaacaaacuugagaggcggauggaaaaucugaacaagaagguggaugacggcuucuuggauauauggacguauaacgcagagcuacugguccuccuggaaaaugagcguacccuugacuuucacgacucuaacgugaaaaaucuguacgaaaagguaaaaagccaauugaagaacaaugcuaaagagauugggaacggaugcuucgaguuuuaucauaaguguaauaacgaaugcauggagucaguuaagaaugguacauacgauuaucccaaauacagugaagaguccaagcucaaccgcgagaaaaucgacggcgugaagcuggaaagcaugggggucuaucagaucuuagccauuuacucuacuguggcuucaagucugguccuacucgugagccugggagccaucuccuucuggaugugcucuaauggcucgcuucaguguagaauuugcauauga

SEQ ID NO: 122857 - RNA, 1698 nt, Artificial Sequence
  derived and/or modified sequence opt3 from hemagglutinin__InfluenzaA__ABD95042
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggggaaagagguacuuguucucuggggagugcaucacccuccaaacaucggugaucagcgcgcccuguaccacacugaaaacgcuuaugucuccguggugucaagccauuacagucgacguuucacccccgagauagcaaagagaccuaaagucagggaccaggaaggccggaucaauuauuacuggacacuucuggagccaggggauacuauuaucuuugaagccaacggaaauuugauugcuccgugguaugccuucgcgcucucucgcggcuuugguuccgggaucauaaccagcaacgcacccaugggagagugugacgccaagugccagacaccucaaggcgcuauuaauucgucucugccauuccagaacguucaccccgugaccaucggcgaguguccuaaguacguaagauccgccaaauuaaggauggugacggggcugcggaauauuccaucaauccagagucgcggacucuuuggugcaaucgcuggcuucauugaagggggauggacuggcauggucgaugguugguauggguaccaucaccagaacgagcaaggcagcggauacgccgcggaccagaaguccacacagaaugccauaaacggcaucaccaauaaagugaacucuguuauugaaaagaugaauacucaguuuacagcaguggggaaagaguucaacaagcuagaacgaagaauggagaaucugaacaaaaaggucgaugacggauucuuggauaucuggaccuauaacgcugagcuacuggugcuccuggaaaaugagaggacgcuugacuuucacgacagcaacguaaagaaucuguacgaaaaaguuaagucacaauugaaaaacaaugccaaggagauagguaacggcugcuucgaauuuuaucauaaauguaauaacgagugcauggagagugugaagaaugggaccuacgauuaucccaaguacuccgaagagagcaaacucaaccgggaaaagauugacggagucaaacuggagucuaugggcguguaucagaucuuagcuaucuacucaacagucgccaguagccuggugcuacucguuucccugggugcaauuucuuucuggaugugcucgaaugggagccuucagugucguaucugcauuuga

SEQ ID NO: 122858 - RNA, 1698 nt, Artificial Sequence; identical to SEQ ID NO: 122857
  derived and/or modified sequence opt3 from hemagglutinin__InfluenzaA__ABD95053

SEQ ID NO: 122859 - RNA, 1698 nt, Artificial Sequence; identical to SEQ ID NO: 122816
  derived and/or modified sequence opt3 from hemagglutinin__InfluenzaA__ABD95064

SEQ ID NO: 122860 - RNA, 1698 nt, Artificial Sequence
  derived and/or modified sequence opt3 from hemagglutinin__InfluenzaA__ABD95075
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguucuaguacucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuauuacuggacacuucuggaaccaggcgauacuauuaucuuugaggccaacgggaauuugauugcuccgugguaugccuucgcgcucucuaagggauuuggcuccgguaucauaaccagcaacgcacccaugggggagugugacgccaagugccagacaccucaaggagcuauuaauucgucucugccauuccagaacguucaccccgugaccaucggcgaauguccuaaauacguacgcuccgccaaguuaagaauggugacgggccugaggaauauuccaucaauccagagucgggggcucuuuggagcaaucgcugguuucauugagggcggguggacuggaauggucgauggcugguaugguuaccaucaccagaacgaacaagggagcggcuacgccgcggaccagaaauccacacagaaugccauaaacggaaucaccaauaaggugaacucuguuauugagaaaaugaauacucaguuuacagcagugggcaaggaguucaacaaacuugaacgccgaauggagaaucugaacaagaaggucgaugacggguucuuggauaucuggaccuauaacgcugaacuacuggugcuccuggagaaugaaagaacgcuugacuuucacgacagcaacguuaaaaaucuguacgagaagguaaaaucacaauugaagaacaaugccaaagaaauaggaaacgguugcuucgaguuuuaucauaaguguaauaacgagugcauggaaagugugaagaauggcaccuacgauuaucccaaauacuccgaggaaagcaagcucaacagggagaaaauugacggggucaagcuggagucuaugggaguguaucagaucuuagcuaucuacucaacagucgccaguagccuggugcuacucguuucccugggcgcaauuucuuucuggaugugcucgaaugguagccuucagugucggaucugcauuuga

SEQ ID NO: 122861 - RNA, 1698 nt, Artificial Sequence; identical to SEQ ID NO: 122857
  derived and/or modified sequence opt3 from hemagglutinin__InfluenzaA__ABD95086

SEQ ID NO: 122862 - RNA, 1698 nt, Artificial Sequence; identical to SEQ ID NO: 122816
  derived and/or modified sequence opt3 from hemagglutinin__InfluenzaA__ABD95097

SEQ ID NO: 122863 - RNA, 1698 nt, Artificial Sequence
  derived and/or modified sequence opt3 from hemagglutinin__InfluenzaA__ABD95119
augaaggccaaacugcucauccuucugugcaccuucacagcuacuuacgcagacacgauuuguauaggcuaucacgccaacaauagcaccgauacaguggacacugucuuggagaagaacguuaccgugacacauuccguaaauuuacuggaagauucucacaacgggaaacuaugccuccugaagggaaucgcgccccuucagcuggguaauuguucaguggcuggcuggauuuuggggaacccugagugcgaacuccugaucaguaaagagagcugguccuacauugucgaaaccccaaauccggagaacggaacuuguuaucccggcuacuuugccgacuaugaggaacugagagagcaacucucuucggugagcucauucgaaagguuugagaucuucccuaaggguaguuccuggccaaaucauacaguuaccggggugucugcaagcugcucccacaacggaaagucaaguuuuuaccggaauuuacuguggcuuacgggcaaaaacggcuuguaucccaaucugagcaugucuuacgucaacaauaaggagaaagaagugcuaguacucuggggaguucaucacccuccaaacauaggggaucagcgcgcccuguaccacacugagaacgcuuauguguccgucgugucaagccauuacagucgacguuucacccccgaaaucgcaaagagaccuaaagugagggaccaggagggucggauuaauuauuacuggacacuucuggaaccaggcgauacuaucauuuuugaggccaacgggaauuugaucgcuccgugguaugccuucgcgcucucucgcggauuuggcuccgguauaauuaccagcaacgcacccaugggggagugugacgccaagugccagacaccucaaggagcuaucaauucgucucugccauuccagaacguccaccccguuaccauuggcgaauguccuaaguacgugagauccgccaaauuaaggaugguaacgggccugcggaauaucccaucaauccagagucgcgggcucuuuggagcaauugcugguuucauagagggcggguggacuggaaugguggauggcugguaugguuaccaucaccagaacgaacaagggagcggcuacgccgcggaccagaaguccacacagaaugccaucaacggaauuaccaauaaagucaacucugugaucgagaagaugaauacucaguuuacagcaguuggcaaagaguucaacaaacuugaacgaagaauggagaaucugaacaagaagguggaugacggguucuuggauauauggaccuauaacgcugaacuacugguccuccuggagaaugaaaggacgcuugacuuucacgacagcaacgugaagaaucuguacgagaaaguaaagucacaauugaaaaacaaugccaaggaaauuggaaacgguugcuucgaguuuuaucauaaauguaauaacgagugcauggaaaguguuaagaauggcaccuacgauuaucccaaguacuccgaggaaagcaaacucaaccgggagaagaucgacggggugaaacuggagucuaugggagucuaucagaucuuagcuauuuacucaacaguggccaguagccugguccuacucgugucccugggcgcaaucucuuucuggaugugcucgaaugguagccuucagugucguauuugcauauga

SEQ ID NO: 122864 - RNA, 1698 nt, Artificial Sequence
  derived and/or modified sequence opt3 from hemagglutinin__InfluenzaA__ABD95130
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcagcuaucccaauuugucuauguccuacgugaacaauaaggagaaagaaguacugguucuauggggagugcaucacccuccaaacaucggggaucagcgcgcccucuaccacacugagaacgcuuaugucucaguggugagcagucauuacucucgacguuucacccccgaaauagcaaagagaccuaaagucagggaccaggagggucggaucaauuauuacuggacacugcuugaaccaggcgauacuauuaucuuugaggccaacgggaaucugauugcuccgugguaugccuucgcguugucccgcggauuuggcagcgguaucauaaccucgaacgcacccaugggggagugugacgccaagugccagacaccucaaggagcuauuaauucuucccucccauuccagaacguucaccccgugaccaucggcgaauguccuaaguacguaagaucagccaaacugaggauggugacgggcuuacggaauauuccaaguauccagagccgcgggcuguuuggagcaaucgcugguuucauugagggcggguggacuggaauggucgauggcugguaugguuaccaucaccagaacgaacaaggguccggcuacgccgcggaccagaagucuacacagaaugccauaaacggaaucaccaauaaagugaacagcguuauugagaagaugaauacucaguuuacagcagugggcaaagaguucaacaagcucgaacgaagaauggagaaucuuaacaaaaaggucgaugacggguuccuggauaucuggaccuauaacgcugaauugcuagugcugcucgagaaugaaaggacgcuggacuuucacgacucaaacguaaagaaucuuuacgagaaaguuaagagucaacugaaaaacaaugccaaggaaauaggaaacgguugcuucgaguuuuaucauaaauguaauaacgagugcauggaauccgugaagaauggcaccuacgauuaucccaaguacagcgaggaaucuaaauugaaccgggagaagauugacggggucaaacucgagucaaugggaguguaucagauccuggcuaucuacaguacagucgccagcuccuuagugcugcuaguuucucucggcgcaauuucguucuggaugugcagcaaugguucccugcagugucguaucugcauuuga

SEQ ID NO: 122865 - RNA, 1698 nt, Artificial Sequence; identical to SEQ ID NO: 122816
  derived and/or modified sequence opt3 from hemagglutinin__InfluenzaA__ABD95141

SEQ ID NO: 122866 - RNA, 1698 nt, Artificial Sequence; identical to SEQ ID NO: 122816
  derived and/or modified sequence opt3 from hemagglutinin__InfluenzaA__ABD95152

SEQ ID NO: 122867 - RNA, 1698 nt, Artificial Sequence; identical to SEQ ID NO: 122863
  derived and/or modified sequence opt3 from hemagglutinin__InfluenzaA__ABD95163

SEQ ID NO: 122868 - RNA, 1698 nt, Artificial Sequence; identical to SEQ ID NO: 122857
  derived and/or modified sequence opt3 from hemagglutinin__InfluenzaA__ABD95174

SEQ ID NO: 122869 - RNA, 1698 nt, Artificial Sequence
  derived and/or modified sequence opt3 from hemagglutinin__InfluenzaA__ABD95185
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggagagucaaguuuuuaccggaauuuacuguggcuuacgggcaagaacggcuuguaucccaaucugagcaugucuuacgugaacaauaaagaaaaggagguucuaguacucuggggagugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggucggaucaauuauuacuggacacuucuggagccaggcgauacuauuaucuuugaggccaacgggaauuugauugcuccgugguaugccuucgcgcucucucgcggauuuggcuccgguaucauaaccagcaacgcacccaugggggaaugugacgccaaaugccagacaccucaaggagcuauuaauucgucucugccauuccagaacguucaccccgugaccaucggcgaguguccuaaguacguaagauccgccaaguuaaggauggugacgggccugcggaauauuccaucaauccagagucgcgggcucuuuggagcaaucgcugguuucauugaaggcggguggacuggaauggucgauggcugguaugguuaccaucaccagaacgagcaagggagcggcuacgccgcggaccagaaauccacacagaaugccauaaacggaaucaccaauaaggugaacucuguuauugaaaagaugaauacucaguuuacagcagugggcaaagaguucaacaaacuugagcgaagaauggaaaaucugaacaagaaagucgaugacggguucuuggauaucuggaccuauaacgcugagcuacuggugcuccuggaaaaugagaggacgcuugacuuucacgacagcaacguaaagaaucuguacgaaaagguuaaaucacaauugaagaacaaugccaaagagauaggaaacgguugcuucgaguuuuaucauaaguguaauaacgaaugcauggagagugugaaaaauggcaccuacgauuaucccaaguacuccgaagagagcaagcucaaccgggagaaaauugacggggucaagcuggaaucuaugggaguguaucagaucuuagcuaucuacucaacagucgccaguagccuggugcuacucguuucccugggcgcaauuucuuucuggaugugcucgaaugguagccuucagugucguaucugcauuuga

SEQ ID NO: 122870 - RNA, 1698 nt, Artificial Sequence; identical to SEQ ID NO: 122857
  derived and/or modified sequence opt3 from hemagglutinin__InfluenzaA__ABD95196

SEQ ID NO: 122871 - RNA, 1698 nt, Artificial Sequence; identical to SEQ ID NO: 122315
  derived and/or modified sequence opt3 from hemagglutinin__InfluenzaA__ABD95207

SEQ ID NO: 122872 - RNA, 1698 nt, Artificial Sequence; identical to SEQ ID NO: 122816
  derived and/or modified sequence opt3 from hemagglutinin__InfluenzaA__ABD95218

SEQ ID NO: 122873 - RNA, 1698 nt, Artificial Sequence; identical to SEQ ID NO: 122863
  derived and/or modified sequence opt3 from hemagglutinin__InfluenzaA__ABD95229

SEQ ID NO: 122874 - RNA, 1698 nt, Artificial Sequence; identical to SEQ ID NO: 122816
  derived and/or modified sequence opt3 from hemagglutinin__InfluenzaA__ABD95240

SEQ ID NO: 122875 - RNA, 1698 nt, Artificial Sequence; identical to SEQ ID NO: 122857
  derived and/or modified sequence opt3 from hemagglutinin__InfluenzaA__ABD95251

SEQ ID NO: 122876 - RNA, 1698 nt, Artificial Sequence; identical to SEQ ID NO: 122315
  derived and/or modified sequence opt3 from hemagglutinin__InfluenzaA__ABD95262

SEQ ID NO: 122877 - RNA, 1698 nt, Artificial Sequence; identical to SEQ ID NO: 122816
  derived and/or modified sequence opt3 from hemagglutinin__InfluenzaA__ABD95273

SEQ ID NO: 122878 - RNA, 1698 nt, Artificial Sequence; identical to SEQ ID NO: 122312
  derived and/or modified sequence opt3 from hemagglutinin__InfluenzaA__ABD95284

SEQ ID NO: 122879 - RNA, 1698 nt, Artificial Sequence; identical to SEQ ID NO: 122816
  derived and/or modified sequence opt3 from hemagglutinin__InfluenzaA__ABD95295

SEQ ID NO: 122880 - RNA, 1698 nt, Artificial Sequence
  derived and/or modified sequence opt3 from hemagglutinin__InfluenzaA__ABD95306
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaauccuaguacucuggggaguucaucacccuccaaacauaggggaucagcgcgcccuguaccacacugagaacgcuuauguguccgucgugucaagccauuacagucgacguuucacccccgaaaucgcaaagagaccuaaagugagggaccaggagggucggauuaauuauuacuggacacuucuggaaccaggcgauacuaucauuuuugaggccaacgggaauuugaucgcuccgugguaugccuucgcgcucucucgcggauuuggcuccgguauaauuaccagcaacgcacccaugggggagugugacgccaagugccagacaccucaaggagcuaucaauucgucucugccauuccagaacguccaccccguuaccauuggcgaauguccuaaguacgugagauccgccaaauuaaggaugguaacgggccugcggaauaucccaucaauccagagucgcgggcucuuuggagcaauugcugguuucauagagggcggguggacuggaaugguggauggcugguaugguuaccaucaccagaacgaacaagggagcggcuacgccgcggaccagaaguccacacagaaugccaucaacggaauuaccaauaaagucaacucugugaucgagaagaugaauacucaguuuacagcaguuggcaaagaguucaacaaacuugaacgaagaauggagaaucugaacaagaagguggaugacggguucuuggauauauggaccuauaacgcugaacuacugguccuccuggagaaugaaaggacgcuugacuuucacgacagcaacgugaagaaucuguacgagaaaguaaagucacaauugaaaaacaaugccaaggaaauuggaaacgguugcuucgaguuuuaucauaaauguaauaacgagugcauggaaaguguuaagaauggcaccuacgauuaucccaaguacuccgaggaaagcaaacucaaccgggagaagaucgacggggugaaacuggagucuaugggagucuaucagaucuuagcuauuuacucaacaguggccaguagccugguccuacucgugucccugggcgcaaucucuuucuggaugugcucgaaugguagccuucagugucguauuugcauauga

SEQ ID NO: 122881 - RNA, 1698 nt, Artificial Sequence; identical to SEQ ID NO: 122857
  derived and/or modified sequence opt3 from hemagglutinin__InfluenzaA__ABD95328

SEQ ID NO: 122882 - RNA, 1701 nt, Artificial Sequence
  derived and/or modified sequence opt3 from hemagglutinin__InfluenzaA__ABD95339
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagagcuccuggccuaagcauucagugacccgcgguguuacugcuaguugcagccacaaagggaagucuuccuuuuaucgaaaccucuuauggcugacagagaaaaauggaucauacccaaaccuuagcaagaguuaugugaaugacaaggaaaaagaggucuuggugcuguggggcguacaucaccccucuaacaucgaagaucagaagaccauauaccguaaagagaaugcauacguuuccguggucagcucgcacuauaacagaagguucacgccugaaaucgccaagcggccaaaagugcgcgaccaggagggcagaauuaauuacuauuggacucuacucgagcccggggauaccaucauuuuugaagcuaacggaaaccugaucgccccuugguacgcguucgcacuuucuagggguuuuggcuccgggauaauuacaucaaaugugaguauggacgagugugaugccaagugccagacuccacaaggagcuaucaacagcucccugccguuccagaauguccaucccguuaccauuggcgaauguccuaaauaugugcggucuacaaaguugcgcaugguaaccggucuccgaaacaucccaagcauccagucaagagggcuguuuggagccauugcaggcuucauagagggcggguggacgggaaugaucgacgguugguacggcuaucaccaucagaaugaacaagggaguggauacgcugccgaucagaaguccacucagaacgcgauuaauggcaucacaaacaaagugaauagcgucauagagaagaugaacacccaguuuacugccguggguaaagaguucaauaaguuagaaaagaggauggagaaccugaauaagaagguugacgacggguuccucgauauuuggacauacaacgcagaacuucugguguugcuagagaaugaacggacccuggacuuucacgauucuaacgucaaaaaccucuaugagaaggugaaaucacaacugaagaauaacgcuaaagagaucggcaauggaugcuucgaauuuuaccacaaguguaacaaugagugcauggaaaguguaaagaacggcacguaugacuaccccaaauauagcgaggaguccaaacuuaaucgugagaaaaucgaugggguuaagcuggaaucuaugggaguguaccagauuuuggccaucuauucgaccgucgcuagcucccucgugcuguuagucucacugggugccauuaguuucuggaugugcucuaacggcagccuacagugucgcauaugcaucuga

SEQ ID NO: 122883 - RNA, 1698 nt, Artificial Sequence; identical to SEQ ID NO: 122758
  derived and/or modified sequence opt3 from hemagglutinin__InfluenzaA__ABE11657

SEQ ID NO: 122884 - RNA, 1698 nt, Artificial Sequence
  derived and/or modified sequence opt3 from hemagglutinin__InfluenzaA__ABE11668
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggagaguuccuggccaaaucauacagugaccggugucucugcaagcugcucccacaacgggaagucaaguuuuuaccggaauuuacuguggcuuacgggaaagaacggcuuguaucccaaucugagcaugucuuacgugaacaauaaggaaaaagagguucuaguacucuggggcgugcaucacccuccaaacaucggggaucagcgcgcccuguaccacacugaaaacgcuuaugucuccguggugucaagccauuacagucgacguuucacccccgagauagcaaagagaccuaaagucagggaccaggaaggacggaucaauuauuacuggacacuucuggagccaggugauacuauuaucuuugaggccaacggcaauuugauugcuccgugguaugccuucgcgcucucucgcggguuuggauccggcaucauaaccagcaacgcacccauggacgaaugugaugccaagugccagacaccucaaggugcuauuaauucgucucugccauuccagaacguucaccccgugaccaucggggaguguccuaaguacguaagauccgccaaauuaaggauggugacgggacugcggaauauuccaucaauccagagucgcggccucuuuggcgcaaucgcuggguucauugaaggagguuggacuggcauggucgacgggugguauggauaccaucaccagaacgagcaaggcagcgguuacgccgcggaucagaaguccacacagaaugccauaaacgggaucaccaauaaagugaacucuguuauugaaaagaugaauacucaguuuacagcagugggcaaagaguucaacaaacuugagcgaagaauggaaaaucugaacaaaaaggucgacgauggauucuuggacaucuggaccuauaacgcugagcuacuggugcuccuggaaaaugagaggacgcuugacuuucacgauagcaacguaaagaaucuguacgaaaaaguuaagucacaauugaaaaacaaugccaaggagauaggcaacgggugcuucgaguuuuaucauaaauguaauaacgaaugcauggagagugugaagaauggaaccuacgacuaucccaaguacuccgaagagagcaaacucaaccgggagaagauugauggugucaaacuggaaucuaugggcguguaucagaucuuagcuaucuacucaacagucgccaguagccuggugcuacucguuucccugggggcaauuucuuucuggaugugcucgaauggaagccuucagugucguaucugcauuuga

SEQ ID NO: 122885 - RNA, 1698 nt, Artificial Sequence
  derived and/or modified sequence opt3 from hemagglutinin__InfluenzaA__ABE11679
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggacgcaacggcuuguaucccaaucugagcaaaucuuacgcaaacaauaaggaaaaagagguacuuguucucuggggcgugcaucacccuccaaacaucggggaucagcgagcccuguaccacacugaaaacgcuuaugucuccguggugucaagccauuacagucguagauucacccccgagauagcaaagaggccuaaaguccgggaccaggaaggacgcaucaauuauuacuggacacuucuggagccaggugauacuauuaucuuugaggccaacggcaauuugauugcuccgagauaugccuucgcgcucucuaggggguuuggauccggcaucauaaccagcaacgcacccauggacgaaugugaugccaagugccagacaccucaaggugcuauuaauucgucucugccauuccagaacguucaccccgugaccaucggggaguguccuaaguacguacgguccgccaaauuacgcauggugacgggacugcgaaauauuccaucaauccagaguagaggccucuuuggcgcaaucgcuggguucauugaaggagguuggacuggcauggucgacgggugguauggauaccaucaccagaacgagcaaggcagcgguuacgccgcggaucagaaguccacacagaaugccauaaacgggaucaccaauaaagugaacucuguuauugaaaagaugaauacucaguuuacagcagugggcaaagaguucaacaagcuagagaggcggauggaaaaucugaacaaaaaggucgacgauggauucuuggacaucuggaccuauaacgcugagcuacuggugcuccuggaaaaugagcguacgcuugacuuucacgauagcaacguaaagaaucuguacgaaaaaguuaagucacaauugaaaaacaaugccaaggagauaggcaacgggugcuucgaguuuuaucauaaauguaaugacgaaugcauggagagugugaagaacggaaccuacgauuaucccaaguacuccgaagagagcaaacucaaucgcgagaagauugacggugucaaacuggaaucuaugggcguguaucagaucuuagcuaucuacucaacagucgccaguagccuggugcuacucguuucccugggggcaauuucuuucuggaugugcucgaacggaagccuucaguguagaaucugcauuuga

SEQ ID NO: 122886 - RNA, 1698 nt, Artificial Sequence
  derived and/or modified sequence opt3 from hemagglutinin__InfluenzaA__ABE11690
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuucaucuuucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucgggaaccagcgcgcccuguaccacacugagaaugcuuaugucuccguggugucaagccauuacagucgacguuucacccccgaaauagcaaagagaccuaaagucagggaucaggagggucggaucaacuauuacuggacacuucuggaaccaggcgacacuauuaucuuugaggccaaugggaacuugauugcuccgugguaugccuucgcgcucucucgcggauuuggcuccgguaucauaaccagcaaugcacccaugggggagugugaugccaagugccagacaccucaaggagcuauuaacucgucucugccauuccagaauguucaccccgugaccaucggcgaauguccuaaguacguaagauccgccaaauuaaggauggugacgggccugcggaacauuccaucaauccagagucgcgggcucuuuggagcaaucgcugguuucauugagggcggguggacuggaauggucgacggcugguaugguuaccaucaccagaaugaacaagggagcggcuacgccgcggaucagaaguccacacagaacgccauaaauggaaucaccaacaaagugaauagcguuauugagaagaugaacacucaguuuacagcagugggcaaagaguucaauaagcuagaacgaagaauggagaaccugaacaaaaaggucgacgauggguucuuggacaucuggaccuauaaugcugaacuacuggugcuccuggagaacgaaaggacgcuugauuuucacgacagcaauguaaagaaccuguacgagaaaguuaagucacaauugaaaaauaacgccaaggaaauaggaaaugguugcuucgaguuuuaucauaaauguaacaaugagugcauggaaagugugaagaacggcaccuacgacuaucccaaguacuccgaggaaagcaaacucaaucgggagaagauugauggggucaaacuggagucuaugggaguguaucagaucuuagcuaucuacucaacagucgccaguagccuggugcuacucguuucccugggcgcaauuucuuucuggaugugcucgaacgguagccuucagugucguaucugcauuuga

SEQ ID NO: 122887 - RNA, 1698 nt, Artificial Sequence
  derived and/or modified sequence opt3 from hemagglutinin__InfluenzaA__ABE11701
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguucuaguacucuggggagugcaucacccuccaaacaucggggaucagaaggcccuguaccacacugagaacgcuuaugucuccguggugucaagccauuacagucgccgauucacccccgaaauagcaaaacguccuaaggucagagaccaggaggguaggaucaauuauuacuggacacuucuggaaccaggcgauacuauuaucuuugaggccaacgggaauuugauugcuccgugguaugccuucgcgcucucucggggauuuggcuccgguaucauaaccagcaacgcacccaugggggagugugacgccaagugccagacaccucaaggagcuauuaauucgucucugccauuccagaacguucaccccgugaccaucggcgaauguccuaaauacguacgcuccgccaaguuaagaauggugacgggccugaggaauauuccaucaauccagagucgggggcucuuuggagcaaucgcugguuucauugagggcggguggacuggaauggucgauggcugguaugguuaccaucaccagaacgaacaagggagcggcuacgccgcggaccagaaauccacacagaaugccauaaacggaaucaccaauaaggugaacucuauuaucgagaaaaugaauacucaguuuacagcaguuggcaaggaguucaacaaacuugaacgccgaauggagaaucugaacaagaagguggaugacggguucuuggauauauggaccuauaacgcugaacuacugguccuccuggagaaugaaagaacgcuugacuuucacgacagcaacgugaaaaaucuguacgagaagguaaaaucacaauugaagaacaaugccaaagaaauuggaaacgguugcuucgaguuuuaucauaaguguaauaacgagugcauggaaaguguuaagaauggcaccuacgauuaucccaaauacuccgaggaaagcaagcucaacagggagaaaaucgacggggugaagcuggagucuaugggagucuaucagaucuuagcuauuuacucaacaguggccaguagccugguccuacucgugucccugggcgcaaucucuuucuggaugugcucgaaugguagccuucagugucggauuugcauauga

SEQ ID NO: 122888 - RNA, 1698 nt, Artificial Sequence; identical to SEQ ID NO: 122816
  derived and/or modified sequence opt3 from hemagglutinin__InfluenzaA__ABE11712

SEQ ID NO: 122889 - RNA, 1698 nt, Artificial Sequence; identical to SEQ ID NO: 122857
  derived and/or modified sequence opt3 from hemagglutinin__InfluenzaA__ABE11723

SEQ ID NO: 122890 - RNA, 1698 nt, Artificial Sequence; identical to SEQ ID NO: 122863
  derived and/or modified sequence opt3 from hemagglutinin__InfluenzaA__ABE11734

SEQ ID NO: 122891 - RNA, 1698 nt, Artificial Sequence; identical to SEQ ID NO: 122816
  derived and/or modified sequence opt3 from hemagglutinin__InfluenzaA__ABE11812

SEQ ID NO: 122892 - RNA, 1698 nt, Artificial Sequence; identical to SEQ ID NO: 122857
  derived and/or modified sequence opt3 from hemagglutinin__InfluenzaA__ABE11823

SEQ ID NO: 122893 - RNA, 1698 nt, Artificial Sequence; identical to SEQ ID NO: 122857
  derived and/or modified sequence opt3 from hemagglutinin__InfluenzaA__ABE11834

SEQ ID NO: 122894 - RNA, 1698 nt, Artificial Sequence; identical to SEQ ID NO: 122857
  derived and/or modified sequence opt3 from hemagglutinin__InfluenzaA__ABE11845

SEQ ID NO: 122895 - RNA, 1698 nt, Artificial Sequence; identical to SEQ ID NO: 122863
  derived and/or modified sequence opt3 from hemagglutinin__InfluenzaA__ABE11856

SEQ ID NO: 122896 - RNA, 1701 nt, Artificial Sequence
  derived and/or modified sequence opt3 from hemagglutinin__InfluenzaA__ABE11900
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugaaaagaacggacuguaucccaaucuuagcaagucuuacgucaacaauaaagagaaggaaguguugguacuguggggcguucaucacccuuccaacaucggcgaucagcgcgcaauuuaccacaccgagaacgccuaugugucagucgugagcagucauuacucucgacguuuuacaccagaaaucgcuaagagacccaaagugagggaccaggaggggcggauaaauuauuacuggacucuacucgagccuggagauaccaucauuuucgaagccaacgguaaucugaucgcgccaugguaugcauuugcccuuucccgcggcuucgggagcggaauuaucacaucgaacgcuucuaugggcgagugugacgccaagugccagaccccgcaaggugcaauaaauuccucacugcccuuucagaacguccacccuguuacgauuggggaauguccaaaauacgugagaaguacuaaguugaggaugguaacaggacuccggaauauccccagcauucagucccgcggccuguucggcgcuaucgccggguuuaucgagggagguuggaccggcaugauugaugggugguauggauaccaucaccagaacgaacaaggcucugguuacgcggccgaccagaaaagcacucagaaugcaauaaacgggaucacaaauaaggugaacucagucauugagaaaaugaauacccaguucacggcugugggcaaggaguucaacaaguuagaacgaagaauggagaaucugaacaaaaagguugaugacggauuucucgauaucuggaccuauaacgccgaacuucugguguugcuagagaaugaaaggacacuggacuuccacgacaguaacgucaaaaaucucuacgagaaggugaaaacucaacugaagaacaaugcuaaggagauaggcaacgggugcuuugaguucuaucauaaauguaauaacgaaugcauggaauccguaaagaauggaaccuacgauuauccuaaauacagcgaggagucuaaacuuaaccgggagaaaauugacgguguuaagcuggaaucaaugggcguguaucagaucuuggccaucuacaguacagucgcaagcucccucgugcuguuaauuucucugggggccaucucguuuuggaugugcagcaauggaucccuacagugucguauuugcauauga

SEQ ID NO: 122897 - RNA, 1701 nt, Artificial Sequence
  derived and/or modified sequence opt3 from hemagglutinin__InfluenzaA__ABE11942
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugaaaagaacggacuguaucccagccuuucuaaguccuacgucaauaacaaagagaaggaaguguugguacuguggggcguucaucacccuucaaauaucggcgaucagcgcgcaauuuaccacaccgagaacgccuaugugagcgucgugaguucucauuacucccgacguuuuacaccagaaaucgcuaagagacccaaagugagggaccaggaggggcggauaaacuauuacuggacucuacucgagccuggagauaccaucauuuucgaagccaaugguaaccugaucgcgccaugguaugcauuugcccuuagccgcggcuucgggucgggaauuaucacaucuaaugcuuccaugggcgagugugacgccaagugccagaccccgcaaggugcaauaaacucaagucugcccuuucagaauguccacccuguuacgauuggggaauguccaaaauacgugagaagcacuaaguugaggaugguaacaggacuccggaacauccccuccauucagucucgcggccuguucggcgcuaucgccggguuuaucgagggagguuggaccggcaugauugaugggugguauggauaccaucaccagaaugaacaaggcagcgguuacgcggccgaccagaaaucaacucagaacgcaauaaaugggaucacaaacaaggugaauagugucauugagaaaaugaacacccaguucacggcugugggcaaggaguucaauaaguuagaacgaagaauggagaaccugaauaaaaagguugaugacggauuucucgauaucuggaccuauaacgccgaacuucugguguugcuagagaacgaaaggacacuggacuuccacgacuccaaugucaaaaaccucuacgagaaggugaaaacucaacugaagaauaacgcuaaggagauaggcaaugggugcuuugaguucuaucauaaauguaacaaugaaugcauggaaagcguaaagaacggaaccuacgauuauccuaaauacucugaggagucaaaacuuaaucgggagaaaauugacgguguuaagcuggaaaguaugggcguguaucagaucuuggccaucuacagcacagucgcauccucucucgugcuguuagucucgcugggggccauuagcuuuuggaugugcuccaacggaucacuacagugucguaucugcauuuga

SEQ ID NO: 122898 - RNA, 1701 nt, Artificial Sequence
  derived and/or modified sequence opt3 from hemagglutinin__InfluenzaA__ABE12078
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccaaaauucugagggaacuggccaggcugccgacuugaaaagcacacaggcggccaucaaccagaucaaugguaaacucaaccgucugauugaaaagaccaaugagaaguuucaucagaucgaaaaagaguucucagaaguagaggggcgcauucaggauuuagagaaguauguggaagacacgaaaauagaucuguggaguuacaacgcagagcuccuugucgcucuggaaaaccaacacaccaucgacuugacagauuccgagaugaauaagcuauucgaaaagacuaagaagcagcugagagagaacgccgaggacaugggcaauggauguuuuaaaauuuaucauaagugcgauaacgcuugcaucggcagcaucaggaaugggaccuacgaccacgauguguaccgggacgaagcccucaacaaucgauuccagauuaaaggaguugagcugaagucugguuauaaagacuggauacuuuggaucucauuugcaauuaguuguuuccuguugugcgugguccuccugggcuuuaucaugugggccugucagaaggggaacauucgcugcagcaucuguauauga

SEQ ID NO: 122899 - RNA, 1701 nt, Artificial Sequence; identical to SEQ ID NO: 122793
  derived and/or modified sequence opt3 from hemagglutinin__InfluenzaA__ABE12123

SEQ ID NO: 122900 - RNA, 1698 nt, Artificial Sequence; identical to SEQ ID NO: 122816
  derived and/or modified sequence opt3 from hemagglutinin__InfluenzaA__ABE12248

SEQ ID NO: 122901 - RNA, 1701 nt, Artificial Sequence
  derived and/or modified sequence opt3 from hemagglutinin__InfluenzaA__ABE12623
augaagaccaucauugcccugagcuacauauucugccucgugcuuggccaggaccugcccgggaacgauaauuccacagcuacuuuguguuuaggacaccaugcagucccuaacgguacgcugguuaaaaccaucacaaaugaccaaauugaggugacuaacgccaccgagcuaguacagucuucaaguacaggcaagaucugcaauaacccacacaggauucucgaugggaucgacuguacccugauagaugcgcuucugggagacccgcauugcgauggcuuucagaaugaaacuugggacuuguucguggaaagaagcaaggcuuuuuccaacuguuaucccuacgaugucccugacuaugccucucuccggucgcugguggcaucaagcgguacacuggaguucaucaaugaaggguuuaccuggacgggaguuacucagaacggcggcaguaaugccugcaagcgcgggccagauuccggauucuuuucucgacucaacugguuauacaaaagcgguuccaccuaucccgugcugaaugucacaaugccuaacaaugacaacuucgauaaacuuuacauuuggggcgugcaccauccaucaacuaaccaagagcagaccaguuuguauguacaggcuagcgggcguguuacagugucuaccaagagaucccagcaaacgaucauucccaauaucggaucaaggccuuggguccggggccugagcagucgcauaucuauuuacuggacuaucgugaaaccaggugacauucuagugaucaacuccaaugggaaccucaucgcaccgagaggauacuuuaagaugaggacaggcaaaagcucgauuaugcggucugacgcccccauaggcaccuguaucuccgagugcauuacuccuaaugggucaaucccaaacgauaagcccuuccagaaugucaacaaaauaacauauggagcuuguccuaaguacguuaagcagaauacccugaaacuugccacggguaugcgcaacgugccagaaaagcagacccgaggccuguuuggggcgauugcaggauucaucgagaauggcugggaagguaugaucgacgggugguauggcuuuagacaccaaaacagugagggaacaggccaggccgcugauuugaaaagcacucaggccgcaauugaccaaaucaaugggaagcucaacaggguaauugagaaaaccaaugaaaaguuccaccagauagagaaagaguucuccgaaguggaaggacggauccaggaucuggagaaguacgucgaggacacaaagauugauuuauggucuuauaacgcugaacugcucguggcccuugagaaccagcauacuaucgaccugaccgauagcgaaaugaauaaauuguuugagaagacacgucgccaacuaagagaaaacgcggaggacauggguaauggcugcuucaggaucuaccacaaaugugauaacgccugcauugggucaauacggaauggaaccuaugaccaugacguuuaccgagaugaggcacugaacaaucgcuuucagaucaagggcguggaacucaaaagugguuacaaggacuggauucuguggaucuccuucgcuauuagcugcuuucuucugugugucguguugcucggguucaucaugugggccugccagaagggcaacauaagauguaauaucugcauuuga

SEQ ID NO: 122902 - RNA, 1701 nt, Artificial Sequence; identical to SEQ ID NO: 122846
  derived and/or modified sequence opt3 from hemagglutinin__InfluenzaA__ABE12645

SEQ ID NO: 122903 - RNA, 1701 nt, Artificial Sequence; identical to SEQ ID NO: 122823
  derived and/or modified sequence opt3 from hemagglutinin__InfluenzaA__ABE13076

SEQ ID NO: 122904 - RNA, 1701 nt, Artificial Sequence; identical to SEQ ID NO: 122799
  derived and/or modified sequence opt3 from hemagglutinin__InfluenzaA__ABE13323

SEQ ID NO: 122905 - RNA, 1701 nt, Artificial Sequence
  derived and/or modified sequence opt3 from hemagglutinin__InfluenzaA__ABE13471
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaaaauucuucaacagguagaaucugcgacaguccacacaggauucucgauggcaaaaacuguacccugaucgacgcucuacugggggauccgcauugcgacggauuucagaauaaggagugggauuuguucguggaacggagcaaagccuauuccaacuguuaccccuaugacgucccugauuacgcaucucuccgcucgcugguggccucaagcggcacucuggaguuuuauaaugaaaguuucaacuggacagguguugcucagaaugggaccuccuacgcaugcaagcgacguucugugaaguccuuuuucuccagacucaacugguuacacaaacuggaguauaaguacccagcccuuaaugucacgaugcccaacaaugacaaauuugauaaguuguacauauggggagugcaucacccuucaacugacagugaucagaccagccuguauguacaggcuucuggcaggguuacaguguccacuaaacggucacagcagaccgucaucccaaacauuggcagccgccccugggugagaggggugaguucuaggaucuccauuuacuggacaaucgucaagccuggagacauacuacucauuaacagcaccgguaaucugaucgccccacggggcuauuucaagauucgcucggggaaaucuuccaucaugcgaucagacgcgccgaucggaaacuguaauagugagugcauuacgcccaacggcagcauaccuaaugauaagccauuucaaaacguuaauagaaucacuuacggugcaugucccagguaugugaaacagaacacacuuaagcuggccaccgggaugcggaauguaccugaaaaacagacucguggaauuuucggcgcuaucgccggcuuuauagagaacgggugggaaggaaugguggacgguugguacggcuuccgccaccagaauagcgaggggacaggacaagcagcugauuugaagucuacccaggccgcgauuaaccagaucaauggcaaacucaacagacugaucgagaagacgaaugaaaaguuucaucaaauugagaaagaguucagcgaagucgaagguaggauccaggacuuagagaaguauguggaggauaccaaaauugaccuguggucauacaacgccgaacuccuuguugcacuggagaaccagcacacaauagauuugacugacagugaaaugaauaagcuauucgagcggacccgaaaacagcugcgcgaaaacgcugaggauauggggaauggcugcuuuagaaucuaccauaagugugacaacgccugcauuggauccaucaggaauggcacauaugaucacgacguguaccgggacgaggcucucaacaaucgcuuccaaaucaagggggucgaacugaaaagcggauauaaggauuggauucuuuggauaucuuuugccaucucaugcuuccuguugugugugguacuccuggguuuuauuaugugggcaugccagaaaggcaacaucagauguaauauuugcaucuga

SEQ ID NO: 122906 - RNA, 1701 nt, Artificial Sequence
  derived and/or modified sequence opt3 from hemagglutinin__InfluenzaA__ABE13555
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaggguucuucaacaggcagaaucugcgacaguccacacaggauucucgaugggaaaaauuguacccugaucgacgcucuacugggagauccgcauugcgacggcuuucagaacaaggagugggauuuguucguggaacggagcaaagccuauuccaauuguuaccccuaugacgucccugauuacgcaucucuccgcucgcugguggccucaagcgguacucuggaguuuaacaaugaaaguuucaacuggacagggguugcucagaauggaaccuccuaugcaugcaagcgacguucugucaagagcuuuuucuccagacucaacugguuacacaaacuggaguacaaguauccagcccuuaaugugacgaugcccaacaaugacaaauuugauaaguuguacauauggggcgugcaucacccuucaacugacagugaucaaaccagccuguacguacaggcuucuggcaggguuacaguguccacuaaacggucacagcagaccgucaucccaaacauugggagccgccccugggugagaggagugaguucuaggaucuccauuuauuggacaaucgucaagccuggugacauacuacucauuagcucgaccggcaaccugaucgccccacggggguacuucaagauucgcucuggaaaauccucaaucaugcgaagugacgcgccgaucgauaauuguaacagcgagugcauuacgcccaauggcuccauaccuaacgacaagccauuucaaaauguuaacagaaucacuuauggugcaugucccagguacgugaaacagaauacacuuaagcuggccaccgggaugcggaacguaccugaaaaacagacuaagggaauuuucggcgcuaucgccggcuuuauagagaaugggugggaaggaaugguggaugguugguauggcuuccgucaccagaacucugaggggacaggacaagcagcugacuugaaaagcacccaggccgcgauuaaucagaucaacggcaagcucaaucgccugaucgagaagacgaacgaaaaauuucaucaaauugagaaggaguucucagaagucgaagguagaauccaggauuuagagaaauacguggaggacaccaagauugaucuguggaguuauaaugccgaacuccuuguugcacuggagaaccagcacacaauagacuugacugauuccgaaaugaacaaacuauucgagaggacccggaagcagcugcgagaaaaugcugaggacauggggaacggcugcuuuaagaucuaccauaaaugugauaaugccugcauuggaagcauccgcaacggcacauacgaccacgacguguauagagaugaggcucucaauaacagguuccaaaucaagggggucgaacugaaaucuggauacaaggacuggauucuuuggauaucauuugccaugaguugcuuccuguugugugugguacuccuggguuuuaucaugugggcaugccagaaaggcaauauucgguguaacaucugcauuuga

SEQ ID NO: 122907 - RNA, 1701 nt, Artificial Sequence
  derived and/or modified sequence opt3 from hemagglutinin__InfluenzaA__ABE13606
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaaaugguacagucuucaaguacagguagaaucugcgacagcccacacaggauucuagauggcaaaaauuguacccucaucgacgcucugcuuggggauccgcauugcgacggauuucagaacaaggagugggaucuguucguggaacgguccaaagccuauucuaauuguuaccccuaugacgucccugauuacgcaucguugcgcucacucguggccagcaguggcacucuggaguuuacaaacgaagguuucaauuggaccgggguugcucaggacggaacguccuaugcaugcaagcgaggcucugugaaguccuuuuucucccgucugaacuggcuccacaaauuagaguacaaguauccagcccugaaugucacuaugcccaacaaugauaaauuugacaaguuguacauauggggcgugcaucacccuucaaccgauagugaccaaacaagccuuuacguacaggcuucugggagaguuacuguguccaccaaaaggucacagcagacagucaucccaaacauuggaagccggcccugggugcgcggugugaguucuagaaucuccauuuauuggaccaucgucaagccuggcgacauacugcuaauuaauagcacggggaaccucaucgccccaaggggauacuucaagauucggucgggcaaaucuuccaucaugcgcucagaugcgccgaucgguaacuguaauagugagugcauuacucccaacgggagcauaccuaaugacaagccauuucaaaacguuaaucgaaucacauauggagcaugucccagauacgugaaacagaacacccugaaacuugccacuggcaugaggaauguaccugaaaagcagacacggggcauuuucggggcuaucgccggauuuauagagaacgguugggaaggcaugguggaugggugguauggauuccgucaccagaauagcgagggcaccggucaagcagcugaccugaagucuacgcaggccgcgauuaaccagaucaaugggaaauugaaccgccucaucgagaagaccaaugaaaaguuucaucaaauugagaaagaguucagcgaagucgaaggcagaauccaggaucuggagaaguacguggaggacacaaaaauugauuuauggucauauaacgccgaacugcucauagcacuugagaaucagcacacuaucgaccugaccgauagugaaaugaacaaguuguucgagaggacacggaaacagcuacgagaaaacgcugaggacaugggaaauggcugcuuuaagauuuaccauaagugugauaacgccugcaucggguccauccgcaauggaacuuacgaccacgacguuuauagagaugaggcucugaacaauagguuccaaauuaaagguguggaacucaagagcggcuacaaagacuggauacuguggaucucuuuugccauuucaugcuuccuucugugugucguguugcucggguuuaucaugugggcaugccagaagggaaacauucgguguaauaucugcauauga

SEQ ID NO: 122908 - RNA, 1701 nt, Artificial Sequence
  derived and/or modified sequence opt3 from hemagglutinin__InfluenzaA__ABE13628
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaaaguccuaugcaugcaagcgaggcucugugaacagcuuuuucucccgucucaauugguuacacaaacuggaguacaaguauccagcccuuaacgucacgaugcccaauaacgauaaauuugacaaguuguacauauggggcgugcaucacccuucaacugauagugaccaaaccagccuguacguacaggcuucugggagaguuacaguguccacuaaaaggucacagcagaccgucaucccaaauauuggaagccggcccugggugcgcgguaucaguucuagaauuuccaucuauuggacaauagugaagccuggcgacauucuacucaucaacagcaccgggaaccugauugccccaaggggauacuucaagauccggaauggcaaaucgucuaucaugcgcuccgaugcgccgauugacaacuguaauucagagugcauaacgcccaacgguaguaucccuaaugauaagccauuucaaaacgucaaucgaauuacuuauggggcaugucccagauacguuaaacagaacacacuuaagcuggccaccggaaugaggaaugugccugaaaaacagacucggggcaucuucggcgcuauagccggguuuauugagaacggaugggaagguaugguagacggcugguauggguuccgucaccagaauagcgagggaacaggccaagcagcugauuugaaguccacccaggccgcgaucgaccagaucaacgguaaacucaaucgccugauugagaagacgaacgaaaaguuucaucaaaucgagaaagaguucucugaaguggaagggaggauucaggauuuagagaaguacgucgaggacaccaaaauagaucuguggagcuauaaugccgaacuccuuguggcacuggagaaccagcacacaaucgacuugacugauucagaaaugaacaagcuauucgagagaacccggaaacagcugcgagaaaaugcugaggacaugggcaacggaugcuuuaagauuuaccauaagugugacaaugccugcaucggcaguauccgcaacgggacauacgaucacgacguuuauagagaugaggcucucaauaacagguuccaaauuaaaggaguggaacugaaguccgguuacaaagacuggauacuuuggaucagcuuugccauuucuugcuuccuguugugugucgugcuccugggcuuuaucaugugggcaugccagaaggggaauauucgguguaacaucugcauauga

SEQ ID NO: 122909 - RNA, 1701 nt, Artificial Sequence
  derived and/or modified sequence opt3 from hemagglutinin__InfluenzaA__ABE13824
augaagaccaucauugcccugagcuacauacucugccagguguucgcucaaaaacuucccggcaacgacaauuccacagcaacucuguguuuggggcaccaugccgucccuaacggaacguuaguuaagaccaucacaaaugaucagauugaggugacuaacgcgaccgaacugguacagucuucaaguacagguagaaucugcgacagcccacacaggauucuagauggcaaaaauuguacccucaucgacgcucugcuuggggauccgcauugcgacggauuucagaacaaggagugggaucuguucguggaacgguccaaagccuauucuaauuguuaccccuaugacgucccugauuacgcaucguugcgcucacucguggccagcaguggcacucuggaguuuacaaacgaagguuucaauuggaccgggguugcucaagacggaaaguccuaugcaugcaagcgaggcucugugaacagcuuuuucucccgucugaauuggcuccacaaauuagaguacaaguauccagcccugaacgucacgaugcccaauaacgauaaauuugacaaacuuuacauauggggcgugcaucacccuucaacugauagugaccagaccagcuuguacguacaggcuucugggagaguuacaguguccacuaagaggucacagcaaaccgucaucccaaauauuggaagccggcccugggugcgcgguaucaguucuagaauuuccaucuauuggacaauagugaagccuggcgacauucugcuaaucaacagcaccgggaaccucauugccccaaggggauacuucaagauccggaauggcaaaucgucuaucaugcgcuccgaugcgccgauugacaacuguaauucagagugcauaacgcccaacgguaguaucccuaaugauaagccauuucagaacgucaaucgaauuacuuauggggcaugucccagauacguuaaacagaacacacugaaacuugccaccggaaugaggaaugugccugaaaagcagacucggggcaucuucggcgcuauagccggguuuauugagaacggaugggaagguaugguagacggcugguauggguuccgucaccaaaauagcgagggaacaggccaggcagcugaucugaaguccacccaggccgcgaucgaccaaaucaacgguaaauugaaucgccucauugagaagacgaacgaaaaguuucaucagaucgagaaagaguucucugaaguggaagggaggauucaggaucuggagaaguacgucgaggacaccaaaauagauuuauggagcuauaaugccgaacugcucguggcacuugagaaccagcacacaaucgaccugacugauucagaaaugaacaaguuguucgagagaacccggaaacaacuacgagaaaaugcugaggacaugggcaacggaugcuuuaagauuuaccauaagugugacaaugccugcaucggcaguauccgcaacgggacauacgaucacgacguuuauagagaugaggcucugaauaacagguuccagauuaaaggaguggaacucaaguccgguuacaaagacuggauacuguggaucagcuuugccauuucuugcuuccuucugugugucguguugcucggcuuuaucaugugggcaugccagaaggggaauauucgguguaacaucugcauauga

SEQ ID NO: 122910 - RNA, 1701 nt, Artificial Sequence; identical to SEQ ID NO: 122909
  derived and/or modified sequence opt3 from hemagglutinin__InfluenzaA__ABE14019

SEQ ID NO: 122911 - RNA, 1701 nt, Artificial Sequence
  derived and/or modified sequence opt3 from hemagglutinin__InfluenzaA__ABE14030
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguaucgguagaauuugcgacagcccacacaggauccucgauggcaaaaauuguacacugauagacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacccuggaguuuacuaacgaagguuucaauuggacagggguugcucaggacggaaaguccuaugcaugcaagcgaggcucugugaacagcuuuuucucccgucucaauugguuacacaaacuggaguacaaguauccagcccuuaacgucaccaugcccaauaacgauaaauuugacaaguuguacaucuggggcgugcaucacccuucaacggauagugaccaaacuagccuguacguacaggcuucugggagaguuaccguguccacaaaaaggucacagcagacugucauuccaaauaucggaagccggcccugggugcgcgguauuaguucuagaaucuccauauauuggaccauugugaagccuggcgacauccuacucauuaacagcacagggaaccugaucgccccaaggggauacuucaagauccggaauggcaaaucgucuauuaugcgcuccgaugcgccgauagacaacuguaauucagagugcaucacccccaacgguaguauuccuaaugauaagccauuucaaaacgucaaucgaaucacguauggggcaugucccagauacguuaaacagaacacucuuaagcuggccacaggaaugaggaaugugccugaaaaacagacccggggcauauucggcgcuauugccggguuuaucgagaacggaugggaagguaugguagacggcugguauggguuccgucaccagaauagcgagggaacuggccaagcagcugauuugaaguccacacaggccgcgaucgaccagauuaacgguaaacucaaucgccugaucgagaagaccaacgaaaaguuucaucaaauugagaaagaguucucugaaguggaagggagaauacaggauuuagagaaguacgucgaggacacgaaaaucgaucuguggagcuauaaugccgaacuccuuguggcacuggagaaccagcacaccauugacuugacagauucagaaaugaacaagcuauucgagaggacucggaaacagcugcgagaaaaugcugaggacaugggcaacggaugcuuuaagaucuaccauaagugugacaaugccugcaucggcaguauucgcaacgggaccuacgaucacgacguuuauagagaugaggcucucaauaacagguuccaaauaaaaggaguggaacugaaguccgguuacaaagacuggauccuuuggauuagcuuugccaucucuugcuuccuguugugugucgugcuccugggcuuuauuaugugggcaugccagaaggggaauauccgguguaacauaugcaucuga

SEQ ID NO: 122912 - RNA, 1701 nt, Artificial Sequence; identical to SEQ ID NO: 122908
  derived and/or modified sequence opt3 from hemagglutinin__InfluenzaA__ABE14041

SEQ ID NO: 122913 - RNA, 1701 nt, Artificial Sequence; identical to SEQ ID NO: 122909
  derived and/or modified sequence opt3 from hemagglutinin__InfluenzaA__ABE14063

SEQ ID NO: 122914 - RNA, 1701 nt, Artificial Sequence
  derived and/or modified sequence opt3 from hemagglutinin__InfluenzaA__ABE14124
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaacguccuaugcaugcaagcgaggcucugugaaguccuuuuucucccgucucaacugguuacacaaacuggaguacaaguauccagcccuuaaugucacuaugcccaacaaugauaaauuugacaaguuguacauauggggcgugcaucacccuucaaccgauagugaccaaacaagccuguacguacaggcuucugggagaguuacuguguccaccaaaaggucacagcagacagucaucccaaacauuggaagccggcccugggugcgcggugugaguucuagaaucuccauuuauuggaccaucgucaagccuggcgacauacuacucauuaauagcacggggaaccugaucgccccaaggggauacuucaagauucggucgggcaaaucuuccaucaugcgcucagaugcgccgaucgguaacuguaauagugagugcauuacucccaacgggagcauaccuaaugacaagccauuucaaaacguuaaucgaaucacauauggagcaugucccagauacgugaaacagaacacccuuaagcuggccacuggcaugaggaauguaccugaaaaacagacacggggcauuuucggggcuaucgccggauuuauagagaacgguugggaaggcaugguggaugggugguauggauuccgucaccagaauagcgagggcaccggucaagcagcugacuugaagucuacgcaggccgcgauuaaccagaucaaugggaaacucaaccgccugaucgagaagaccaaugaaaaguuucaucaaauugagaaagaguucagcgaagucgaaggcagaauccaggauuuagagaaguacguggaggacacaaaaauugaucuguggucauauaacgccgaacuccuuauagcacuggagaaucagcacacuaucgacuugaccgauagugaaaugaacaagcuauucgagaggacacggaaacagcugcgagaaaacgcugaggacaugggaaauggcugcuuuaagauuuaccauaagugugauaacgccugcaucggguccauccgcaauggaacuuacgaccacgacguuuauagagaugaggcucucaacaauagguuccaaauuaaagguguggaacuuaagagcggcuacaaagacuggauacuuuggaucucuuuugccauuucaugcuuccuguugugugucgugcuccugggguuuaucaugugggcaugccagaagggaaacauucgguguaauaucugcauauga

SEQ ID NO: 122915 - RNA, 1701 nt, Artificial Sequence
  derived and/or modified sequence opt3 from hemagglutinin__InfluenzaA__ABE14464
augaagaccaucauugcccugagcuacauacucugccagguguucgcucaaaaacuucccggcaacgacaauuccacagcaacucuguguuuggggcaccaugccgucccuaacggaacguuaguuaagaccaucacaaaugaucagauugaggugacuaacgcgaccgaacugguacagucuucaaguacagguagaaucugcgacagcccacacaggauucuagauggcaaaaauuguacccucaucgacgcucugcuuggggauccgcauugcgacggauuucagaacaaggagugggaucuguucguggaacgguccaaagccuauucuaauuguuaccccuaugacgucccugauuacgcaucguugcgcucacucguggccagcaguggcacucuggaguuuacaaacgaagguuucaauuggaccgggguugcucaagacggaaaguccuaugcaugcaagcgaggcucugugaacagcuuuuucucccgucugaauuggcuccacaaauuagaguacaaguauccagcccugaacgucacgaugcccaauaacgauaaauuugacaaacuuuacauauggggcgugcaucacccuucaacugauagugaccagaccagcuuguacguacaggcuucugggagaguuacaguguccacuaagaggucacagcaaaccgucaucccaaauauuggaagccggcccugggugcgcgguaucaguucuagaauuuccaucuauuggacaauagugaagccuggcgacauucugcuaaucaacagcaccgggaaccucauugccccaaggggauacuucaagauccggaauggcaaaucgucuaucaugcgcuccgaugcgccgauugacaacuguaauucagagugcauaacgcccaacgguaguaucccuaaugauaagccauuucagaacgucaaucgaauuacuuauggggcaugucccagauacguuaaacagaacacacugaaacuugccaccggaaugaggaaugugccugaaaagcagacucggggcaucuucggcgcuauagccggguuuauugagaacggaugggaagguaugaucgacggcugguauggguuccgucaccaaaauagcgagggaacaggccaggcagcugaucugaaguccacccaggccgcgaucgaccaaauuaacgguaaauugaaucgccucaucgagaagacgaacgaaaaguuucaucagauugagaaagaguucucugaaguagaagggagaauacaggaucuggagaaguacguggaggacaccaaaaucgauuuauggagcuauaaugccgaacugcucgucgcacuugagaaccagcacacaauugaccugacugauucagaaaugaacaaguuguucgagaggacccggaaacaacuacgagaaaaugcugaggacaugggcaacggaugcuuuaagaucuaccauaagugugacaaugccugcaucggcaguauucgcaacgggacauacgaucacgacguguauagagaugaggcucugaauaacagguuccagauaaaaggaguugaacucaaguccgguuacaaagacuggauccuguggauuagcuuugccaucucuugcuuccuucuguguguggucuugcucggcuuuauuaugugggcaugccagaaggggaauauccgguguaacauaugcaucuga

SEQ ID NO: 122916 - RNA, 1701 nt, Artificial Sequence
  derived and/or modified sequence opt3 from hemagglutinin__InfluenzaA__ABE14840
augaagaccaucauugcccugagcuacauacucugccuuguguucgcucagaaacugcccagaaacgacaauuccacagcaacuuuguguuuaggccaccaugccgucccuaacgggacgcugguuaagaccaucacaaaugaucaaauugaggugacuaacgcgaccgagcuaguacagucuucaaguacaggaaggaucugcgacagcccacaccggauucucgaugguaaaaauuguacccugaucgacgcucugcugggcgauccgcauugcgacggguuucagaacaaggaaugggauuuguucguggaacgcuccaaagccuauucuaauuguuaccccuaugacgucccugauuacgcaucgcuccgaucacugguggccagcaguggaacucuggaguuuacaaacgaaggcuucaauuggaccgguguugcucaggacgggaaguccuaugcaugcaagcguggaucugugaacagcuuuuucuccagacucaauugguuacacaaacuggaguacaaguauccagcccuuaacgucacgaugcccaauaacgauaaauuugacaaguuguacauauggggcgugcaucacccuucaacugauagugaccaaaccagccuguacguacaggcuucuggcaggguuacaguguccacuaaacggucacagcagaccgucaucccaaauauugggagccgccccugggugagaggaaucaguucuaggauuuccaucuauuggacaauagugaagccuggugacauucuacucaucagcucgaccggcaaccugauugccccacggggguacuucaagauccgcaacggaaaaucuuccaucaugcgaucagaugcgccgauugacaauuguaacagugagugcauaacgcccaauggcagcaucccuaacgauaagccauuucaaaaugucaacagaauuacuuauggugcaugucccagguacguuaaacagaauacacuuaagcuggccaccgggaugcggaacgugccugaaaaacagacucguggaaucuucggcgcuauagccggcuuuauugagaaugggugggaaggaaugguagacgguugguauggcuuccgccaccagaacuccgaggggacaggacaagcagcugauuugaagucuacccaggccgcgaucgaccagaucaauggcaaacucaacagacugauugagaagacgaaugaaaaguuucaucaaaucgagaaagaguucagcgaaguggaagguaggauucaggauuuagagaaguacgucgaggacaccaaaauagaucuguggucauauaacgccgaacuccuuguggcacuggagaaucagcacacaaucgacuugacugauagugaaaugaacaagcuauucgagcggacccgaaaacagcugcgcgaaaacgcugaggacauggggaauggcugcuuuaagauuuaccauaagugugacaacgccugcaucggauccaucagaaauggcacauacgaucacgacguuuauagggaugaggcucucaacaaucgguuccaaauuaaagggguggaacuuaagagcggauacaaagacuggauacuuuggaucucuuuugccauuucaugcuuccuguugugugucgugcuccuggguuuuaucaugugggcaugccagaagggcaacauucgcuguaguaucugcauauga

SEQ ID NO: 122917 - RNA, 1701 nt, Artificial Sequence
  derived and/or modified sequence opt3 from hemagglutinin__InfluenzaA__ABE15578
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaaaguccuaugcaugcaagcgaggcucugugaacagcuuuuucucccgucucaauugguuacacaaacuggaguacaaguauccagcccuuaacgucacgaugcccaauaacgauaaauuugacaaguuguacauauggggcgugcaucacccuucaacugauagugaccaaaccagccuguacguacaggcuucugggagaguuacaguguccacuaaaaggucacagcagaccgucaucccaaauauuggaagccggcccugggugcgcgguaucaguucuagaauuuccaucuauuggacaauagugaagccuggcgacauucuacucaucaacagcaccgggaaccugauugccccaaggggauacuucaagauccggaauggcaaaucgucuaucaugcgcuccgaugcgccgauugacaacuguaauucagagugcauaacgcccaacgguaguaucccuaaugauaagccauuucaaaacgucaaucgaauuacuuauggggcaugucccagauacguuaaacagaacacacuuaagcuggccaccggaaugaggaaugugccugaaaaacagacucggggcaucuucggcgcuauagccggguuuauugagaacggaugggaagguaugguagacggcugguauggguuccgucaccagaauagcgagggaacaggccaagcagcugauuugaaguccacccaggccgcgaucgaccagaucaacgguaaacucaaucgccugauugagaagacgaacgaaaaguuucaucaaaucgagaaagaguucucugaaguggaagggaggauucaggauuuagagaaguacgucgaggacaccaaaauagaucuguggagcuauaaugccgaacuccuuguggcacuggagaaccagcacacaaucgacuugacugauucagaaaugaacaagcuauucgagagaacccggaaacagcugcgagaaaaugcugaggacaugggcaacggaugcuuuaagauuuaccauaagugugacaaugccugcaucggcaguauccgcaacgggacauacgaucacgacguuuauagagaugaggcucucaauaacagguuccaaauuaaaggaguggaacugaaguccgguuacaaagacuggauacuuuggaucagcuuugccauuucuugcuuccuguugugugucgugcuccugggcuuuaucaugugggcaugccagaaggggaauauucgguguucaaucugcauauga

SEQ ID NO: 122918 - RNA, 1701 nt, Artificial Sequence
  derived and/or modified sequence opt3 from hemagglutinin__InfluenzaA__ABE26991
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugagaaaaacggacuguaucccaaucuuagcaagucuuacgucaacaauaaagaaaaggaaguguugguacuguggggcguucaucacccuuccaacaucggcgaucagcgcgcaauuuaccacaccgagaacgccuaugugucagucgugagcagucauuacucucgacguuuuacaccagaaaucgcuaagagacccaaagugagggaccaggaggggcggauaaauuauuacuggacucuacucgagccuggagauaccaucauuuucgaagccaacgguaaucugaucgcgccaugguaugcauuugcccuuucccgcggcuucgggagcggaauuaucacaucgaacgcuucuaugggcgacugugaugccaagugccagaccccgcaaggugcaauaaauuccucacugcccuuucagaacguccacccuguuacgauuggggaguguccaaaauacgugagaaguacuaaguugaggaugguaacaggacuccggaauauccccagcauucagucccgcggccuguucggcgcuaucgccggguuuaucgaaggagguuggaccggcaugauugacgggugguauggauaccaucaccagaacgagcaaggcucugguuacgcggccgauaaaaagagcacucagaaugcaauagacgggaucacaaacaaaguaaauucagucauugaaaagaugaacacccaguucacggcugugggcaaggaguucaauaaauuagagcgaagaauggaaaaccugaauaagaaaguugaugacggauuucucgacaucuggaccuauaacgccgagcuucugguguugcuagaaaacgagaggacacuggauuuccacgacaguaaugucaagaaccucuacgaaaaagugaagaaucagcugaagaacaaugcuaaagagauaggcaacgggugcuuugaguucuaucauaaguguaauaacgaaugcauggaguccgugaaaaauggaacuuacgauuauccuaaguacagcgaagagucuacccuuaaacgggagaagauugacgguguuaagcuggaaucaaugggcguguaucaaaucuuggccaucuacaguacagucgcaagcucccucgugcuguuagucucucugggggccauuucguuuuggaugugcagcaacggaucccuacagugucguaucugcauuuga

SEQ ID NO: 122919 - RNA, 1701 nt, Artificial Sequence
  derived and/or modified sequence opt3 from hemagglutinin__InfluenzaA__ABF47550
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucuuaugcuugcaagcgaggcagcgugaacuccuucuuuucacgucugaauuggcuccacgagagugaguacaaguauccagcauuaaacgucacgaugcccaauaacggcaaauucgauaagcuguacaucuggggagugcaucacccuagcacugacagagaacaaaccaaucuuuacguaagggccucugggcggguuacaguguccacuaaacgcucacagcagaccgucauuccaaacaucgguagcagacccugggugaggggcuugaguucucggauuuccaucuauuggacaauagugaagccuggggauauucugcuaaucaacagcaccggaaaucucauugcuccacgcggcuacuuuaaaauccgaacggguaagucgucuaucaugagauccgacgccccgauugggacuuguucaagugagugcauaacacccaacggaagcaucccuaaugacaagccauuccagaacgucaauaaaauuaccuauggcgcgugucccagguacguuaagcaaaacacucugaaacuugcaacaggcaugcggaaugugccugaaaagcagacccgugggaucuuuggagccauagcugguuucauugagaacggcugggaggggaugguagauggaugguauggcuuucgccaccaaaauuccgaagguacggggcaggccgcagaccugaaaucuacccaggcugccaucgaucagaucaacggcaaguugaauagacucauugagaaaacaaacgaaaaguuccaucagaucgagaaggaguucagcgaaguggagggaaggauucaagaccuggaaaaauacgucgaggauacuaagauagacuuauggucauauaaugcggaacugcucguggcccuugagaaccagcacaccaucgaucugacagacagugaaaugaauaaauuguuugagaagacucggaaacagcuacgagagaacgcagaagauaugggcaacgggugcuucaagauuuaccauaagugugacaaugcuugcaucggauccauccgcaacgguaccuacgaucacgacguuuauagagacgaggcccugaauaacagguuucagauuaaaggcguggaacucaagagcggguacaaagauuggauacuguggaucucuuucgcuauuucaugcuuucuucugugugucguguugcucggauucaucaugugggccugccaaaagggcaauauucgguguaacaucugcauauga

SEQ ID NO: 122920 - RNA, 1698 nt, Artificial Sequence
  derived and/or modified sequence opt3 from hemagglutinin__InfluenzaA__ABF47561
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaagcugagcaugucuuacgugaauaacaaagagaaggaagugcuaguucucuggggagugcaucacccuccaaauaucggggaucagcgcgcccuguaccacacugagaacgcuuaugucuccguggugucaagccauuacagucgacguuucacccccgaaauagcaaaaagaccuaaggucagggaccaggagggucggaucaacuauuacuggacacuucuggaaccaggcgauacuauuaucuuugaggccaaugggaacuugauugcuccgugguaugccuucgcgcucucucgcggauuuggcuccgguaucauaaccagcaaugcacccaugggggagugugacgccaagugccagacaccucaaggagcuauuaacucgucucugccauuccagaauguucaccccgugaccaucggcgaauguccuaaauacguaagauccgccaaguuaaggauggugacgggccugcggaacauuccaucaauccagagucgcgggcucuuuggagcaaucgcugguuucauugagggcggguggacuggaauggucgauggcugguaugguuaccaucaccagaaugaacaagggagcggcuacgccgcggaccagaaauccacacagaacgccauaaauggaaucaccaacaagguaaauucuguuauugagaaaaugaacacucaguuuacagcagugggcaaggaguucaauaaacuugaacgaagaauggagaaccugaauaagaaggucgaugacggguucuuggauaucuggaccuauaacgcugaacuacuggugcuccuggagaacgaaaggacgcuugacuuucacgacagcaauguuaaaaaccuguacgagaagguaaaaucacaauugaagaauaacgccaaagaaauaggaaaugguugcuucgaguuuuaucauaaguguaacaaugagugcauggaaagugugaagaacggcaccuacgauuaucccaaauacuccgaggaaagcaagcucaaucgggagaaaauugacggggucaagcuggagucuaugggaguguaucagaucuuagcuaucuacucaacagucgccaguagccuggugcuacucguuucccugggcgcaauuucuuucuggaugugcucgaacgguagccuucagugucguaucugcauuuga

SEQ ID NO: 122921 - RNA, 1698 nt, Artificial Sequence
  derived and/or modified sequence opt3 from hemagglutinin__InfluenzaA__ABF47572
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggauaaagagguacuuguucucuggggagugcaucacccuccaaacaucggggaccagcgcgcccuguaccacacugaaaacgcuuaugucuccguggugucaagccauuacagucgacguuucacccccgagauagcaaagagaccuaaagucagggaucaggaaggucggaucaauuauuacuggacacuucuggagccaggcgacacuauuaucuuugaagccaacgggaauuugauugcuccgugguaugccuucgcgcucucucgcggauuuggcuccgguaucauaaccagcaacgcacccaugggggagugugaugccaagugccagacaccucaaggagcuauuaauucgucucugccauuccagaacguucaccccgugaccaucggcgaguguccuaaguacguaagauccgccaaauuaaggauggugacgggccugcggaauauuccaucaauccagagucgcgggcucuuuggagcaaucgcugguuucauugaaggcggguggacuggaauggucgacggcugguaugguuaccaucaccagaacgagcaagggagcggcuacgccgcggaucagaaguccacacagaaugccauaaacggaaucaccaauaaagugaacucuguuauugaaaagaugaauacucaguuuacagcagugggcaaagaguucaacaagcuagaacgaagaauggagaaucugaacaaaaaggucgacgauggguucuuggacaucuggaccuauaacgcugagcuacuggugcuccuggaaaaugagaggacgcuugacuuucacgauagcaacguaaagaaucuguacgaaaaaguuaagucacaauugaaaaacaaugccaaggagauaggaaacgguugcuucgaauuuuaucauaaauguaauaacgagugcauggagagugugaagaauggcaccuacgacuaucccaaguacuccgaagagagcaaacucaaccgggaaaagauugauggggucaaacuggagucuaugggaguguaucagaucuuagcuaucuacucaacagucgccaguagccuggugcuacucguuucccugggcgcaauuucuuucuggaugugcucgaaugguagccuucagugucguaucugcauuuga

SEQ ID NO: 122922 - RNA, 1698 nt, Artificial Sequence; identical to SEQ ID NO: 122816
  derived and/or modified sequence opt3 from hemagglutinin__InfluenzaA__ABF47583

SEQ ID NO: 122923 - RNA, 1701 nt, Artificial Sequence
  derived and/or modified sequence opt3 from hemagglutinin__InfluenzaA__ABF47594
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuaacaaugaauccuucaacuggacagguguugcucagaaugggaccucuuaugcaugcaagcgacguagcgugaaguccuuuuucucaagacucaacugguuacacaaacuggaguacaaguauccagcccaaaaugucacgaugcccaacaaugacaaauuugauaaacuuuacauauggggagugcaucacccuaguacugacagcgaucagaccucuuuguacguacaggcuuccggcaggguuacagugucaacuaagcggagccagcaaaccgucaucccaaacauuggcagucgccccugggugagaggggugucuuccaggaucagcauuuauuggacaaucgucaagccuggagacauacugcuaauuaacucgaccgguaaucucaucgccccacggggcuacuucaagauucgcucugggaaauccucaaucaugcgaagugacgcgccgaucggaaacuguaauagcgagugcauuacgcccaacggcuccauaccuaaugauaagccauuucagaacguuaauagaaucacuuauggugcaugucccagguacgugaaacagaacacacugaaacuugccaccgggaugcggaauguaccugaaaagcagacucguggaauuuucggcgcuaucgccggcuuuauagagaacgggugggaaggaaugguggacgguugguauggcuuccgccaccaaaauucugaggggacaggacaggcagcugaucuuaagagcacccaggccgcgauuaaccaaaucaauggcaaauugaacagacucaucgagaagacgaaugaaaaguuucaucagauugagaaagaguucucagaagucgaagguaggauccaggaccuggagaaguacguggaggauaccaaaauugacuuauggaguuauaacgccgaacugcucguugcacuugagaaccagcacacaauagaucugacugacuccgaaaugaauaaguuguucgagcggacccgaaaacaacuacgcgaaaacgcugaggauauggggaauggcugcuuuaagaucuaccauaagugugacaacgccugcauuggaagcaucagaaauggcacauacgaucacgacguguauagggacgaggcucugaacaaucgguuccagaucaaaggggucgaacucaagucuggauacaaagauuggauucuguggauaucauuugccaucaguugcuuccuucugugugugguauugcucgguuuuauuaugugggcaugccagaagggcaacauccgcuguaauauuugcaucuga

SEQ ID NO: 122924 - RNA, 1701 nt, Artificial Sequence
  derived and/or modified sequence opt3 from hemagglutinin__InfluenzaA__ABF47605
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugagaaaaacggacuguaucccaaucuuagcaagucuuacgucaacaauaaagaaaaggaaguguugguacuguggggcguucaucacccuuccaacaucggcgaucagcgcgcaauuuaccacaccgagaacgccuaugugucagucgugagcagucauuacucucgacguuuuacaccagaaaucgcuaagagacccaaagugagggaccaggaggggcggauaaauuauuacuggacucuacucgagccuggagauaccaucauuuucgaagccuccgguaaccugaucgcgccaugguaugcauuugcccuuagccgcggcuucgggucgggaauuaucacaucuaaugcuuccaugggcgagugugacgccaagugccagaccccgcaaggugcaauaaacucaagucugcccuuucagaauguccacccuguuacgauuggggaauguccaaaauacgugagaagcacuaaguugaggaugguaacaggacuccggaacauccccuccauucagucucgcggccuguucggcgcuaucgccggguuuaucgagggagguuggaccggcaugauugaugggugguauggauaccaucaccagaaugaacaaggcagcgguuacgcggccgacaaaaagucaacucagaacgcaauagaugggaucacaaauaaagugaacagugucauugagaagaugaauacccaguucacggcugugggcaaggaguucaacaaauuagaacgaagaaucgagaaucugaacaagaaaguugacgauggauuucucgacauauggaccuauaaugccgaacuucugguguugcuagagaacgaaaggacacuggacuuccacgauuccaacgucaagaaucucuacgagaaagugaagaaccagcugaagaauaacgcuaaagagauuggcaaugggugcuuugaguucuaucauaaguguaacaaugaaugcauggaaagcguuaaaaacggaacuuacgacuauccuaaguacucugaggagucaaaacuuaagcgggaaaagaucgaugguguaaaacuggagaguaugggcguguaucaaaucuuggccauuuacagcaccgucgcauccucucucgugcuguuagucucgcugggggccaucagcuuuuggaugugcuccaauggaucacuacagugucguauuugcauauga

SEQ ID NO: 122925 - RNA, 1701 nt, Artificial Sequence; identical to SEQ ID NO: 122909
  derived and/or modified sequence opt3 from hemagglutinin__InfluenzaA__ABF47616

SEQ ID NO: 122926 - RNA, 1701 nt, Artificial Sequence
  derived and/or modified sequence opt3 from hemagglutinin__InfluenzaA__ABF47627
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugagaaaaacggacuguaucccaaucuuagcaagucuuacgucaacaauaaagaaaaggaaguguugguacuguggggcguucaucacccuuccaacaucggcgaucagcgcgcaauuuaccacaccgagaacgccuaugugucagucgugagcagucauuacucucgacguuuuacaccagaaaucgcuaagagacccaaagugagggaccaggaggggcggauaaauuauuacuggacucuacucgagccuggagauaccaucauuuucgaagccaacgguaaucugaucgcgccaugguaugcauuugcccuuucccgcggcuucgggagcggaauuaucacaucgaacgcuucuaugggcgacugugaugccaagugccagaccccgcaaggugcaauaaauuccucacugcccuuucagaacguccacccuguuacgauuggggaguguccaaaauacgugagaaguacuaaguugaggaugguaacaggacuccggaauauccccagcauucagucccgcggccuguucggcgcuaucgccggguuuaucgaaggagguuggaccggcaugauugacgggugguauggauaccaucaccagaacgagcaaggcucugguuacgcggccgauaaaaagagcacucagaaugcaauagacgggaucacaaacaaaguaaauucagucauugaaaagaugaacacccaguucacggcugugggcaaggaguucaauaaauuagagcgaagaauggaaaaccugaauaagaaaguugaugacggauuucucgacaucuggaccuauaacgccgagcuucugguguugcuagaaaacgagaggacacuggauuuccacgacaguaaugucaagaaccucuacgaaaaagugaagaaucagcugaagaacaaugcuaaagagauaggcaacgggugcuuugaguucuaucauaaguguaauaacgaaugcauggaguccgugaaaaauggaacuuacgauuauccuaaguacagcgaagagucuaaacuuaagcgggagaagauugacgguguuaaacuggaaucaaugggcguguaucaaaucuuggccaucuacaguaccgucgcaagcucccucgugcuguuagucucucugggggccauuucguuuuggaugugcagcaacggaucccuacagugucguaucugcauuuga

SEQ ID NO: 122927 - RNA, 1701 nt, Artificial Sequence
  derived and/or modified sequence opt3 from hemagglutinin__InfluenzaA__ABF47638
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugaaaagaacggacuguaucccaaucuuagcaagucuuacgucaacaauaaagagaaggaaguguugguacuguggggcguucaucacccuuccaacaucggcgaucagcgcgcaauuuaccacaccgagaacgccuaugugucagucgugagcagucauuacucucgacguuuuacaccagaaaucacuaagagacccaaagugagggaccaggaggggcggauaaauuauuacuggacccuacucgagccuggagauacaaucauuuucgaagcuaacgguaaucugaucgccccaugguaugcguuugcacuuucccgcggcuucgggagcggaauuaucaccucgaacgccucuaugggcgagugugacgcuaagugccagacgccgcaaggugccauaaauuccucacugcccuuucagaacguccacccuguuacuauuggggaauguccaaaauacgugagaaguacaaaguugaggaugguaaccggacuccggaauauccccagcauucagucccgcggccuguucggcgcaaucgcuggguuuaucgagggagguuggacuggcaugauugaugggugguauggauaccaucaccagaacgaacaaggcucugguuacgccgcggaccagaaaagcacacagaaugccauagaugggaucaccaacaaggucaauucagugauugagaaaaugaacacgcaguucaccgcagugggcaaggaguucaauaaguuagaacgaagaauggagaaccugaauaaaaagguugacgauggauuucucgacaucuggacauauaacgcugaacuucugguguugcuagagaacgaaaggacucuggacuuccacgauaguaaugucaaaaaccucuacgagaaggugaaaacccaacugaagaauaacgccaaggagauaggcaaugggugcuuugaguucuaucauaaauguaacaaugaaugcauggaauccguaaagaacggaacauacgacuauccuaaauacagcgaggagucuaaacuuaaucgggagaaaauugaugguguuaagcuggaaucaaugggcguguaucagaucuuggcuaucuacaguacugucgccagcucccucgugcuguuagucucucugggggcaauuucguuuuggaugugcagcaacggaucccuacagugucguaucugcauuuga

SEQ ID NO: 122928 - RNA, 1701 nt, Artificial Sequence; identical to SEQ ID NO: 122927
  derived and/or modified sequence opt3 from hemagglutinin__InfluenzaA__ABF47649

SEQ ID NO: 122929 - RNA, 1701 nt, Artificial Sequence
  derived and/or modified sequence opt3 from hemagglutinin__InfluenzaA__ABF47660
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugagaaaaacggacuguaucccaaucuuagcaagucuuacgucaacaauaaagaaaaggaaguguugguacuguggggcauccaucacccuuccaacauuggcgaucagcgcgcaaucuaccacaccgagaacgccuauguuucaguggucagcagucauuacucucgacguuuuacaccagaaauagcuaagagacccaaagugagggaccaggaggggcggaucaauuauuacuggacucuacucgagccuggagauaccauuaucuucgaagccaacgguaaucugauugcgccaugguaugcauuugcccuuucccgcggcuucgggagcggaaucauaacaucgaacgcuucuaugggcgacugugaugccaagugccagaccccgcaaggugcaauuaauuccucacugcccuuucagaacgugcacccugucacgaucggggaguguccaaaauacguuagaaguacuaaguugaggauggugacaggacuccggaauauucccagcauccagucccgcggccuguucggcgcuaucgccggguuuauugaaggagguuggaccggcaugauagacgggugguauggauaccaucaccagaacgagcaaggcucugguuacgcggccgauaaaaagagcacucagaaugcaaucgacgggauuacaaacaaaguaaauucagugaucgaaaagaugaacacccaguucacggcugucggcaaggaguucaauaaauuagagcgaagaauggaaaaccugaauaagaaaguggaugacggauuucucgacauauggaccuauaacgccgagcuucugguuuugcuagaaaacgagaggacacuggauuuccacgacaguaaugugaagaaccucuacgaaaaagucaagacucagcugaagaauaacgcuaaagagauuggcaaugggugcuuugaguucuaucauaaguguaacaaugaaugcauggaguccgugaaaaacggaaccuacgauuauccuaaguacagcgaagagucuaaacuuaagcgggagaagaucgacgguguaaaacuggaaucaaugggcguuuaucaaaucuuggccauuuacaguacaguggcaagcucccucguccuguuagugucucugggggccaucucguuuuggaugugcagcaauggaucccuacagugucguauuugcauauga

SEQ ID NO: 122930 - RNA, 1698 nt, Artificial Sequence
  derived and/or modified sequence opt3 from hemagglutinin__InfluenzaA__ABF47671
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuucgucuccguggugucaagccauuauagucgacguuuuacccccgaaauagcaaagagaccuaaagucagggaccaggagggucggaucaauuacuauuggacacuucuggaaccaggcgauacuauuaucuucgaggccaacgggaauuugauugcuccgugguacgccuuugcgcucucucgcggauucggcuccgguaucauaaccagcaacgcacccauggacgagugugaugccaagugccagacaccucaaggggcuauuaauucgucucugccauuucagaacguucaccccgugaccaucggagaauguccuaaguauguaagauccgccaaauuaaggauggugacgggccugcggaauauuccaucaauccagagucgcggccucuucggggcaaucgcuggauuuauugaggguggcuggacugggauggucgacggaugguacggcuaucaucaccagaacgaacaagguagcggguacgccgcggaucagaaguccacacagaaugccauaaacggcaucaccaauaaagugaacucuguuauugagaagaugaauacucaguucacagcagugggaaaagaguucaacaagcuagaacgaagaauggagaaucugaacaaaaaggucgacgauggcuuuuuggacaucuggaccuacaacgcugaacuacuggugcuccuggagaaugaaaggacgcuugacuuccacgauagcaacguaaagaaucuguaugagaaaguuaagucacaauugaaaaacaaugccaaggaaauagggaacggaugcuuugaguucuaccauaaauguaauaacgagugcauggaaagugugaagaaugguaccuaugacuaccccaaguauuccgaggaaagcaaacucaaccgggagaagauugauggcgucaaacuggagucuauggggguguaccagaucuuagcuaucuauucaacagucgccaguagccuggugcuacucguuucccugggagcaauuucuuuuuggaugugcucgaauggcagccuucagugucguaucugcauuuga

SEQ ID NO: 122931 - RNA, 1701 nt, Artificial Sequence
  derived and/or modified sequence opt3 from hemagglutinin__InfluenzaA__ABF47693
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaauaucgccggcuggauuuuggggaacccugagugcgaaagucucuucagcaagaaguccuggucuuauaucgcagagaccccaaauucggaaaacggaacauguuacccgggcuauuuugccgauuacgaggagcugagggaacaacugucaagcgucaguuccuucgagcgguuugaaauuuuccccaaagagcgcucuuggccuaagcauaaugugacccgagguguuacugcuagcugcucccacaaagggaagucaaguuuuuaucguaaccucuuauggcugacagagaaaaauggaagcuacccaaaccuuucuaaguccuaugugaauaacaaggaaaaagaggucuuggugcuguggggcguacaucaccccucaaauaucgaagaccagaagaccauauacagaaaagagaacgcauacguuagcguggucaguucuaacuauaauaggcgguucacgccugaaaucgccgagcgcccaaaggugagaggccaggcugggaggauuaacuacuauuggacucuacucgagcccggagauaccaucauuuuugaagccaaugguaaccugaucgcgccuuggcacgcauucgcccuuaaucggggcuuuggguccggaauaauuacaagcaacgcuucgauggacgagugugauacuaaaugccagaccccacaaggcgccaucaauucuucccugccguuccagaacauucaucccgugacaaucggugaauguccuaaguacguccgcucaaccaaauugcgaaugguuacggggcucagaaauaucccaaguauucagagcaggggacuguuuggcgcaauagcuggcuucaucgaagggggauggacugguaugauugacggcugguauggguaccaccaucagaacgagcaaggauccggcuaugccgcggaucagaagucuacacagaaugccaucaacgguauaaccaauaaggugaacagcguaauugagaaaaugaauacucaguuuacagcaguggggaaggaguucaacaaauuagaaaagcggauggagaaccugaauaaaaaggucgacgauggcuuccucgacaucuggaccuacaacgcugaacuucugguguugcuagagaaugaacguacgcuggacuuucacgauucaaacguuaagaaucucuacgagaaagugaagagucaacugaaaaacaaugccaaggagaucggaaacggcugcuucgaauuuuaucacaaauguaauaacgagugcauggaauccgucaagaaugggaccuacgacuaucccaaguacagcgaggagucuaaacuuaaccgcgaaaagauugauggagugaaacuggagucaauggguguauaucagaucuuggcuauuuacaguacaguugccagcucccucgugcuguuagucucucugggcgcaauaucguucuggaugugcagcaaugggucccuacaguguagaaucugcauuuga

SEQ ID NO: 122932 - RNA, 1701 nt, Artificial Sequence; identical to SEQ ID NO: 122931
  derived and/or modified sequence opt3 from hemagglutinin__InfluenzaA__ABF47704

SEQ ID NO: 122933 - RNA, 1701 nt, Artificial Sequence
  derived and/or modified sequence opt3 from hemagglutinin__InfluenzaA__ABF47715
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcauaacgugacccgagguguuacugcuuccugcucacacaaagggaagaguagcuuuuaucguaaucucuuauggcugacagagaaaaacggaucuuacccaaaucuuuccaagucauaugugaacaauaaggaaaaagaggucuuggugcuguggggcguacaucaccccagcaacaucgaagaccagaagaccauauacagaaaagagaaugcauacguuaguguggucucuuccaacuauaacaggcgguucacgccugaaaucgccgagcgcccaaaggugagaggccaggcugggaggauuaauuacuauuggacucuacucgagcccggagauaccaucauuuuugaagccaacgguaaucugaucgcgccuuggcacgcauucgcccuuaaccggggcuuugggagcggaauaauuacaucgaaugcuucuauggacgagugugauacuaaaugccagaccccacaaggcgccaucaacuccucacugccguuccagaauauucaucccgugacaaucggugaauguccuaaguacguccgcaguaccaaauugcgaaugguuacggggcucagaaacaucccaagcauucaguccaggggacuguuuggcgcaauagcuggcuucaucgaagggggauggacugguaugauugacggcugguauggguaccaccaucagaaugagcaaggaucuggcuaugccgcggaucaaaagagcacacagaacgccaucaaugguauaaccaacaaggugaauagcguaauugagaaaaugaacacucaguuuacagcaguggggaaggaguucaauaaauuagaaaagcggauggagaaccugaacaaaaaggucgacgauggcuuccucgacaucuggaccuacaaugcugaacuucugguguugcuagagaacgaacguacgcuggacuuucacgauaguaauguuaagaaccucuacgagaaagugaagucccagcugaaaaauaacgccaaggagaucggaaauggcugcuucgaauuuuaucacaaauguaacaaugagugcauggaaagcgucaagaacgggaccuacgacuaucccaaguacucugaggagucaaaacuuaaucgcgaaaagauugauggagugaaacuggagaguauggguguauaucagaucuuggcuauuuacagcacaguugccuccucucucgugcuguuagucucgcugggcgcaauaucauucuggaugugcuccaacgggucacuacaguguagaaucugcauuuga

SEQ ID NO: 122934 - RNA, 1701 nt, Artificial Sequence; identical to SEQ ID NO: 122931
  derived and/or modified sequence opt3 from hemagglutinin__InfluenzaA__ABF47726

SEQ ID NO: 122935 - RNA, 1701 nt, Artificial Sequence; identical to SEQ ID NO: 122931
  derived and/or modified sequence opt3 from hemagglutinin__InfluenzaA__ABF47737

SEQ ID NO: 122936 - RNA, 1701 nt, Artificial Sequence
  derived and/or modified sequence opt3 from hemagglutinin__InfluenzaA__ABF47748
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagagcuccuggccuaagcauaacgugacccgcgguguuacugcuucaugcagucacaaagggaaaagcucuuuuuaucgaaaucucuuauggcugacagagaaaaacggauccuacccaaaucuuucaaagagcuaugugaacaauaaggaaaaagaggucuuggugcuguggggcguacaucaccccaguaacaucgaagaccagaagaccauauaccguaaagagaaugcauacguuucuguggucuccagccacuauaacagaagguucacgccugaaaucgccaagcggccaaaagugcgcgaucaggagggcagaauuaacuacuauuggacucuacucgagcccggggacaccaucauuuuugaagcuaauggaaaccugaucgccccuugguacgcguucgcacuuucgagggguuuuggcucugggauaauuacauccaaugccucaauggaugagugugacgcuaagugccagacuccacaaggagccaucaacaguagccugccguuccagaaugugcaucccgucaccauuggcgaauguccuaaauauguucgguccacaaaguugcgcauggugaccggucuccgaaacaucccaucuauccagagcagagggcuguuuggagcaauugcuggcuucauagagggcggguggacgggaaugaucgaugguugguacggcuaucaccaucagaaugaacaagggucaggauacgccgcggaccagaagaguacucagaacgccauuaauggcaucacaaacaaaguaaauuccgugauagagaagaugaacacccaguuuacugcagucgguaaagaguucaauaaguuagaaaagaggauggagaaccugaauaagaagguggaugacggguuccucgacauuuggacauacaacgcugaacuucugguuuugcuagagaacgaacggacccuggauuuucacgacagcaaugugaaaaaccucuaugagaaggucaaaucucaacugaagaauaacgccaaagagaucggcaauggaugcuucgaauuuuaccacaaguguaacaaugagugcauggaaucagugaagaacggcacguaugauuaccccaaauauagugaggagagcaaacuuaaucgugaaaagaucgacgggguaaagcuggaguccaugggaguuuaccagauuuuggcuaucuauucuaccguggccucgagccucguccuguuagugucccugggugcaauuucauucuggaugugcaguaacggcucucuacagugucgcauaugcaucuga

SEQ ID NO: 122937 - RNA, 1701 nt, Artificial Sequence
  derived and/or modified sequence opt3 from hemagglutinin__InfluenzaA__ABF47770
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacaaccacaaugggaaacucugcaagcugaaaggaauagcuccccuucagcuggguaaguguucaaucgccggcuggauuuuggggaacccugagugcgaaagucucuucagcaagaaauccuggucuuauaucgcagagaccccaaauucggaaaacggaacauguuacccgggcuauuuugccgauuacgaggagcugagagaacaacugucaagcgucaguuccuucgagagguuugaaauuuuccccaaggagucuagcuggccuaaacauaaugugaccaaggguguuacugcuuccugcucacacaaagggaagaguagcuuuuaucggaaccucuuauggcugacagagaagaauggaucuuacccaaaccuuuccaaaucauaugugaauaacaaggaaaaagaggucuuggugcuguggggcguacaucaccccagcaauaucgaagaccagaagaccauauaccgcaaagagaacgcauacguuaguguggucucuucccacuauaaccgacguuucacgccugaaaucgccaagagaccaaaagugaggaaucaggagggccggauuaacuacuauuggacucuacucgagcccggggauaccaucauuuuugaagcuaauggaaaccugaucgccccuugguacgcguucgcacuuagccgcgguuuuggcucggggauaauuacaucuaaugccuccauggacgagugugaugcuaagugccagacuccacaaggagccaucaacucaagucugccguuccagaaugugcaucccgucaccauuggcgaauguccuaaguauguuagaagcacaaaauugaggauggugaccggucuccggaacaucccauccauccagucucgcgggcuguuuggagcaauugcuggcuucauagagggcggguggacgggaaugaucgacgguugguacggcuaucaccaucagaaugaacaagggagcggauacgccgcggaucagaagucaacucagaacgccauuaauggcaucacaaacaaaguaaauaguauaauugagaagaugaacacccaguuuacugcaguggguaaagaguucaauaaguuagaaaagcgaauggagaaccugaacaaaaaggucgacgauggguuccucgacaucuggacauacaaugcugaacuucugguguugcuagagaacgaaagaacccuggacuuucacgauuccaauguuaaaaaccucuaugagaaggugaaaagccaacugaagaauaacgccaaggagaucggcaauggaugcuucgaauuuuaccacaaauguaacaaugagugcauggaaucugucaagaacggcacguaugacuaccccaaauauucagaggagaguaaacuuaauagggaaaagauugauggggugaagcuggagagcaugggaguauaccagaucuuggcuauuuauuccaccguugccucuucgcucgugcuguuagucagccugggugcaauauccuucuggaugugcucaaacggcagucuacagugucggaucugcauuuga

SEQ ID NO: 122938 - RNA, 1701 nt, Artificial Sequence; identical to SEQ ID NO: 122937
  derived and/or modified sequence opt3 from hemagglutinin__InfluenzaA__ABF47781

SEQ ID NO: 122939 - RNA, 1701 nt, Artificial Sequence; identical to SEQ ID NO: 122937
  derived and/or modified sequence opt3 from hemagglutinin__InfluenzaA__ABF47792

SEQ ID NO: 122940 - RNA, 1701 nt, Artificial Sequence; identical to SEQ ID NO: 122937
  derived and/or modified sequence opt3 from hemagglutinin__InfluenzaA__ABF47803

SEQ ID NO: 122941 - RNA, 1701 nt, Artificial Sequence; identical to SEQ ID NO: 122937
  derived and/or modified sequence opt3 from hemagglutinin__InfluenzaA__ABF47814

SEQ ID NO: 122942 - RNA, 1701 nt, Artificial Sequence; identical to SEQ ID NO: 122937
  derived and/or modified sequence opt3 from hemagglutinin__InfluenzaA__ABF47825

SEQ ID NO: 122943 - RNA, 1701 nt, Artificial Sequence; identical to SEQ ID NO: 122937
  derived and/or modified sequence opt3 from hemagglutinin__InfluenzaA__ABF47836

SEQ ID NO: 122944 - RNA, 1701 nt, Artificial Sequence; identical to SEQ ID NO: 122937
  derived and/or modified sequence opt3 from hemagglutinin__InfluenzaA__ABF47847

SEQ ID NO: 122945 - RNA, 1701 nt, Artificial Sequence
  derived and/or modified sequence opt3 from hemagglutinin__InfluenzaA__ABF47858
augaagaccaucauugcccugagcuacauacucugccuuguguucgcucagaaacugcccggcaacgacaaugggacagcaacuuuguguuuaggacaccaugccgucccuaacgguacgcugguuaagaccaucacaaaugaucaaauugaggugacuaacgcgaccgaacuuguacaguccucuucaacaggcagaaucugcgacaguccacacaggauucucgaugggaaaaauuguacccugaucgacgcucuacugggagauccgcauugcgacggcuuucagaacaaggagugggauuuguucguggaacggagcaaagccuauuccaauuguuaccccuaugacgucccugauuacgcaucucuccgcucgcugguggccucaagcgguacucuggaguuuauaaacgaagacuucaauuggacagggguugcucaggauggaaagaguuaugcaugcaagcgaggcuccgugaacucuuucuucagccgucucaauugguuacacaaacuggaguacaaguauccagcccuuaacgucaccaugcccaauaacggcaaauuugacaaguuguacaucuggggagugcaucacccuuccacggauucagaccaaaccagucuguacguaagagcuagcgggaggguuacugugucuacaaaacggucccagcagacugucauuccaaauaucgguuuccgccccugggugagaggccuaucaagcaggauuaguaucuauuggaccauagugaagccuggggacauucuccugaucaacucuacaggaaaccuuauugccccacggggcuacuuuaagauccgcaaugguaaauccagcaucaugcgaucggaugcgccgauugggaacuguucuuccgagugcauaacccccaauggaucaaucccuaacgacaagccauuccagaaugucaacagaauuacguauggcgcaugucccagguacguuaaacaaaauacucugaaguuggccacaggcaugcggaacgugccugaaaaacagacccgugggaucuuuggagcuauagccgguuucauugagaauggcugggaagggaugguagauggaugguauggcuuucgccaccagaacagugaggguacugggcaggcagcugaccucaagagcacacaagccgcgaucgaucagaucaauggcaaacugaacagauuaauugagaagaccaaugaaaaguuccaucagaucgagaaagaauuuuccgagguggaaggaaggauucaagaccuggagaaguacgucgaggauacgaaaauagaccucuggucuuauaacgccggccuucugguggcauuggaaaaucagcacaccaucgaucuaacagacagcgagaugaacaagcuguuugaacggacucgaaaacagcuccgcgagaacgcugaagauauggggaauggaugcuucaagauuuaccauaagugugacaacgccugcaucgguucaaucagaaauggcaccuacgaccacgauguuuauagggacgaggcucugaacaaucgguuucagauuaaagggguggagcuuaagaguggauacaaagauuggauacuguggaucuccuucgccauuagcugcuuuuugcucugugucgugcuguuaggcuucaucaugugggcaugccaaaaggguaacauucgcuguaauaucugcauauga

SEQ ID NO: 122946 - RNA, 1698 nt, Artificial Sequence; identical to SEQ ID NO: 122758
  derived and/or modified sequence opt3 from hemagglutinin__InfluenzaA__ABF47869

SEQ ID NO: 122947 - RNA, 1698 nt, Artificial Sequence; identical to SEQ ID NO: 122758
  derived and/or modified sequence opt3 from hemagglutinin__InfluenzaA__ABF47880

SEQ ID NO: 122948 - RNA, 1698 nt, Artificial Sequence
  derived and/or modified sequence opt3 from hemagglutinin__InfluenzaA__ABF47891
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgcgcaaaaacggauuguaucccaaucugagcaagucuuacgcaaacaauaaagaaaaggagguucuaguacucuggggcgugcaucacccuccaaacaucggcgaucagcgagcccuguaccacacugaaaacgcuuaugucuccguggugucaagccauuacagucguagauucacccccgagauagcaaaaaggccuaagguccgggaccaggaagggcgcaucaauuauuacuggacacuucuggagccaggagauacuauuaucuuugaggccaacgguaauuugauugcuccgagauaugccuucgcgcucucuaggggcuuuggguccggaaucauaaccagcaacgcacccauggacgaaugugaugccaagugccagacaccucaaggcgcuauuaauucgucucugccauuccagaacguucaccccgugaccaucggugaguguccuaaauacguacgguccgccaaguuacgcauggugacggggcugcgaaauauuccaucaauccagaguagaggacucuuuggcgcaaucgcuggcuucauugaagggggauggacugguauggucgacggcugguauggguaccaucaccagaacgagcaaggaagcggcuacgccgcggaucagaaauccacacagaaugccauaaacgguaucaccaauaaggugaacucuguuauugaaaagaugaauacucaguuuacagcaguggggaaagaguucaacaaacuugagaggcggauggaaaaucugaacaagaaggucgacgauggcuucuuggacaucuggaccuauaacgcugagcuacuggugcuccuggaaaaugagcguacgcuugacuuucacgauagcaacguuaaaaaucuguacgaaaagguaaaaucacaauugaagaacaaugccaaagagauaggaaacggcugcuucgaguuuuaucauaaguguaauaacgaaugcauggagagugugaagaaugggaccuacgacuaucccaaauacuccgaagagagcaagcucaaccgcgagaaaauugauggagucaagcuggaaucuauggguguguaucagaucuuagcuaucuacucaacagucgccaguagccuggugcuacucguuucccugggcgcaauuucuuucuggaugugcucgaaugggagccuucaguguagaaucugcauuuga

SEQ ID NO: 122949 - RNA, 1701 nt, Artificial Sequence
  derived and/or modified sequence opt3 from hemagglutinin__InfluenzaA__ABF47902
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaucgggugauauucuacucaucaauuguacaggcaaccugauugcgccaagaggguauuucaagaucaggucuggaaaguccucaaucaugcggagugacgcaagcauuggcaaaugcaauuccgaauguauaaccccgaacgguucuauccccaaugacaagccuuuucagaacgugaaucgcauuacguacggggccugcccacgauaugucaaacagaacacucuuaagcuggcuacaggaaugagaaauguucccgagaaacaaaccaggggcaucuucggcgccauagcaggguuuauugaaaacggaugggaggguaugguggauggcugguacggguuccggcaccagaauagcgagggaacuggccaggcugccgacuugaagucaacacaagcggccaucaaccagaucaaugguaaacucaaccgucugauugaaaagaccaaugagaaguuucaucagaucgaaaaagaguucagugaaguagaggggcgcauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugagggagaacgccgaggacaugggcaauggauguuuuaagauuuaucauaaaugcgauaacgcuugcaucggcucuauccggaaugggaccuacgaccacgauguguaccgagacgaagcccucaacaaucgcuuccagauuaagggaguugagcugaaaucagguuauaaggacuggauacuuuggaucaguuuugcaauuagcuguuuccuguugugcgugguccuccugggcuuuaucaugugggccugucagaaagggaacauuagaugcaauaucuguauauga

SEQ ID NO: 122950 - RNA, 1698 nt, Artificial Sequence
  derived and/or modified sequence opt3 from hemagglutinin__InfluenzaA__ABF47955
augaaggccaaacugcucgugcuucuguacgcuuucgucgcaaccgacgccgauacaaucugcauuggcuaucacgcgaacaauagcacugacacgguugauaccauauuugagaagaacguggcuguaacacauuccgugaauuuguuagaagacagacacaacgggaaacuguguaagcuaaaaggaaucgcaccccuccagcuggguaagugcaauauuacuggcuggcuucuggggaacccugagugugauucuuugcucccagccaggucauggaguuacaucgucgaaaccccgaauagcgagaacggagccugcuaucccggcgacuucauugauuacgaggagcugcgggagcaacuguccucugugucgucacucgaacgcuuugagaucuucccuaaggaaagcaguuggccaaaucauacauuuaacgguguuaccguguccuguucucaccgagggaaaagcuccuucuaucguaauuuacuguggcuuacuaagaaaggagacucauaccccaaguugacaaacaguuaugucaauaacaaaggcaaggaggugcugguacuauggggcguucaucacccuucuagcuccgaugagcagcagucacucuacagcaaugggaacgcuuacgugagugucgcaucuuccaacuauaauagaagguuuaccccagaaauagccgcucggcccaaggugaaagaccagcacggacgcaugaacuacuauuggacgcugcuugagccuggugauacuaucauuuucgaagccaccggcaaucugaucgcgccaugguacgcauuugccuugagcagaggguucgagucgggaauuaucacaucuaacgcuuccaugcaugaaugcaauacuaagugucaaaccccgcagggcucaauaaacaguaaucuccccuuucagaacauucacccugugacaaucggugagugcccaaaauaugucaggagcaccaagcugcggaugguuacgggguuacgcaauauucccuccauccaguaccgaggacuguucggcgccaucgcaggcuuuauugaagggggauggacugguaugauagacggcugguauggguaccaucaccaaaacgaacagggaucuggcuacgcugccgaucagaaaagcacacagaaugcgaucaacagaauuaccaauaaggugaacucaguaaucgagaaaaugaauacucaauucacagccguggguaaggaguucaacaaccucgaaaagaggauggaaaaucuuaacaaaaaggucgacgacggguuucuggauauauggaccuauaaugcagaguugcuagugcugcucgagaacgaacggacgcuggacuuccacgaucuuaauguuaaaaaccuguacgagaaggugaaaagucaguugaagaauaacgcuaaggaaauuggcaauggauguuuugaguucuaucauaaaugcgacaacgaauguauggaguccguccguaauggcaccuacgauuauccuaaguacagcgaggaaucuaaacucaaccgcgagaagaucgacggggugaaacuggaaucaaugggaguauaucagaucuuagccauuuacaguacaguugcuagcucccuggugcuacucgucucucugggugccaucucguuuuggaugugcagcaauggcucccuucaaugcagaauuuguauauga

SEQ ID NO: 122951 - RNA, 1698 nt, Artificial Sequence
  derived and/or modified sequence opt3 from hemagglutinin__InfluenzaA__ABF60576
augaagaccacaaucauucugauacuccuuacucacgccguggacagccagaaccccaucuccggcaauaacacggcuacccugugcuuggggcaucacgcagucgccaauggaacauuaguuaaaacuauuaccgaugaccaaaucgaggugacaaacgcgaccgaacugguacagucuacuucaauugguaagaucuguaauaacccuuacagagugcuagauggcaggaauugcacacucauagacgcuaugcugggggauccacauugugacgucuuccaguaugagaacugggaucuuuuuaucgaacggaguagcgccuucuccaauugcuacccguaugacauucccgauuacgcaucucugcgcucgaucguggccucaagcggaaccuuggaguuuacggcugaaggcuucacuuggaccgguguuacacagaacgggggaaguggcgcaugucgacguggcuccgccgacagcuuuuucucuagacucaauuggcugacuaaauccgggaacucauauccuacccugaaugugacaaugccaaacaaugauaacuuugacaagcucuacauuuggggaauccaccaucccaguaccaacaaugagcaaacgaaauuauauguccaggagcuggguagggugacuguaagcacaaagcggucucagcagaccauaauuccuaacaucggcucccgcccagggguuagaggacaagcuggcaggauuucaaucuacuggacuaucgugaagcccggugauauucuuaugauaaauagcaacgggaauuuggucgccccucggggauacuucaaaaugcgcacaggcaagaguucuaucaugcgauccgacgcgccaauugauaccugcuggagcgaauguaucacgccgaacggcucgauacccaaugacaaaccuuuucagaacgugaauaaggugaccuaugggaaaugcccaaaguacauuaagcagaacacacugaaacuagcaacuggaaugagaaauguccccgagaagcagaucagggguaucuucggcgccauugcuggguuuaucgaaaacggaugggagggcaugguugacgguugguauggguuccgguaccaaaauucugagggcaccggacaggccgcagaucucaaauccacacaggcugccauugaccaaauaaacggcaagcugaaucgugugaucgaacgcacuaacgagaaauuucaccagauugaaaaggaguucucagaaguagaggggagaauccaggaucuugagaaauauguggaagacaccaagaucgaucuguggaguuacaacgcggaguugcucgucgcccuggaaaaucagcacacaauugacuuaaccgaugcagagaugaacaagcuguucgagaaaacuaggcggcaacuccgagaaaaugcugaggacaugggagguggcuguuuuaagauauaucauaaaugcgauaacgccuguaucgggagcauucgcaauggaacguacgaccacuacaucuauagagacgaagcucuuaacaauagguuccagauuaagggcguggagcugaaauccgguuacaaggauuggaucuuguggauaucuuuugccaucagcugcuuccuaauuugcguugugcugcucggguuuaucaugugggcaugugaaaagggcaacauucggugcaauaucuguauauga

SEQ ID NO: 122952 - RNA, 1701 nt, Artificial Sequence
  derived and/or modified sequence opt3 from hemagglutinin__InfluenzaA__ABF60577
augaagaccaucauugugcugagcuacuucuuuugccucgcccuuucccaggacuauucugagucaaacaauaguacagcuacucuguguuugggccaccaugcaguccccaacgggacgauaguuaaaaccaucacagaugaccaaauugaagugacuaaugccaccgaguuaguacagagcuccucuacaggaaagaucugcaacaauccucacaggauucuggaugguagagacuguacccuaaucgaugcgcuccugggcgacccacauugcgauguguuccaggacgaaacuugggaucuuuacgucgagcggucgucagcuuuuagcaacuguuauccguacgacgugcccgauuaugccagucugcgcuccuugguugcaucuagcgggacacucgaguucauaaccgaaggauuuacguggacuggcgugacccagaaugguggguccaacgccugcaaacgaggaccugcuucaggcuucuuuagucgucugaauuggcugacaaagagcggcucuacuuacccaguccucaacgugaccaugcccaaugacgauaacuucgacaaauuauauguauggggaguucaccauccuuccacaaaucaagagcagaccgaccuguacgugcaggcaucagggagagucacggugagcacuaggcggagucagcaaacaaucauuccaaacaucgguucucgccccugggugagaggccaguccgggaggauuagcaucuacuggaccauagucaagccuggagauguucuugugauuaauucgaacggcaacuugaucgccccacgggguuauuuuaagauucgcacugggaaaucuuccaucaugcgaucagacgcuccgaucgauacauguauuagugaaugcauaacccccaauggaagcaucccuaacgacaagccauuccagaauguaaacaaaauuacguacggcgccugucccaaguaugugaaacaguccacccugaagcuagcgacaggcaugagaaaugucccugagaagaaaacuagggggcucuuuguggcaaucgccggauucauagaaaacgguugggagggcaugauugauugcugguacggguuucggcaccaaaauucugagggaaccggccaggcugccgaccuuaagagcacacaggcagcuaucgaucaaaucaacgguaaacugaaucguguuauugaaaagacuaacgagaaauuccaccagaucgaaaaggaguucucagaaguggaggggcgcauucaggaccuggagaauuaugucgaagauaccaaaauagacuuguggaguuacaacgccgagcuccugguggcguuagaaaaucagcauacaaucgaucugaccgacuccgagaugaacaagcucuuugaaagaacuaggcggcaacuucgagagaaugccgaggacaugggcagcggauguuucaagauuuaucacaaaugcgauaacgcaugcaucgaaucuauccgcaacggcacguacgaccaugauauuuacagagacgaggcucugaauaacagguuucagauaaaggggguagaauugaaaucaggauauaaggauuggauccuauggauuaguuucgccacaagcuguuuucugcucugcguugugcuggguggcuucaucaugugggcuugucagcgggggaauauucgcugcaacaucuguauauga

SEQ ID NO: 122953 - RNA, 1701 nt, Artificial Sequence
  derived and/or modified sequence opt3 from hemagglutinin__InfluenzaA__ABF60578
augaagaccaucauugugcugagcugcuucuuuugucucgccuucucccaggaccuuucugagaacaauaacaauacagcuacucugugcuugggccaccaugcaguccccaacgggacgauaguuaaaaccaucacagaugaccaaauugaagugacuaaugccaccgaguuaguacagucaaguagcacaggaaagaucuguaacaauccucacaggauucuggaugguagagacugcacccuaaucgaugcgcuccugggcgacccacauugugauguguuucaggacgaaacuugggaucuuuacgucgagcgguccaaaucuuucucgaacugcuauccguacgacgugcccgauuaugcuucacugcgcagcuugguugccaguuccgggacacucgaauuuauaaccgaggcauucacguggacuggagugacccagaauggcgguucuggggccuguaagcgaggaccuggcaacggcuuuuucagccgucugaauuggcugacaaaauccgggucagcuuacccaguccucaacgugacuaugcccaauaacgacaauuuugauaaguuauauguauggggaguucaccauccuaguaccaaccaagagcagacaaaccuguacgugcaggcaagcgguagagucaccgugucuacgaggcggucccagcaaacuaucauuccaaauaucggcucacgccccugggugagagggcagagcaggcggauuaguaucuauuggacaauagucaagccuggagacauucuuguuaucaacucuaauggcaacuugauugccccacgcgguuacuucaaaaugcgaaccgggaaguccagcaucaugagaucggacgcuccgaucgauacuugcauuucugaauguauaacacccaauggauccaucccuaacgacaaaccauuucagaaugugaacaagauuaccuacggcgccugccccaaauauaucaagcagucaacgcugaagcuagcgaccggcaugaggaauguaccugagaaacaaacacgggggcuguucggagcaauagccgguuuuauugaaaacggcugggaggggaugaucgauggaugguacggcuuccgucaccagaauagugaggguacugggcaggcugccgaccucaagagcacccaagcagcuaucgaucagauuaacggcaaacuuaaucgcgugaucgaaaagacaaacgagaaauuccaccagauugaaaaggaguuuuccgaagucgagggaagaauacaggaccuggagaaauauguggaagauacuaagaucgacuuguggucuuacaaugccgauguucucguggcgcuggagaaccaacauaccauugacuuaacagauagcgaaaugaacaagcuguucgagaaaaccaggcggcagcuccgagaaaaugccgaggacaugggcaacggguguuuuaagaucuaucacaaaugcgacaaugcaugcaucgagucaauucgcaacggaacuuacgaucaugacauauauagagaugaagcucuuaauaacagguuccagaucaaggguuguggcgucaaaaguggguacaaggacuggauucuguggaucuccuuugccauuagcugcuucuugcuaugugugguacugcucggauuuaucaugugggcuugccagcggggcaauauacgcuguaacaucugcauuuga

SEQ ID NO: 122954 - RNA, 1701 nt, Artificial Sequence
  derived and/or modified sequence opt3 from hemagglutinin__InfluenzaA__ABF60579
augaagacccugaucgcccucagcuacauuuucugccuugugcugggccaggacuugcccgggaacggaaauuccacagcuacuuuaugucugggucaccaugcagucccuaacggcacgcuaguuaaaaccauaacagaugaccaaaucgaggugacuaaugccaccgaacucguacagaacuuuucuauggauaagauuugcaauaacccacacagaauccuggacggggcgaauuguacacuuauugaugcucuguugggagacccgcauugcgaugacuuccagaacgagaaaugggaucucuuuguggaaaggucaaaggccuucaguaauuguuaucccuacgacgucccugauuauaccagccugcggucccugaucgcaucuucgggcacucucgaguuuauaaacgaagacuucaauuggacaggugugacccagaacgggggaucaaaugccugcaaacgcggcccagauagcuccuuuuucagucgauuaaacuggcuguacaagucuggcaauacguaucccaugcuuaacguuacuaugccuaacagcgacaauuuugacaaguuguacaucuggggagugcaccauccauccaccgcucgugagcaaacaaaccuguauguccaggcaucagggaaagugacuguaaguaccaagagaagccagcagacaauuauccccaauauugguucuaggccuuggguucggggccuauccucacgcaucagcauauacuggaccauugugaaaccaggggauauccucgucauuaacaguaauggaaaccugaucgccccgagaggcuacuucaagaugcacacggguaggucuuccaucaugcggagcgacgcucccauugauacuuguucgucugagugcauaacaccuaauggguccaucccaaacgacaaacccuuucaaaaugugaacaagauuaccuauggagccuguccuaaguacgugaaacagaauacucuuaagcuggcgacaggcaugcgcaacaucccagaaaaacagacccgaggcauauucggggcaauugccggauuuaucgagaaugguugggaaggcauggucgaugggugguauggauucagacaccagaacucagagggcacgggucaagcugccgacuugaagaguacccaggcagcuaucgaucagauuaaugggaaacucaacaggguuaucgagaagacaaacgaaaaauuccaucaaauugagaaggaauuuagcggcguggagggacggauacaggaccuggaaaaguacguagaggauacuaaaaucgacuuaugguccuauaaugccgagcugcucguggcgcuugaaaaccagcacaccauugaucugacagacucugagaugaauaaguuguucgagaaaacucgucgccagcuaagagaaaacgccgaagacaugggcaaugggugcuuuaagaucuaccauaaaugugauaacgcaugcaucgagagcauuaggaauggaaccuaugaccacaacgaguaccgggaugaagcucugaauaaccgauuccaaauaaagggugucgagcucaagucaggcuacaaagacuggauccuguggauuaguuuugccaucuccugcuuccuucugugugugguuuugcucggguuuauuaugugggcuugccagaagggaaauauccgcuguaacauaugcaucuga

SEQ ID NO: 122955 - RNA, 1701 nt, Artificial Sequence
  derived and/or modified sequence opt3 from hemagglutinin__InfluenzaA__ABF60580
augaagaccaucauugcccugagcuacauauucugccucgcuuuugcacaggaccuucccggcaacgauaauuccacagccacucuguguuuggggcaccaugcggugccuaacggaacguuagucaaaaccaucacaaaugaccaaauugagguuacuaacgcuaccgaacuggugcagucuucaaguacagguaagaucugcgauaauccacacaggauucuagacggcaucaacuguacccucauagaugcccugcuuggggacccgcauugcgauggauuccagaaugagaaaugggaccuguuuguagaaagaagcaaggcauucuccaacuguuaucccuacgaugugccugacuaugccucuuugcggucgcucgucgcuucaagcggcacucuggaguuuaucaaugaagguuucaacuggacaggggugacccagaauggaggcaguuccgcaugcaaacgcggcccagauaacggguuuuucucucgacugaauuggcucuacaagagcggauccacguaucccguucaaaacgugacuaugccuaauaacgacaacucagauaaguuauacauuugggguguccaccauccaaguaccgacaaagagcagacagaccuguaugugcaggccagcggcaagguaacuguuucuaccaaacguauccagcaaacagugauucccaaugucggguccagaccuugggugaggggacuuucaagccgggugaguaucuacuggaccauagucaagccaggcgauguuuuggugauuaacucuaaugguaaccugaucgcuccgcgcggguacuauaaaaugagaacgggaaaguccagcauuaugaggucggacgcccccaucggcacuuguucuuccgagugcaucacaccuaauggcucaauuccaaacgauaagcccuuucagaauguaaacaaaauaaccuacggggcguguccuaaguaugugaaacagaauacucuaaagcucgcaacaggaaugcggaacgucccagaaaaacagacccgcgguaucuucggcgccauugcuggguuuaucgagaauggaugggaaggcaugauagacgguugguacggguuccgacaccaaaacagugagggcacgggacaggccgcagaucuuaagagcacccaggcugccauugaccaaaucaauggcaaacugaacagagugaucgagaagacaaaugaaaaguuucaccagauugagaaagaguucuccgaaguugaagggaggauccaggaucuggagaaguauguggaggacacuaaaauugauuuguggucuuacaacgcggaaguccucguggcccuggagaaccagcauaccauagacuuaacagauagcgaaaugaauaagcuguucgagaaaacucggcgucaacuccgcgaaaacgcagaggacaugggaaaugguugcuuuaagaucuaucacaagugugacaacgcuugcauuggcucaaucagaaaugggaccuacgaucaugacguauacagggaugaggcccuuaacaaucgguuccagaucaaaggaguugaacugaagaguggcuauaaagacuggauuuuguggauauccuuugcuaucagcugcuuccuacugugugugguccuccuggguuuuauuaugugggccugccagaaggggaacauccgauguaauauuugcaucuga

SEQ ID NO: 122956 - RNA, 1701 nt, Artificial Sequence
  derived and/or modified sequence opt3 from hemagglutinin__InfluenzaA__ABF60581
augaagaccaucauugugcugagcuacuucuuuugccucgcccuuucccaggacuauucugagucaaacaauaguacagcuacucuguguuugggccaccaugcaguccccaacgggacgauaguuaaaaccaucacagaugaccaaauugaagugacuaaugccaccgaguuaguacagagcuccucuacaggaaagaucugcaacaauccucacaggauucuggaugguagagacuguacccuaaucgaugcgcuccugggcgacccacauugcgauguguuccaggacgaaacuugggaucuuuacgucgagcggucgucagcuuuuagcaacuguuauccguacgacgugcccgauuaugacagucugcgcuccuugguugccucuagcgggacacucgaguucauaaccgaaggauuuacguggacuggcgugacccagaaugguggguccaacgcaugcaaacgaggaccugccucaggcuucuuuagucgucugaauuggcugacaaagagcggcucuacuuacccaguccucaacgugaccaugcccaauaacgauaauuucgacaaauuauauguauggggaguucaccauccuuccacaaaccaagagcagaccaaucuguacgugcaggcuucagggagagucacggugagcacuaggcggagucagcaaacaaucauuccaaacaucgguucucgccccugggugagaggccaguccgggaggauuagcaucuacuggaccauagucaagccuggagacguucuugugauuaacucgaauggcaacuugaucgcaccacgggguuauuuuaagaugcgcacugggaaaucuuccauuaugcgaucagaugccccgaucgacacauguaucagugaaugcauuacccccaauggaagcauaccuaacgauaugccauuccagaauguaaacaagaucacguacggcgcuugucccaaauaugugaagcagggcacccugaaacuagccacagggaugagaaaugucccugagaagcaaacuaggggacucuuuggugcgauugcaggcuucaucgaaaacgggugggagggaaugauagacggcugguacgguuuucggcaccaaaauuccgaggggaccggccaggccgcugaucugaagucuacacaggccgcaauugaccagaucaacggaaaacuuaaucgugugaucgaaaagacuaacgagaaauuccaccagauugaaaaggaguucagcgaaguugagggccgcauccaggaucuggagaaauauguggaagacaccaagauugauuuguggucagacaaugcugagcuccuggucgccuuagaaaaccaacauacaauagaucugaccgacagugagaugaauaaacucuuugaaaagacuagaaggcagcuucgggagaacgcggaggugauggggaacggaugcuucaagaucuaccacaaaugugacaaugccugcauugaauccauccgaaacgguacguaugaucaugacaucuaccgcgaugaggcacugaauaacagauuucagauuaagggcguagaauugaaaagcggguacaaggacuggauacuauggaucucuuucgcuauuucaugcuuucugcucuguguugugcugcuuggauucaucaugugggccugccagaggggcaauauucgguguaacaucugcauauga

SEQ ID NO: 122957 - RNA, 1701 nt, Artificial Sequence; identical to SEQ ID NO: 122756
  derived and/or modified sequence opt3 from hemagglutinin__InfluenzaA__ABF82651

SEQ ID NO: 122958 - RNA, 1698 nt, Artificial Sequence; identical to SEQ ID NO: 122816
  derived and/or modified sequence opt3 from hemagglutinin__InfluenzaA__ABF82662

SEQ ID NO: 122959 - RNA, 1698 nt, Artificial Sequence
  derived and/or modified sequence opt3 from hemagglutinin__InfluenzaA__ABF82673
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaaggaagcugguccuacaucguggagaccccaaauccggaaaacggcacuuguuaucccgguuacuuugccgacuaugaggagcugagagaacaacucucuucgguuagcucauucgagagguuugaaauuuucccuaaggggaguuccuggccaaaucauacagugaccggagucucugcaagcugcucccacaacggcaagucaaguuuuuaccggaauuuacuguggcuuacgggcaaaaacggguuguaucccaaucugagcaugucuuacgugaacaauaaggagaaagagguacuuguucucuggggagugcaucacccuccaaacaucggugaucagcgcgcccuguaccacacugaaaacgcuuaugucuccguggugucaagccauuacagucgacguuucacccccgagauagcaaagagaccuaaagucagggaccaggaaggccggaucaauuauuacuggacacuucuggagccaggggauacuauuaucuuugaagccaacggaaauuugauugcuccgugguaugccuucgcgcucucucgcggcuuugguuccgggaucauaaccagcaacgcacccaugggagagugugacgccaagugccagacaccucaaggcgcuauuaauucgucucugccauuccagaacguucaccccgugaccaucggcgaguguccuaaguacguaagauccgccaaauuaaggauggugacggggcugcggaauauuccaucaauccagagucgcggacucuuuggugcaaucgcuggcuucauugaagggggauggacuggcauggucgaugguugguauggguaccaucaccagaacgagcaaggcagcggauacgccgcggaccagaaguccacacagaaugccauaaacggcaucaccaauaaagugaacucuguuauugaaaagaugaauacucaguuuacagcaguggggaaagaguucaacaagcuagaacgaagaauggagaaucugaacaaaaaggucgaugacggauucuuggauaucuggaccuauaacgcugagcuacuggugcuccuggaaaaugagaggacgcuugacuuucacgacagcaacguaaagaaucuguacgaaaaaguuaagucacaauugaaaaacaaugccaaggagauagguaacggcugcuucgaauuuuaucauaaauguaauaacgagugcauggagagugugaagaaugggaccuacgauuaucccaaguacuccgaagagagcaaacucaaccgggaaaagauugacggagucaaacuggagucuaugggcguguaucagaucuuagcuaucuacucaacagucgccaguagccuggugcuacucguuucccugggugcaauuucuuucuggaugugcucgaaugggagccuucagugucguaucugcauuuga

SEQ ID NO: 122960 - RNA, 1698 nt, Artificial Sequence; identical to SEQ ID NO: 122857
  derived and/or modified sequence opt3 from hemagglutinin__InfluenzaA__ABF82684

SEQ ID NO: 122961 - RNA, 1701 nt, Artificial Sequence; identical to SEQ ID NO: 122823
  derived and/or modified sequence opt3 from hemagglutinin__InfluenzaA__ABF82695

SEQ ID NO: 122962 - RNA, 1701 nt, Artificial Sequence; identical to SEQ ID NO: 122799
  derived and/or modified sequence opt3 from hemagglutinin__InfluenzaA__ABF82706

SEQ ID NO: 122963 - RNA, 1698 nt, Artificial Sequence; identical to SEQ ID NO: 122315
  derived and/or modified sequence opt3 from hemagglutinin__InfluenzaA__ABF82819

SEQ ID NO: 122964 - RNA, 1698 nt, Artificial Sequence; identical to SEQ ID NO: 122816
  derived and/or modified sequence opt3 from hemagglutinin__InfluenzaA__ABF82830

SEQ ID NO: 122965 - RNA, 1698 nt, Artificial Sequence; identical to SEQ ID NO: 122816
  derived and/or modified sequence opt3 from hemagglutinin__InfluenzaA__ABF82841

SEQ ID NO: 122966 - RNA, 1698 nt, Artificial Sequence; identical to SEQ ID NO: 122816
  derived and/or modified sequence opt3 from hemagglutinin__InfluenzaA__ABF82852

SEQ ID NO: 122967 - RNA, 1698 nt, Artificial Sequence
  derived and/or modified sequence opt3 from hemagglutinin__InfluenzaA__ABF82863
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcagcuucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcauguucuacgugaacaauaaggagaaagaaguacuuguucucuggggagugcaucacccuccaaacaucggggaucagcgcgcccuguaccacacugagaacgcuuaugucucugugguguccucacauuacagccgacguuuuacccccgaaauagcaaagagaccuaaagucagggaccaggagggucggaucaauuauuacuggacacuucuggaaccaggcgauacuauuaucuucgaggccaacgggaauuugauugcuccgugguaugccuuugcgcucagucgcggauucggcucugguaucauaaccuccaacgcacccaugggggagugugacgccaagugccagacaccucaaggagcuauuaauagcucgcugccauuucagaacguucaccccgugaccaucggcgaauguccuaaguacguaagaucugccaaauuaaggauggugacgggccugcggaauauuccauccauccagucacgcggacucuucggggcaaucgcugguuuuauugagggcggguggacuggaauggucgauggcugguaugguuaccaucaccagaacgaacaagggaguggcuacgccgcggaccagaagucaacacagaaugccauaaacggaaucaccaauaaagugaacuccguuauugagaagaugaauacucaguucacagcagugggcaaagaguucaacaagcuagaacgaagaauggagaaucugaacaaaaaggucgaugacggguuuuuggauaucuggaccuauaacgcugaacuacuggugcuccuggagaaugaaaggacgcuugacuuccacgacucuaacguaaagaaucuguacgagaaaguuaagagccaauugaaaaacaaugccaaggaaauaggaaacgguugcuuugaguucuaucauaaauguaauaacgagugcauggaaucagugaagaauggcaccuacgauuaucccaaguacagugaggaauccaaacucaaccgggagaagauugacggggucaaacuggagagcaugggaguguaucagaucuuagcuaucuacucuacagucgccucaagucuggugcuacucguuagccugggcgcaauuuccuuuuggaugugcucuaaugguucgcuucagugucguaucugcauuuga

SEQ ID NO: 122968 - RNA, 1698 nt, Artificial Sequence
  derived and/or modified sequence opt3 from hemagglutinin__InfluenzaA__ABF82874
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucagggaccaggagggucggaucaauuauuacuggacacuucuggaaccaggcgauacuauuaucuuugaggccaacgggaauuugauugcuccgugguaugccuucgcgcucucucgcggauuuggcuccgguaucauaaccagcaacgcacccaugggggagugugacgccaagugccagacaccucaaggagcuauuaauucgucucugccauuccagaacguucaccccgugaccaucggcgaauguccuaaguacguaagauccgccaaauuaaggauggugacgggccugcggaauauuccaucaauccagagucgcgggcucuuuggagcaaucgcugguuucauugagggcggguggacuggaauggucgauggcugguaugguuaccaucaccagaacgaacaagggagcggcuacgccgcggaccagaaguccacacagaaugccauaaacggaaucaccaauaaagugaacucuguuauugagaagaugaauacucaguuuacagcagugggcaaagaguucaacaagcuagaacgaagaauggagaaucugaucaaaaaggucgaugacggguucuuggauauauggaccuauaacgcugaacuacuggugcuccuggagaacgaaaggacgcuugacuuucacgacagcaauguaaagaaccuguacgagaaaguuaagucacaauugaaaaauaacgccaaggaaauuggaaaugguugcuucgaguuuuaucauaaauguaacaaugagugcauggaaagugugaagaacggcaccuacgauuaucccaaguacuccgaggaaagcaaacucaaucgggagaagaucgacggggucaaacuggagucuaugggaguguaucagaucuuagcuauuuacucaacagucgccaguagccuggugcuacucguuucccugggcgcaaucucuuucuggaugugcucgaacgguagccuucagugucguauuugcauauga

SEQ ID NO: 122969 - RNA, 1698 nt, Artificial Sequence; identical to SEQ ID NO: 122816
  derived and/or modified sequence opt3 from hemagglutinin__InfluenzaA__ABF82885

SEQ ID NO: 122970 - RNA, 1698 nt, Artificial Sequence; identical to SEQ ID NO: 122816
  derived and/or modified sequence opt3 from hemagglutinin__InfluenzaA__ABF82896

SEQ ID NO: 122971 - RNA, 1698 nt, Artificial Sequence; identical to SEQ ID NO: 122816
  derived and/or modified sequence opt3 from hemagglutinin__InfluenzaA__ABF82907

SEQ ID NO: 122972 - RNA, 1698 nt, Artificial Sequence; identical to SEQ ID NO: 122860
  derived and/or modified sequence opt3 from hemagglutinin__InfluenzaA__ABF82929

SEQ ID NO: 122973 - RNA, 1698 nt, Artificial Sequence; identical to SEQ ID NO: 122816
  derived and/or modified sequence opt3 from hemagglutinin__InfluenzaA__ABF82940

SEQ ID NO: 122974 - RNA, 1701 nt, Artificial Sequence
  derived and/or modified sequence opt3 from hemagglutinin__InfluenzaA__ABF83447
augaagaccaucauugcccugagcuacauauucugccucgcucuuggccaggaccugcccgggaacgauaauaacacagcaacuuuguguuuaggacaccaugccgugccuaaugguacgcuggucaaaaccaucacagacgaucaaauugagguuacuaacgcgaccgaacuugugcaguccucuucaacaggcaagaucugcaauaacccacacaggauucucgacgggaucgauuguacccugauagacgcucuacugggagauccgcauugcgacguauuucagaaugagacuugggauuuguucguggaaagaaguaaagccuuuagcaacuguuaucccuacgacgucccugauuaugcaucccuccggucucugguggccucgucaggcacacuggaguucaucaccgaagguuuuacguggacugggguuacccagaauggaggcagcaacgcuugcaagcgcggcccagggaguggauucuuuucccgacucaauugguuaacaaaaucugguagcacuuaccccgugcugaacgucaccaugccuaauaacgacaauuucgauaaacuuuauauuuggggcgugcaccauccauccacaaaccaagagcagaccucauuguacguacaggcaagugggggaguuacggugagcacucguagaucucagcaaacaaucauucccaacaucggcuccaggccuuggguccggggucugucaagccgcauaaguauuuauuggaccaucgugaagccaggggacgugcuagucauuaauucuaacggaaaucucaucgccccgagaggcuacuuuaagaugaggacuggcaaguccagcaucaugcggucggacgcucccauugauacauguauaucugagugcaucaccccuaacggguccauuccaaaugacaaacccuuccagaacguuaauaagaucacguacggagccuguccuaaauaugugaagcagaacacccugaaacuugcgacagguaugcgcaauguaccagaaaagcagacucgaggccuguuuggggcaauagccggauucauugagaacggcugggaagguaugaucgaugggugguacggcuuuagacaccaaaauucagagggaaccggccaggcugccgacuugaagaguacacaggcagcuaucgaucaaauuaacgggaaacucaauagggugaucgagaagacuaacgaaaaauuccaccagauugagaaggaguucagcgaagucgaaggacggauacaggaccuggagaaauauguggaggauaccaagaucgacuuaugguccuacaaugccgaacugcucguugcgcuugagaaccagcauacaauugaucugaccgacucugaaaugaacaaguuguuugagaaaacucgucgccaacuaagagaaaaugccgaggauauggguaacggcugcuucaagaucuaucacaaaugugacaaugcaugcaucgagagcauuaggaacgggacguacgaccaugauguguaucgggacgaagcucugaauaaccgauuucagauaaagggagucgagcucaaaucaggcuacaaggauuggauccuguggauuaguuucgccaucuccugcuuucuucugugugugguauugcucgguuucauuaugugggcuugccagcgcgggaauaucagauguaacauaugcaucuga

SEQ ID NO: 122975 - RNA, 1644 nt, Artificial Sequence
  derived and/or modified sequence opt3 from hemagglutinin__InfluenzaA__ABG20468
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuaugugaucuggacggagucaaaccccuaauucucagagauugcucaguggccggugagaagaucaacccugcgaaugaccuguguuauccaggcaacuucaaugauuacgaagaacuuaagcaucuguugaguaggauaaaccacuuugagaaaauccagauuaucccgaaguccuccuggucugaccaugaggcuucgucagggguuagcagugccugccccuaucagggacgguccucuuucuuucgcaauguggucuggcucauuaaaaagaacaaugcauacccuacaaucaaacgaagcuauaacaauacuaaccaagaggaucugcuggugcucuggggcauacaccacccaaaugacgccgcugaacagacccguuuauaccagaaccccacaaccuauauuuccguagguacuucaacacugaaccagagacuuguuccuaagaucgcaaccaggaguaaggugaaugggcaaagcggacggauggaguucuuuuggacgauuuugaaaccaaacgaugccaucaauuucgagucuaacggcaauuuuaucgcucccgaaaacgccuacaagauugucaaaaagggcgacuccacuauaaugaaaucagagcuggaauacgggaauuguaacaccaagugcgagacaccuaucggagcgauuaauagcaguaugccauuccauaacauccacccgcuaacuauaggugaaugucccaaauaugugaagucuaaucgccucgugcuggcaaccggccuuagaaacuccccucagggggagaggcggcgcaagaaacgaggacuguuuggcgccauugcugguuucaucgaagggggauggcagggcauggucgauggcugguacggguaucaucacagcaaugaacagggaucggguuacgccgcagacaaggagucuacacaaaaagcuaucgacggcguuaccaacaaggugaauagcauuaucgauaaaaugaacacgcaguuugaagccguagggagagaguucaacaauuuggaaaggcggauugagaaccucaauaagaagauggaggacggauuucuggauguguggacuuauaacgcggaauuacugguccucauggagaaugaacguacacuugacuuccacgauucaaacgugaaaaaucuguacgacaagguucgcuugcagcuaagagauaacgccaaagagcugggcaaugguugcuucgaauuuuaucauaggugugacaacgagugcauggagagugugcggaaugggaccuacgauuacccacaauauagcgaagaggcacgacucaagcgcgaagagauauccggcgucaaacuggagucuaucggaacuuaccagauucuuagcaucuauucaacaguggcuaguucccuggccuuggcuaucaugguagccggccucagccuguggauguguucuaacgggucauuacagugcagaauuugcauauga

SEQ ID NO: 122976 - RNA, 1707 nt, Artificial Sequence
  derived and/or modified sequence opt3 from hemagglutinin__InfluenzaA__ABG20472
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaaagcccacaaugggaaguuaugugaucuggacggagucaaaccccuaauucucagagauugcucaguggcggguuggcugcuuggcaacccuaugugugacgaguuccugaauguuccagaauggaguuauaucguggagaagauaaacccggcuaaugauuugugcuaccccgggaacuuuaaugacuaugaggaacucaagcaucugcugagcaggaucaaccacuucgagaaaauucagaucauuccuaaguccucuuggucggaucaugaagccucaagcggagucaguuccgcauguccauaccagggccggucuagcuuuuuccgcaaugugguauggcucaucaaaaaggacaacgccuaucccaccauaaaacgauccuacaauaacacaaaucaagaggauuuacugguucuuugggguauucaccacccuaacgacgcugcagagcagacucguuuguaucagaacccaaccacauacaucucaguggggaccaguacucugaaucagaggcuaguccccaagauugccacaagaagcaaggugaacggacaaucuggccggauggaauuuuucuggaccauccucaaaccuaaugaugcuaucaacuuugaguccaauggcaacuucauugccccagaaaaugcguacaagauagugaaaaagggggacucaacgaucaugaaaagcgagcuggaauauggaaacugcaauacuaagugucagaccccgauuggugcaaucaacaguucuaugcccuuucauaauauacacccucuuacaauuggcgagugcccaaaauacgucaaguccaaccgccugguuuuggccacugggcucagaaauagcccccagggagagaggcggcgcaagaaacgaggccuguucggugcuaucgccggguuuaucgaaggaggcuggcagggcaugguggacgggugguauggauaccaucacucgaacgagcaagguucuggcuaugcagcugauaaggaauccacccagaaagccauugacgggguaacaaauaaggugaacucaaucauugauaaaaugaacacccaguucgaggcggucggaagagaauuuaauaacuuagagaggcggauagagaaucugaacaagaagauggaagacggcuuccucgauguguggacguacaaugccgagcuucugguuuugauggaaaacgagcguacucuagacuuccacgauaguaaugugaaaaaccuguaugacaagguccgccuccaacugagagauaaugcaaaagaacuugguaacggguguuuugaguucuaccauaggugcgacaaugaguguauggaaagcgugcggaacggcacauacgauuauccucaguacuccgaggaagcucgacugaagcgcgaggagaucucuggaguaaaauuggaaagcauuggcaccuaucagauccucucaaucuacaguacuguugccuccagccuggcuuuagccauuaugguggcagggcugucucuauggaugugcucaaauggaagucuccagugcagaauauguaucuga

SEQ ID NO: 122977 - RNA, 1707 nt, Artificial Sequence
  derived and/or modified sequence opt3 from hemagglutinin__InfluenzaA__ABG20478
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucaaaccccugauucuaagagauugcucaguggccgguuggcuccugggcaacccuaugugugacgaauuucuuaauguuccagaauggaguuauaucguggagaagauaaacccggcgaaugaucugugcuaccccgggaacuucaaugacuaugaggaauugaagcaucuccugagcaggaucaaccacuuugagaaaauucagaucauuccuaaguccucuuggucggaucaugaagcuaguagcggagucaguuccgccuguccauaccagggccggucuagcuucuuucgcaaugugguauggcugaucaaaaaggacaacgcauaucccacaauaaaacgauccuacaauaacacuaaucaagaggaucucuuaguucugugggguauucaccacccuaacgacgccgcugagcagacccgucuuuaucagaacccaacaaccuacaucucaguggggacuucaacauugaaucagagacugguccccaagauugcaaccaggagcaaggugaacggacaaucuggccggauggaguucuuuuggacgauccuaaaaccuaaugaugccaucaacuucgaauccaauggcaacuuuauugcuccagaaaaugccuacaagauagugaaaaagggggacucaacuaucaugaaaagcgagcucgaauauggaaacugcaauaccaagugucagacaccgauuggugcgaucaacaguucuaugcccuuccauaauauacacccucugacuauuggcgagugcccaaaauacgucaaguccaaccgccuuguucuggcaaccggguugagaaauagcccccagggagagaggcggcgcaagaaacgaggccucuuuggugccaucgcuggguucaucgaaggaggcuggcagggcaugguggacgggugguauggauaccaucacucgaacgagcaagguucuggcuaugccgcagauaaggaauccacacagaaagcuauugacgggguaaccaauaaggugaacucaaucauugauaaaaugaacacgcaguuugaggccgucggaagagaguucaauaaccuggaaaggcggauagagaauuuaaacaagaagauggaagacggcuuccuggauguguggacuuacaaugcggagcuccuuguucugauggaaaacgagcguacauuggacuuucacgauaguaaugugaaaaaccuauaugacaagguccgccugcaacucagagauaaugccaaagaacuggguaacggguguuucgaguuuuaccauaggugcgacaaugaguguauggaaagcgugcggaacggcaccuacgauuauccucaguacuccgaggaagcacgacuuaagcgcgaggagaucucuggaguaaaacuggaaagcauuggcacuuaucagaucuugucaaucuacaguacaguugcuuccagccucgcccuggcuauuaugguggccggguuaucucuguggaugugcucaaauggaagucuacagugcagaauauguaucuga

SEQ ID NO: 122978 - RNA, 1701 nt, Artificial Sequence; identical to SEQ ID NO: 122799
  derived and/or modified sequence opt3 from hemagglutinin__InfluenzaA__ABG26758

SEQ ID NO: 122979 - RNA, 1701 nt, Artificial Sequence
  derived and/or modified sequence opt3 from hemagglutinin__InfluenzaA__ABG26769
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaaaauucuucaacagguagaaucugcgacaguccacacaggauucucgauggcaaaaacuguacccugaucgacgcucuacugggggauccgcauugcgacggauuucagaauaaggagugggauuuguucguggaacggagcaaagccuauuccaacuguuaccccuaugacgucccugauuacgcaucucuccgcucgcugguggccucaagcggcacucuggaguuuaauaacgaaaguuucaauuggacagguguugcucagaacgggaccuccuaugcaugcaagcgacguucugucaagagcuuuuucuccagacucaauugguuacacaaacuggaguacaaguauccagcccuuaacgugacgaugcccaauaacgacaaauuugauaaguuguacauauggggagugcaucacccuucaacugacagugaucagaccagccuguacguacaggcuucuggcaggguuacaguguccacuaaacggucacagcagaccgucaucccaaacauuggcagcgggcccugggugcgcggagugaguucuagaaucuccauuuauuggacaaucgucaagccuggugacauacuacucauuaauagcaccggcaaccugaucgccccaaggggguacuucaagauucggucgggaaaaucuuccaucaugcgcucagacgcgccgaucggcaauuguaacagugagugcauuacgcccaaugguagcauaccuaacgauaagccauuucaaaauguuaaccgaaucacuuauggggcaugucccagauacgugaaacagaauacacuuaagcuggccaccggaaugaggaacguaccugaaaaacagacucggggcauuuucggcgcuaucgccggguuuauagagaauggaugggaagguaugguggacggcugguauggguuccgucaccagaacuccgagggaacaggccaagcagcugauuugaagucuacccaggccgcgauuaaucagaucaacgguaaacucaaucgccugaucgagaagacgaacgaaaaguuucaucaaauugagaaagaguucagcgaagucgaagggagaauccaggacuuagagaaguacguggaggauaccaaaauugaccuguggucauauaacgccgaacuccuuguugcacuggagaaucagcacacaauagauuugacugacagugaaaugaacaagcuauucgagaggacccggaaacagcugcgagaaaaugcugaggauaugggcaacggaugcuuucgcaucuaccauaagugugacaaugccugcauuggcuccaucagaaacgggacauacgaucacgacguguauagggacgaggcucucaauaaccgguuccaaaucaagggagucgaacugaaaagcgguuacaaggauuggauucuuuggauaucuuuugccaucucaugcuuccuguugugugugguacuccugggcuuuauuaugugggcaugccagaaagggaauauccgcuguaacauuugcaucuga

SEQ ID NO: 122980 - RNA, 1701 nt, Artificial Sequence; identical to SEQ ID NO: 122927
  derived and/or modified sequence opt3 from hemagglutinin__InfluenzaA__ABG26780

SEQ ID NO: 122981 - RNA, 1701 nt, Artificial Sequence
  derived and/or modified sequence opt3 from hemagglutinin__InfluenzaA__ABG26791
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucaaggagcaacugucgucagugagcaguuuugaaagguucgagauuuuuccuaaggaguccucuuggccaaaucauacaguuaccaaaggugugacggcuagcugcucccacaacgggaagucaaguuucuacaaaaaucugcucugguuaacugaaaagaacggacuguaucccaaucuuagcaaaucuuacgucaacaauaaggagaaggaaguguugguacuguggggcguucaucacccuuccaacaucggcgaucagcgggcaauuuaccacaccgagaacgccuaugugucagucgugagcagucauuacucucgccgauuuacaccagaaaucgcuaaacgucccaaggugagagaccaggaggggaggauaaauuauuacuggacucuacucgagccuggagauaccaucauuuucgaagccaacgguaaucugaucgcgccaugguaugcauuugcccuuucccggggcuucgggagcggaauuaucacaucgaacgcuucuaugggcgagugugacgccaaaugccagaccccgcaaggugcaauaaauuccucacugcccuuucagaacguccacccuguuacgauuggggaauguccaaaguacgugcgcaguacuaaauugagaaugguaacaggacucaggaauauccccagcauucagucccggggccuguucggcgcuaucgccggguuuaucgagggagguuggaccggcaugauugaugggugguauggauaccaucaccagaacgaacaaggcucugguuacgcggccgacaagaaaagcacucagaaugcaauagaugggaucacaaacaaggucaauucagugauugagaagaugaacacccaguucacggcugugggcaaagaguucaauaaguuagaacgccgaauggagaaccugaauaaaaagguugacgauggauuucucgacaucuggaccuauaacgccgaacuucugguguugcuagagaacgaaagaacacuggacuuccacgauaguaaugucaaaaaccucuacgagaaggugaagaaucagcugaaaaacaaugcuaaggagauaggcaacgggugcuuugaguucuaucauaaauguaauaacgaaugcauggaauccguaaagaauggaacuuacgacuauccuaaauacagcgaggagucuaaacuuaagagggaaaagauugaugguguuaagcuggagucaaugggcguguaucaaaucuuggccaucuacaguaccgucgcaagcucccucgugcuguuagucucucugggggccauuucguuuuggaugugcagcaacggaucccuacagugucggaucugcauuuga

SEQ ID NO: 122982 - RNA, 1701 nt, Artificial Sequence
  derived and/or modified sequence opt3 from hemagglutinin__InfluenzaA__ABG26802
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcaaaaauuguacccucaucgacgcucugcuuggggauccgcauugcgacggauuucagaacgagaagugggaucuguucguggaacggucuaaagccuuuucgaauuguuaucccuacgacgucccugauuaugcaucauugcgcagccucguggccaguuccggcacucuggaguucauaaacgaagguuuuaauuggacagggguuacccagucuggaggcagcuacgcuugcaagcgaggcuccgugaacucauucuuuagucgucugaauuggcucuaugagagcgagucuaaguacccagcauuaaacgucacgaugcccaauaacgggaaauucgacaagcuguauaucuggggagugcaccauccuuccacugauaaagaacaaaccaaucuuuacguaagagccucagguaggguuacagugagcacuaagcggagucagcagaccgucauuccaaacaucggcccccgcccuugggugagaggguugucuuccaggauuagcaucuacuggacaauagugaaaccaggagacauucugcuaaucaacucgaccggcaaucucauugcuccgcgggguuauuuuaagauccgcacggggaagucuuccaucaugcgaucagaugcccccauuggaacuuguaguagcggcugcauaacaccuaacggcuccaucccaaaugacaaacccuuccagaacgucaauaagauuaccuacggggcguguccuagauauguuaaacaaaacacucugaaacuugcaacaggaaugaggaaugugccagagaaacagacccgggguaucuuuggcgccauagcuggguucauugaaaacggaugggagggcaugguagacgguugguacggguuucgucaccagaauagcgagggcacgggacaggccgcagaucugaagucuacccaagcugccaucgaccagaucaacggcaaauugaaucgccucauugaaaagacaaacgagaaguuccaccagaucgaaaaagaguucucagaaguggaggggaggauucaagaucuggagaaguaugucgaagacacuaaaauagauuuauggaguuacaaugcggagcugcucguggcccuugaaaaccagcauaccaucgacaugacagauuccgagaugaauaagcuguuugaaaagacuagaaagcaguugcgggagaacgcagaggacaugggaaacgguugcuucaagauuuaucacaaaugugauaaugcuugcaucggcagcauccgaaacgggaccuacgaccaugauguuuaccgcgacgaagcccuaaauaacagauuucagauuaagggaguggagcugaaaucuggcuauaaggacuggauacucuggaucucauucgcuauuaguugcuuucugcuuugugucgugcuguuggguuucaucaugugggccugccaaaaagggaauauuagguguaacaucugcauauga

SEQ ID NO: 122983 - RNA, 1701 nt, Artificial Sequence; identical to SEQ ID NO: 122931
  derived and/or modified sequence opt3 from hemagglutinin__InfluenzaA__ABG26813

SEQ ID NO: 122984 - RNA, 1701 nt, Artificial Sequence
  derived and/or modified sequence opt3 from hemagglutinin__InfluenzaA__ABG26824
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacaaccacaaugggaaacucugcaagcugaaaggaauagcuccccuucagcuggguaaguguucaaucgccggcuggauuuuggggaacccugagugcgaaagucucuucagcaagaaauccuggucuuauaucgcagagaccccaaauucggaaaacggaacauguuacccgggcuauuuugccgauuacgaggagcugagagaacaacugucaagcgucaguuccuucgagagguuugaaauuuuccccaaggagucuagcuggccuaaacauaaugugaccaaggguguuacugcuuccugcucacacaaagggaagaguagcuuuuaucggaaccucuuauggcugacagagaagaauggaucuuacccaaaccuuuccaaaucauaugugaauaacaaggaaaaagaggucuuggugcuguggggcguacaucaccccagcaauaucgaagaccagaagaccauauaccgcaaagagaacgcauacguuaguguggucucuucccacuauaaccgacguuucacgccugaaaucgccaagagaccaaaagugaggaaucaggagggccggauuaacuacuauuggacucuacucgagcccggggauaccaucauuuuugaagcuaauggaaaccugaucgccccuugguacgcguucgcacuuagccgcgguuuuggcucggggauaauuacaucuaaugccuccauggacgagugugaugcuaagugccagacuccacaaggagccaucaacucaagucugccguuccagaaugugcaucccgucaccauuggcgaauguccuaaguauguuagaagcacaaaauugaggauggugaccggucuccggaacaucccauccauccagucucgcgggcuguuuggagcaauugcuggcuucauagagggcggguggacgggaaugaucgacgguugguacggcuaucaccaucagaaugaacaagggagcggauacgccgcggaucagaagucaacucagaacgccauuaauggcaucacaaacaaaguaaauaguauaauugagaagaugaacacccaguuuacugcaguggguaaagaguucaauaaguuagaaaagcgaauggagaaccugaacaaaaaggucgacgauggguuccucgacaucuggacauacaaugcugaacuucugguguugcuagagaacgaaagaacccuggacuuucacgauuccaauguuaaaaaccucuaugagaaggugaaaagccaacugaagaauaacgccaaggagaucggcaauggaugcuucgaauuuuaccacaaauguaacaaugagugcauggaaucugucaagaacggcacguaugacuaccccaaauauucagaggagaguaaacuuaauagggaaaagauugauggggugaagcuggagagcaugggaguauaccagaucuuggcuauuuauuccaccguugccucuucgcucgugcuguuagucagccugggugcaauauccuucuggaugugcucaaacggcagucuacaguguaagaucugcauuuga

SEQ ID NO: 122985 - RNA, 1701 nt, Artificial Sequence; identical to SEQ ID NO: 122937
  derived and/or modified sequence opt3 from hemagglutinin__InfluenzaA__ABG26835

SEQ ID NO: 122986 - RNA, 1701 nt, Artificial Sequence
  derived and/or modified sequence opt3 from hemagglutinin__InfluenzaA__ABG26890
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagaauagcccaacagguagaaucugcgacucaccgcacaggauucucgauggcaaaaacuguacccugaucgacgcucuacugggggauccccauugcgacggauuucagaauaaggagugggauuuguucguggaacggaguaaagccuauagcaacuguuacccuuaugacgucccagauuacgcaucccuccgcucucugguggccucgucaggcacucuggaguuuacaaaugaaaacuucaauuggaccgguguugcucaggacgggaagucuuaugcaugcaagcgaggaagugugaacuccuuuuucucucgucucaauugguuacacaaacuggaguacaaguaucccgcccuuaacgucacgaugccuaauaacggcaaauuugauaaguuguacauauggggcgugcaucacccaagcacugacuccgaucaaaccucacuguacguaagagcuagugggaaaguuacagugagcacuaagaggucucagcagaccgucauccccgacauuggauaucggccuugggugcgcggucuauccucaagaaucagcauuuacuggacaaucgugaagccaggcgacauacuccugauuaacaguaccgggaaucuuaucgccccgaggggauauuucaaaauucggaacggcaagucuuccaucaugcgcagcgaugcgcccaucgguaauuguucgucugagugcauuacgccuaacggguccauaccaaaugacaaacccuuucagaacgucaaucgaaucacuuacggagcauguccuagauauguuaagcaaaacacacugaaauuggccaccggcaugaggaaugugccagaaaagcagacucggggcauuuucggggcuaucgccggauuuauagagaacgguugggaaggcaugguagaugggugguacggauuccgucaccaaaauucagagggcacaggucaggcagcugaccucaaaaguacccaggccgcgauugaucagaucaacgggaagcugaaucgcuuaguggagaagacgaacgaaaaauuucaucagaucgagaaggaguucagcgaagucgaaggcaggauucaagaccuggagaaauauguggaggauaccaagaucgaccucugguccuacaaugccgaacuucugguugcauuggagaaccagcacacaauugaucuaacugacucugaaaugaacaaacuguucgagagaacccggaagcagcuccgagaaaaugcugaggauaugggaaacggcugcuuuaagauauaccauaaaugugacaaugccugcaucgggagcauucgcaacggaacauaugaccacgauguguacagagacgaggcucugaauaacagguuccagaucaagggugucgaacuuaaaucaggcuauaaggauuggauccuguggauuaguuuugccauauccugcuucuugcucugugugguacuguuaggguuuaucaugugggcaugccaaaaaggaaauauucgguguaacaucugcauuuga

SEQ ID NO: 122987 - RNA, 1701 nt, Artificial Sequence
  derived and/or modified sequence opt3 from hemagglutinin__InfluenzaA__ABG26901
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaaaauucuccaacagguagaaucugcgacucaccgcacaggauucucgauggcaaaaacuguacccugaucgacgcucuacugggggauccccauugcgacggauuucagaauaaggagugggauuuguucguggaacggaguaaagccuauagcaacuguuacccuuaugacgucccagauuacgcaucccuccgcucucugguggccucgucaggcacucuggaguuuacaaaugaaaacuucaauuggaccgguguugcucaggacggaaagagcuauaguugcaagcgaggguccgugaacucuuucuucagccgucucaauugguuacacaaauccgaguacaaguaucccgcacugaacgucacgaugccuaauaacggcaaauuugauaaacuuuacauauggggcgugcaucacccaucaacugacagugaucagaccagcuuguacguaagagccucugggaagguuacaguguccacuaagaggucacagcagaccgucauccccgacauuggauaucggccuugggugcgcggucugagcaguagaaucucuauuuacuggacaaucgugaagccaggcgacauacuacucauuaacuccaccgggaaucugaucgcuccgaggggauauuucaaaauucggaacggcaagagcucgaucaugcgcucugaugcccccaucgguaauuguuccucagagugcauuacgccuaacgggaguauaccaaaugacaaacccuuucagaacgucaaucgaaucacuuacggagcguguccuagauauguuaagcaaaacacacuuaaacuggcaaccggcaugaggaaugugccagaaaagcagacucggggcauuuucggggccaucgcuggauuuauagagaacgguugggaaggcaugguagaugggugguacggauuccgucaccagaauagcgagggcacaggucaggccgcagacuugaaauccacccaagcugccauugaucagaucaacgggaagcucaaucgccugguggagaagacgaacgaaaaauuucaucagaucgagaaggaauuuucugaggucgaaggcaggauucaagacuuagagaaauauguggaggauaccaagaucgaccuguggagcuacaaugcggaacuccuuguugcccuggagaaccagcacacaauugauuugacugacucagaaaugaacaaacuauucgagagaacccggaagcagcugcgagaaaaugcagaggauaugggaaacggcugcuuuaagauauaccauaaaugugacaaugcuugcaucgggaguauucgcaacggaacauaugaccacgauguguacagagacgaggcccucaauaacagguuccagaucaagggugucgaacugaaauccggcuauaaggauuggauccuuuggauuagcuuugcuauaucuugcuuccuguugugugugguacuccugggguuuaucaugugggccugccaaaaaggaaauauucgguguaacaucugcauuuga

SEQ ID NO: 122988 - RNA, 1701 nt, Artificial Sequence
  derived and/or modified sequence opt3 from hemagglutinin__InfluenzaA__ABG26912
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaaggaagguuucaacuggaccgggguugcucaggacggaaaguccuaugcaugcaaacgaggcucugugaauagcuuuuucucccgucucaacugguuacacaagcuggaguacaaauauccagcccuuaaugucacgaugcccaacaaugauaaguuugacaaauuguacauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccaucuauuggacaauagugaagccuggcgacauucuacucaucaauagcaccgggaaccugauugccccaaggggauacuucaaaauccggaacggcaagucgucuaucaugcgcuccgaugcgccgauuucaaauuguaacagugagugcauaacgcccaaugguagcaucccuaacgacaaaccauuucaaaaugucaaccgaauuacuuauggggcaugucccagauacguuaagcagaauacacuuaaacuggccaccggaaugaggaacgugccugaaaagcagacucggggcaucuucggcgcuauagccggguuuauugagaauggaugggaagguaugguagauggcugguauggguuccgucaccagaacuccgagggaacaggccaagcagcugacuugaaaucuacccaggccgcgaucgaucagaucaaugguaagcucaaccgccugauugagaagacgaaugaaaaauuucaucaaaucgagaaggaguucagcgaaguggaagggaggauucaggacuuagagaaauacgucgaggauaccaagauagaccuguggucauauaacgccgaacuccuuguggcacuggagaaucagcacacaaucgauuugacugacagugaaaugaacaaacuauucgagagaacccggaagcagcugcgagaaaacgcugaggauaugggcaauggaugcuuuaagauuuaccauaaaugugacaacgccugcaucggcuccauccgcaaugggacauacgaccacgauguuuauagagacgaggcucucaacaauagguuccaaauuaagggaguggaacugaaaagcgguuacaaggauuggauacuuuggaucucuuuugccauuucaugcuuccuguugugugucgugcuccugggcuuuaucaugugggcaugccagaaagggaacauucgguguaauaucugcauauga

SEQ ID NO: 122989 - RNA, 1698 nt, Artificial Sequence
  derived and/or modified sequence opt3 from hemagglutinin__InfluenzaA__ABG26945
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucgggaaccagcgcgcccuguaccacacugagaaugcuuaugucuccguggugucaagccauuacagucgacguuucacccccgaaauagcaaagagaccuaaagucagggaucaggagggucggaucaacuauuacuggacacuucuggaaccaggcgacacuauuaucuuugaggccucugggaauuugauugcuccgugguaugccuucgcgcucucccgcggauuuggcagcgguaucauaaccucgaacgcacccaugggggagugugaugccaagugccagacaccucaaggagcuauuaauucuucccugccauuccagaacguucaccccgugaccaucggcgaauguccuaaguacguaagaucagccaaauuaaggauggugacgggccugcggaauauuccaaguauccagagccgcgggcucuuuggagcaaucgcugguuucauugagggcggguggacuggaauggucgacggcugguaugguuaccaucaccagaacgaacaaggguccggcuacgccgcggaucagaagucuacacagaaugccauaaacggaaucaccaauaaagugaacagcguuauugagaagaugaauacucaguuuacagcagugggcaaagaguucaacaagcuagaacgaagaauggagaaucugaacaaaaaggucgacgauggguucuuggacaucuggaccuauaacgcugaacuacuggugcuccuggagaaugaaaggacgcuugauuuucacgacucaaacguaaagaaucuguacgagaaaguuaagagucaauugaaaaacaaugccaaggaaauaggaaacgguugcuucgaguuuuaucauaaauguaauaacgagugcauggaauccgugaagaauggcaccuacgacuaucccaaguacagcgaggaaucuaaacucaaccgggagaagauugauggggucaaacuggagucaaugggaguguaucagaucuuagcuaucuacaguacagucgccagcucccuggugcuacucguuucucugggcgcaauuucguucuggaugugcagcaaugguucccuucagugucguaucugcauuuga

SEQ ID NO: 122990 - RNA, 1701 nt, Artificial Sequence
  derived and/or modified sequence opt3 from hemagglutinin__InfluenzaA__ABG26956
augaagaccaucauugcccugagcuacauacucugccuuguguucgcucagaaacugcccggcaacgacaauagaacagcaacuuuguguuuagggcaccaugccgucccuaacggaacgcugguuaagaccaucacaaaugaucaaauugaggugacuaacgcgaccgaacugguacaguccucuucaacagguaggaucugcgacaguccacaccagauucucgauggcgagaauuguacccugaucgacgcccuucugggggauccgcauugcgacggauuucagaacaaagaaugggauuuguucguggagcggagcaaggcuuauuccaauuguuaccccuaugacgucccugauuacgugucucuccgcucgcugguugcaucaagcggcacucuggaauuuaacaaugagaguuucaacuggacagguguggcccaaaaugggaccuccucugcuugcaaacgacguagcgacaaguccuuuuucucaaagcucaacugguuacaccagcugaaauauaaguacccagcacuuaaugucacgaugcccaacaaugagaaauuugauaaguuguauauauggggagugcaucacccuggcacugacagugaucagaucagccuguacgcccaggcuucuggcagaguaaccguuuccacaaaaaggucacaacagacugugauuccaaacaucgggagccggcccuggguccgcggagugaguucuagaauuuccaucuacuggaccauagugaagccuggugacauucuacucaucaacagcacaggcaaucugauugccccaaggggguauuucaagauccggucgggaaaaucuuccaucaugcgcucagacgcgccgauuggcaaguguaacagugaaugcauaacccccaaugguagcaucccuaacgauaaaccauuucagaaugucaaccgaauuacguacggggcaugucccagauauguuaagcagaauacucuuaaacuggccacaggaaugaggaacgugccugagaagcaaacccggggcaucuucggcgcuauagccggguuuauugaaaauggaugggaggguaugauggacggcugguacggguuccgucaccagaacuccgagggaacuggccaggcagcugauuugaaaucuacacaagccgcgaucaaucagaucaacgguaagcucaaucgccugauugaaaagaccaacgagaaauuucaucagaucgaaaaggaguucagcgaaguagaggggaggauucaggacuuagagaaauauguggaagauacgaagauagaccuguggucauacaaugccgagcuccuugucgcacuggaaaaccaacacaccaucgauuugacagacagugagaugaacaaacuauucgaaagaacuaagaagcagcugcgggagaaugcugaggauaugggcaacggaugcuuuaaaauuuaucauaagugugacaaugccugcaucggcuccauccgaaacgggaccuacgaucacgacguguaccgcgacgaagcucucaauaacagauuccagauuaaaggaguugagcuaaagagcgguuauaaagauugggugcuuuggauaucuuuugccaucucaugcuuccuguuguguauuguccuccugggcuuuaucaugugggcaugccagaaggggaauauuagguguaacaucugcauauga

SEQ ID NO: 122991 - RNA, 1698 nt, Artificial Sequence
  derived and/or modified sequence opt3 from hemagglutinin__InfluenzaA__ABG37120
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggagagucaaguuuuuaccggaauuuacuguggcuuacgggcaagaacggcuuguaucccaaucugagcaugucuuacgugaacaauaaagaaaaggaggugcuaguucucuggggagugcaucacccuccaaacaucgggaaccagcgcgcccuguaccacacugaaaaugcuuaugucuccguggugucaagccauuacagucgacguuucacccccgagauagcaaaaagaccuaaggucagggaucaggaaggucggaucaacuauuacuggacacuucuggagccaggcgacacuauuaucuuugaggccaaugggaacuugauugcuccgugguaugccuucgcgcucucucgcggauuuggcuccgguaucauaaccagcaaugcacccaugggggaaugugaugccaaaugccagacaccucaaggagcuauuaacucgucucugccauuccagaauguucaccccgugaccaucggcgaguguccuaaguacguaagauccgccaaguuaaggauggugacgggccugcggaacauuccaucaauccagagucgcgggcucuuuggagcaaucgcugguuucauugaaggcggguggacuggaauggucgacggcugguaugguuaccaucaccagaaugagcaagggagcggcuacgccgcggaucagaaauccacacagaacgccauaaauggaaucaccaacaagguaaauucuguuauugaaaagaugaacacucaguuuacagcagugggcaaagaguucaauaaacuugagcgaagaauggaaaaccugaacaagaaagucgacgauggguucuuggacaucuggaccuauaaugcugagcuacuggugcuccuggaaaacgagaggacgcuugauuuucacgacagcaauguaaagaaccuguacgaaaagguuaaaucacaauugaagaauaacgccaaagagauaggaaaugguugcuucgaguuuuaucauaaguguaacaaugaaugcauggagagugugaaaaacggcaccuacgacuaucccaaguacuccgaagagagcaagcucaaucgggagaaaauugauggggucaagcuggaaucuaugggaguguaucagaucuuagcuaucuacucaacagucgccaguagccuggugcuacucguuucccugggcgcaauuucuuucuggaugugcucgaacgguagccuucagugucguaucugcauuuga

SEQ ID NO: 122992 - RNA, 1701 nt, Artificial Sequence
  derived and/or modified sequence opt3 from hemagglutinin__InfluenzaA__ABG37131
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacggcccacaccagauucuagaugggaaaaauuguacccucaucgacgcucugcuuggagauccgcauugcgacggcuuucagaacaaggagugggaucuguucguggaaagguccaaagccuauucuaauuguuaccccuaugacgucccugauuacgcaucguugcggucacucguggccagcagugguacucuggaguuuacaaacgaauccuucaauuggaccgggguugcucaaaacggaacgucuuaugcaugcaagcgcggcagcgugaaguccuuuuucucacgacugaauuggcuccacaaauuagaguacaaguauccagcccugaacgucacuaugcccaauaacgacaaauuugauaagcuguacauauggggcgugcaucacccuaguaccgacagcgaucagacaucuuuguacguacaguccucagggcguguuacugugagcaccaaaagaagucagcaaacagucaccccaaauaucggaucuaggcccugggugcgggguauuuccagccgcaucucgauuuauuggacgaucgugaagccuggcgacauacugcuaauuaacucuacugggaaccucaucgcuccaagaggauacuucaagauuaggcggggcaaauccucaaucaugcgcagugacgccccgaucgauaauuguaacagcgagugcauuacacccaaugguuccauaccuaacgacaagccauuucagaaugucaaccgaaucaccuauggggcgugucccagauacguuaaacagaauacucugaaacuugcaacaggaaugaggaacgugccugaaaagcagacccggggcauuuucggcgccaucgcuggguuuauagagaauggaugggaagguaugguagauggcugguauggguuccgucaccaaaacucugagggaacgggccaggccgcagaccuuaagagcacccaggcugccauuaaucaaaucaacgguaaauugaaucgccucaucgagaagacaaacgaaaaguuucaucagauugagaaagaguucucagaaguggaagggagaauccaggaucuggagaaguacgucgaggacacuaaaauugauuuauggaguuauaaugcggaacugcucguggcccuugagaaccagcacaccauagaccugacagauuccgaaaugaacaaguuguucgagaggacucggaaacaacuacgagaaaaugcagaggacaugggcaacggaugcuuuaagaucuaccauaagugugauaaugcuugcauuggcagcauccgcaacgggaccuacgaccacgacguuuauagagaugaggcccugaauaacagguuccagaucaaaggaguggaacucaagucugguuacaaagacuggauucuguggauaucauuugcuaucaguugcuuccuucugugugucguguugcucggcuuuauuaugugggccugccagaaggggaauauccgguguaacauuugcaucuga

SEQ ID NO: 122993 - RNA, 1701 nt, Artificial Sequence; identical to SEQ ID NO: 122799
  derived and/or modified sequence opt3 from hemagglutinin__InfluenzaA__ABG37142

SEQ ID NO: 122994 - RNA, 1701 nt, Artificial Sequence
  derived and/or modified sequence opt3 from hemagglutinin__InfluenzaA__ABG37164
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacgauuuucagaacaaggagugggacuuguucguggaacgguccaaagccuauucuaauuguuaccccuaugaugucccugacuacgcaucgcuccgcucacugguggccagcaguggaacucuggaguuuacaaaggaaggcuucaacuggaccgguguugcucaggaugggaaguccuaugcaugcaaacgaggaucugugaauagcuuuuucucccgucucaacugguuacacaagcuggaguacaaauauccagcccuuaaugucacgaugcccaacaaugacaaguuugauaaauuguacauauggggcgugcaucacccuucaacugacagugaccaaaccagccuguacguacaggcuucuggcagaguuacaguguccacuaagaggucacagcagaccgucaucccaaacauugggagccggcccugggugcgcggaaucaguucuagaauuuccaucuauuggacaauagugaagccuggugauauucuacucaucaauagcaccggcaaccugauugccccaaggggguacuucaaaauccggaacggaaagucgucuaucaugcgcuccgacgcgccgauuggcaauuguaacucagagugcauaacgcccaaugguaguaucccuaacgauaaaccauuucaaaaugucaaccgaauuacuuauggggcaugucccagauacguuaagcagaauacacuuaaacuggccaccggaaugaggaacgugccugaaaagcagacucggggcaucuucggcgcuauagccggguuuauugagaauggaugggaagguaugguagacggcugguauggguuccgucaccagaacagcgagggaacaggccaagcagcugauuugaaauccacccaggccgcgaucgaccagaucaaugguaagcucaaccgccugauugagaagacgaaugaaaaauuucaucaaaucgagaaggaguucucugaaguggaagggaggauucaggauuuagagaaauacgucgaggacaccaagauagaucuguggagcuauaacgccgaacuccuuguggcacuggagaaucagcacacaaucgacuugacugauucagaaaugaacaaacuauucgagagaacccggaagcagcugcgagaaaacgcugaggacaugggcaauggaugcuuuaagauuuaccauaaaugugacaacgccugcaucggcaguauccgcaaugggacauacgaucacgacguuuauagagaugaggcucucaacaauagguuccaaauuaagggaguggaacugaaauccgguuacaaggacuggauacuuuggaucagcuuugccauuucuugcuuccuguugugugucgugcuccugggcuuuaucaugugggcaugccagaaagggaacauucgguguaauaucugcauauga

SEQ ID NO: 122995 - RNA, 1701 nt, Artificial Sequence
  derived and/or modified sequence opt3 from hemagglutinin__InfluenzaA__ABG37175
augaagaccaucauugcccugagcuacauacucugccagguguucgcuaaaaagcugcccggcaacgacaauuccacagcaacucuuuguuuggggcaccaugccgucccuaacggaacguuaguuaaaaccaucacaaaugaucaaauugaggugacuaacgcgaccgaacugguacagucuucaaguacagguagaaucugcgacagcccacacaggauucuagauggcaagaauuguacccucaucgacgcucugcuuggggauccgcauugcgacggauuucagaacaaagagugggaucuguucguggaacgguccaaggccuauucuaauuguuaccccuaugacgucccugauuacgcaucguugcgcucacucguggccagcaguggcacucuggaguuuacaaacgaagguuucaauuggaccgggguugcucaggacggaaaguccuauucuugcaaacgaggcagcgugaacuccuuuuucucacgucugaauuggcuccacaaguuagaguacaaauauccagcacugaacgucacgaugcccaauaacgauaaguuugacaaacuuuacauauggggcgugcaucacccuaguacugauagcgaccaaaccucuuuguacguacaggccuccgggagaguuacagugucaacuaagaggagccagcagaccgucaucccaaauauuggaagucggcccugggugcgcgguaucucuuccagaauuagcaucuauuggacaauagugaagccuggcgacauucugcuaaucaacucgaccgggaaccucauugcuccaaggggauacuucaaaauccggaauggcaagucuuccaucaugcgcucagaugccccgauugacaacuguaauagugagugcauaacgcccaacgguagcaucccuaaugauaaaccauuucaaaacgucaaucgaauuacuuauggggcgugucccagauacguuaagcagaacacacugaaacuugcaaccggaaugaggaaugugccugaaaagcagacucggggcaucuucggcgccauagcuggguuuauugagaacggaugggaagguaugguagacggcugguauggguuccgucaccaaaauuccgagggaacaggccaggccgcagaucugaaaucuacccaggcugccaucgaccagaucaacgguaaguugaaucgccucauugagaagacgaacgaaaaauuucaucaaaucgagaaggaguucagcgaaguggaagggaggauucaggaucuggagaaauacgucgaggacaccaagauagauuuauggucauauaaugcggaacugcucguggcccuugagaaccagcacacaaucgaccugacugauagugaaaugaacaaauuguucgagagaacccggaagcagcuacgagaaaaugcagaggacaugggcaacggaugcuuuaagauuuaccauaaaugugacaaugcuugcaucggcuccauccgcaacgggacauacgaucacgacguuuauagagaugaggcccugaauaacagguuccaaauuaagggaguggaacucaaaagcgguuacaaggacuggauacuguggaucucuuuugcuauuucaugcuuccuucugugugucguguugcucggcuuuaucaugugggccugccagaaagggaauauucgguguaacaucugcauauga

SEQ ID NO: 122996 - RNA, 1701 nt, Artificial Sequence
  derived and/or modified sequence opt3 from hemagglutinin__InfluenzaA__ABG37186
augaagaccaucauugcccugagcuacauacucugccagguguucgcucaaaaacuucccggcaacgacaauuccacagcaacucuguguuuggggcaccaugccgucccuaacggaacguuaguuaagaccaucacaaaugaucagauugaggugacuaacgcgaccgaacugguacagucuucaaguacagguagaaucugcgacagcccacacaggauucuagauggcaaaaauuguacccucaucgacgcucugcuuggggauccgcauugcgacggauuucagaacaaggagugggaucuguucguggaacgguccaaagccuauucuaauuguuaccccuaugacgucccugauuacgcaucguugcgcucacucguggccagcaguggcacucuggaguuuacaaacgaagguuucaauuggaccgggguugcucaagacggaaaguccuaugcaugcaagcgaggcucugugaacagcuuuuucucccgucugaauuggcuccacaaauuagaguacaaguauccagcccugaacgucacgaugcccaauaacgauaaauuugacaaacuuuacauauggggcgugcaucacccuucaacugauagugaccagaccagcuuguacguacaggcuucugggagaguuacaguguccacuaagaggucacagcaaaccgucaucccaaauauuggaagccggcccugggugcgcgguaucaguucuagaauuuccaucuauuggacaauagugaagccuggcgacauucugcuaaucagcucgaccgggaaccucauugccccaaggggauacuucaagauccggaacggcaaaucuuccaucaugcgcucagaugcgccgauugacaauuguaacagugagugcauaacgcccaaugguagcaucccuaacgauaagccauuucagaaugucaaccgaguuacuuauggggcaugucccagauacgugaaacagaauacacugaaacuugccaccggaaugaggaacguaccugaaaagcagacucggggcauuuucggcgcuaucgccggguuuauagagaauggaugggaagguaugguggacggcugguauggguuccgucaccaaaacuccgagggaacaggccaggcagcugaucugaagucuacccaggccgcgauugaccaaaucaaugguaaauugaaccgccucaucgagaagacgaaugaaaaguuucaucagauugagaaagaguucagcgaagucgaagggagaauccaggaucuggagaaguacguggaggacaccaaaauugauuuauggucauauaacgccgaacugcucguugcacuugagaaucagcacacaauagaccugacugauagugaaaugaacaaguuguucgagaggacccggaaacaacuacgagaaaacgcugaggacaugggcaauggaugcuuuaagaucuaccauaagugugacaacgccugcauuggcuccauccgcaaugggacauacgaucacgacguguauaaagaugaggcucugaacaauagauuccagaucaagggagucgugcucaaaagcgguuacaaggacuggauucuguggauaucuuuugccaucucaugcuuccuucuguguguaguuuugcucggcuuuauuaugugggcaugccagaaagggaacaucagguguaauauuugcaucuga

SEQ ID NO: 122997 - RNA, 1701 nt, Artificial Sequence
  derived and/or modified sequence opt3 from hemagglutinin__InfluenzaA__ABG37197
augaagaccaucauugcccugagcuacauacucugccagguguucgcucaaaaacuucccggcaacgacaauuccacagcaacucuguguuuggggcaccaugccgucccuaacggaacguuaguuaagaccaucacaaaugaucagauugaggugacuaacgcgaccgaacugguacagucuucaaguacagguagaaucugcgacagcccacacaggauucuagauggcaaaaauuguacccucaucgacgcucugcuuggggauccgcauugcgacggauuucagaacaaggagugggaucuguucguggaacgguccaaagccuauucuaauuguuaccccuaugacgucccugauuacgcaucguugcgcucacucguggccagcaguggcacucuggaguuuacaaacgaagguuucaauuggaacgggguugcucaagacggaaaguccuaugcaugcaagcgaggcucugugaaauccuuuuucagccgucugaauuggcuccacaaguuagaguacaaauauccagcccugaacgucaccaugcccaauaacgauaaguuugacaaacuuuacauauggggcgugcaucacccuucaacggauagugaccagacuagcuuguacguacaggcuucugggagaguuaccguguccacaaagaggucacagcaaacugucaucccaaauauuggaagccggcccugggugcgcgguaucaguucuagaauuuccaucuauuggaccauagugaagccuggcgacauucugcuaaucaacagcacagggaaccucauugccccaaggggauacuucaaaauccggaauggcaagucgucuaucaugcgcuccgaugcgccgauugacaacuguaauucagagugcauaacccccaacgguaguaucccuaaugauaaaccauuucagaacgucaaucgaauuacguauggggcaugucccagauacguuaagcagaacacucugaaacuugccacaggaaugaggaaugugccugaaaagcagacccggggcaucuucggcgcuauagccggguuuauugagaacggaugggaagguaugguagacggcugguauggguuccgucaccaaaauagcgagggaacuggccaggcagcugaucugaaauccacacaggccgcgaucgaccaaaucaacgguaaguugaaucgccucauugagaagaccaacgaaaaauuucaucagaucgagaaggaguucucugaaguggaagggaggauucaggaucuggagaaauacgucgaggacacgaagauagauuuauggagcuauaaugccgaacugcucguggcacuugagaaccagcacaccaucgaccugacagauucagaaaugaacaaauuguucgagagaacucggaagcaacuacgagaaaaugcugaggacaugggcaacggaugcuuuaagauuuaccauaaaugugacaaugccugcaucggcaguauccgcaacgggaccuacgaucacgacguuuauagagaugaggcucugaauaacagguuccagauuaagggaguggaacucaaauccgguuacaaggacuggauacuguggaucagcuuugccauuucuugcuuccuucugugugucguguugcucggcuuuaucaugugggcaugccagaaagggaauauucgguguaacaucugcauauga

SEQ ID NO: 122998 - RNA, 1701 nt, Artificial Sequence
  derived and/or modified sequence opt3 from hemagglutinin__InfluenzaA__ABG37208
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcaaaaauuguacccucaucgacgcucugcuuggggauccgcauugcgacggauuucagaacgagaagugggaucuguucguggaacggucuaaagccuuuucgaauuguuaucccuacgacgucccugauuaugcaucauugcgcagccucguggccaguuccggcacucuggaguucauaaacgaagguuuuaauuggacagggguuacccagucuggaggcagcuacgcuugcaagcgaggcuccgugaacucauucuuuagucgucugaauuggcucuauaagagcgagucuaaauacccagcauuaaacgucacgaugcccaauaacgggaaguucgacaaacuguauaucuggggagugcaccauccuuccacugauaaggagcaaaccaaucuuuacguaagagccucagguaggguuacagugagcacuaaacggagucagcagaccgucauuccaaacaucggcccccgcccuugggugagaggguugucuuccaggauuagcaucuacuggacaauagugaagccaggagacauucugcuaaucaacucgaccggcaaucucauugcuccgcgggguuauuuuaagauccgcacggggaaaucuuccaucaugcgaucagaugcccccauuggaacuuguaguagcggcugcauaacaccuaacggcuccaucccaaaugacaagcccuuccagaacgucaauaaaauuaccuacggggcguguccuagauauguuaagcaaaacacucugaaacuugcaacaggaaugaggaaugugccagaaaagcagacccgggguaucuuuggcgccauagcuggguucauugagaacggaugggaaggcaugguagacgguugguacggguuucgucaccaaaauucugagggcacgggacaggccgcagaucugaaaagcacccaggcugccaucgaccagaucaacggcaaguugaaucgccucauugagaagacaaacgaaaaauuccaccagaucgagaaggaguucucagaaguggaagggaggauucaagaucuggagaaauaugucgaggacacuaagauagauuuauggaguuacaaugcggaacugcucguggcccuugagaaccagcauaccaucgacaugacagauuccgaaaugaauaaacuguuugagaagacuagaaagcaguugcgggaaaacgcagaggacaugggaaacgguugcuucaaaauuuaucacaagugugauaaugcuugcaucggcagcauccgaaacgggaccuacgaccaugauguuuaccgcgacgaggcccuaaauaacagauuucagauuaaaggaguggaacugaagucuggcuauaaagacuggauacucuggaucucauucgcuauuaguugcuuucugcuuugugucgugcuguuggguuucaucaugugggccugccaaaaggggaauauuagguguaacaucugcauauga

SEQ ID NO: 122999 - RNA, 1701 nt, Artificial Sequence
  derived and/or modified sequence opt3 from hemagglutinin__InfluenzaA__ABG37230
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacaccaaucaaaauacaaguauccagagcugaacgucaccaugcccaauaacggcaaauuugacaaacuuuacaucuggggcgugcaucacccuaguacggauagcgaccagacuucuuuguacgccagagcuuccgggaggguaaccguuucaacaaagcggagccagcagacugugauuccaaauaucggauuccgccccugggucagaggucugaguucuaggauuuccaucuauuggaccauagugaagccuggcgacauucuacucaucaacagcacagggaaccugauugccccacggggauacuuuaagauccgcaauggcaaaucgucuaucaugcgauccgaugcgccgauugguaacuguucaagugagugcauaacccccaaugggagcaucccuaacgacaagccauuccaaaaugugaacagaauuacguauggagcaugucccagguacgucaaacagaauacucuuaagcuggccacaggcaugcggaacguuccugaaaaacagacccguggcaucuuuggggcuauagccggauucauugagaaugguugggaaggcaugguggaugggugguauggauuucgccaccagaacuccgagggcacuggucaagcagcugacuugaagucuacacaggccgcgaucgaucagaucaaugggaaacucaacagacugauugagaagaccaaugaaaaguuccaucaaaucgagaaagaguucagcgaaguagaaggcaggauucaggacuuagagaaguacguggaggauacgaaaauagaccuguggucauauaacgccggacuccuugucgcacuggaaaaucagcacaccaucgauuugacagacagugagaugaacaagcuauuugaacggacucgaaaacagcugcgcgagaacgcugaagauaugggcaaugggugcuucaagauuuaccauaagugugacaacgccugcaucggauccaucagaaaugguaccuacgaccacgauguguauagggacgaggcucucaacaaucgguuucaaauuaaaggcguugagcuuaagagcggguacaaagauuggauacuuuggaucucuuucgccauuucaugcuuucuguugugugugguccuccugggauucaucaugugggcaugccagaagggcaacauucgcuguaauaucugcauauga

SEQ ID NO: 123000 - RNA, 1701 nt, Artificial Sequence
  derived and/or modified sequence opt3 from hemagglutinin__InfluenzaA__ABG37241
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcgacaguccgcacaggauucucgauggcaaaaauuguacccugaucgacgcucuacugggggauccccauugcgacggauuucagaacaaggagugggauuuguucguggaacggagcaaagccuauuccaauuguuacccuuaugacgucccagauuacgcaucucuccgcucgcugguggccucaagcggcacucuggaguuuacaaacgaaaauuucaacuggaccgguguugcucaggacgggaagaguuaugcaugcaagcgaggauccgugaauagcuuuuucucucgucucaacugguuacacaaacuggaguacaaguaucccgcccuuaaugucacgaugccuaacaauggcaaauuugauaaguuguacauauggggcgugcaucacccauccacugacucagaucaaaccagucuguacguaagagcuagcgggaaaguuacagugucuacuaagaggucccagcagaccgucauccccgacauuggauaucggccuugggugcgcggucuaucaagcagaaucaguauuuacuggacaaucgugaagccaggcgacauacuccugauuaacucuaccgggaaccuuaucgccccgaggggauauuucaaaauucggaauggcaaguccagcaucaugcgcucggaugcgcccaucgguaacuguucuuccgagugcauuacgccuaaugggucaauaccaaacgacaaacccuuucagaaugucaaccgaaucacuuacggagcauguccuagauauguuaagcaaaauacacugaaauuggccaccggcaugaggaacgugccagaaaagcagacucggggcauuuucggggcuaucgccggauuuauagagaaugguugggaaggcaugguagaugggugguacggauuccgucaccagaacagugagggcacaggucaggcagcugaccucaaaagcacccaagccgcgauugaucagaucaaugggaagcugaaccgcuuaguggagaagacgaaugaaaaauuucaucagaucgagaaggaguucuccgaagucgaaggcaggauucaagaccuggagaaauauguggaggauaccaagaucgaccucuggucuuacaacgccgaacuucugguugcauuggagaaucagcacacaauugaucuaacugacagcgaaaugaacaaacuguucgagagaacccggaagcagcuccgagaaaacgcugaggauaugggaaauggcugcuuuaagauauaccauaaaugugacaacgccugcaucgggucaauucgcaauggaacauaugaccacgauguguacagagacgaggcucugaacaauagguuccagaucaagggugucgaacuuaaaaguggcuauaaggauuggauccuguggauuuccuuugccauaagcugcuucuugcucugugugguacuguuaggguuuaucaugugggcaugccaaaaaggaaacauucgguguaauaucugcauuuga

SEQ ID NO: 123001 - RNA, 1701 nt, Artificial Sequence
  derived and/or modified sequence opt3 from hemagglutinin__InfluenzaA__ABG37252
augaagaccaucauugcccugagcuacauacucugccuuguguucgcucagaaacugacaggcaacgacaauuccacugcaacguuguguuuagggcaccaugccguccccaacggaacccugguuaagacaaucacuaaugaucaaauugaggugaccaacgcgacagaacuuguacagucuucaccuaccgguagaaucugcgacaguccacacaggauucucgauggcaaaaauuguacucugaucgacgcucuacugggggauccgcauugcgacggauuucagaacaaggagugggauuuguucguggaacggagcaaagccuauuccaauuguuaccccuaugacgucccugauuacgcaucucuccgcucgcugguggccucaagcggcacacuggaguuuaccaacgaaaauuucaacuggacggguguugcucaggacgggaagaguuaugcaugcaagcgaggauccgugaauagcuuuuucucucgucucaacugguuacacaaacuggaguacaaguauccagcccuuaaugucacuaugcccaacaauggcaaauuugauaaguuguacauauggggcgugcaucacccuuccaccgacucagaucaaacaagucuguacguaagagcuagcgggaaaguuacugugucuaccaagaggucccagcagacagucaucccagacauuggauaucggcccugggugcgcggucuaucaagcagaaucaguauuuacuggaccaucgugaagccuggcgacauacuccugauuaacucuacggggaaccuuaucgccccaaggggauauuucaaaauucggaauggcaaguccagcaucaugcgcucggaugcgccgaucgguaacuguucuuccgagugcauuacucccaaugggucaauaccuaacgacaaaccauuucagaaugucaaccgaaucacauacggagcaugucccagauauguuaagcaaaauacccugaaauuggccacuggcaugaggaacgugccugaaaagcagacacggggcauuuucggggcuaucgccggauuuauagagaaugguugggaaggcaugguagaugggugguacggauuccgucaccagaacagugagggcaccggucaggcagcugaccucaaaagcacgcaagccgcgauugaucagaucaaugggaagcugaaccgcuuaguggagaagaccaaugaaaaauuucaucagaucgagaaggaguucuccgaagucgaaggcaggauucaagaccuggagaaauauguggaggauacaaagaucgaccucuggucuuacaacgccgaacuucugguugcauuggagaaucagcacacuauugaucuaaccgacagcgaaaugaacaaacuguucgagagaacacggaagcagcuccgagaaaacgcugaggauaugggaaauggcugcuuuaagauauaccauaaaugugacaacgccugcaucgggucaauucgcaauggaacuuaugaccacgauguguacagagacgaggcucugaacaauagguuccagaucaagggugucgaacuuaaaaguggcuauaaggauuggauccuguggauuuccuuugccauaagcugcuucuugcucugugugguacuguuaggguuuaucaugugggcaugccaaaaaggaaacauucgguguaauaucugcauuuga

SEQ ID NO: 123002 - RNA, 1701 nt, Artificial Sequence
  derived and/or modified sequence opt3 from hemagglutinin__InfluenzaA__ABG37263
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaaggaagguuucaacuggaccgggguugcucaggacggaaaguccuaugcaugcaaacgaggcucugugaauagcuuuuucucccgucucaacugguuacacaagcuggaguacaaauauccagcccuuaaugucacgaugcccaacaaugauaaguuugacaaauuguacauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccaucuauuggacaauagugaagccuggcgacauucuacucaucaauagcaccgggaaccugauugccccaaggggauacuucaaaauccggaacggcaagucgucuaucaugcgcuccgaugcgccgauugguaauuguaacucagagugcauaacgcccaaugggaguaucccuaacgacaaaccauuucaaaaugucaaccgaauuacuuauggagcaugucccagauacguuaagcagaauacacuuaaacuggccaccggcaugaggaacgugccugaaaagcagacucggggcaucuucggggcuauagccggauuuauugagaaugguugggaaggcaugguagaugggugguauggauuccgucaccagaacagcgagggcacaggucaagcagcugacuugaaauccacccaggccgcgaucgaucagaucaaugggaagcucaaccgccugauugagaagacgaaugaaaaauuucaucaaaucgagaaggaguucucugaaguggaaggcaggauucaggacuuagagaaauacgucgaggauaccaagauagaccuguggagcuauaacgccgaacuccuuguggcacuggagaaucagcacacaaucgauuugacugacucagaaaugaacaaacuauucgagagaacccggaagcagcugcgagaaaacgcugaggauaugggaaauggcugcuuuaagauuuaccauaaaugugacaacacaugcaucgggaguauccgcaauggaacuuacgaccacgauguuuauagagacgaggcccucaacaauagguuccaaauuaaggguguggaacugaaauccggcuacaaggauuggauacuuuggaucagcuuugcuauuucuugcuuccuguugugugucgugcuccugggguuuaucaugugggccugccagaaaggaaacauucgguguaauaucugcauauga

SEQ ID NO: 123003 - RNA, 1701 nt, Artificial Sequence
  derived and/or modified sequence opt3 from hemagglutinin__InfluenzaA__ABG37274
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcgacaguccgcacaggauucucgauggcaaaaauuguacccugaucgacgcucuacugggggauccccauugcgacggauuucagaacaaggagugggauuuguucguggaacggagcaaagccuauuccaauuguuacccuuaugacgucccagauuacgcaucucuccgcucgcugguggccucaagcggcacucuggaguuuacaaacgaaaauuucaacuggaccgguguugcucaggacgggaagaguuaugcaugcaagcgaggauccgugaauagcuuuuucagccgucucaacugguuacacaaacuggaguacaaguaucccgcccuuaaugucacgaugccuaacaauggcaaauuugauaaguuguacauauggggcgugcaucacccauccacugacucagaucaaaucagucuguacguaagagcuagcgggaaaguuaccgugucuacaaagaggucccagcagacugucauucccgacaucggauaucggccuugggugcgcggucuaucaagcagaauuaguaucuacuggaccauagugaagccaggcgacauucuccugaucucuuccacagggaaccuuauugccccgaggggauauuucaaaauccggaacggcaagagcucgaucaugcgcucugaugcgcccauugguaauuguuccucagagugcauaaccccuaacgggaguaucccaaaugacaaacccuuucagaacgucaaucgaauuacguacggagcauguccuagauauguuaagcaaaacacucugaaauuggccacaggcaugaggaaugugccagaaaagcagacccggggcaucuucggggcuauagccggauuuauugagaacgguugggaaggcaugguagaugggugguacggauuccgucaccagaauagcgagggcacuggucaggcagcugaccucaaauccacacaagccgcgaucgaucagaucaacgggaagcugaaucgcuuaguggagaagaccaacgaaaaauuucaucagauugagaaggaguucucugaagucgaaggcagaauccaagaccuggagaaauauguggaggauacgaagauugaccucuggagcuacaaugccgaacuucugguugcauuggagaaccagcacaccauagaucuaacagacucagaaaugaauaaacuguucgagaggacucggaagcagcuccgagaaaacgcugaggauaugggaaacggcugcuuuaagaucuaccauaaaugugacaaugccugcauugggaguauccgcaacggaaccuaugaccacgauguguacagagacgaggcucugaauaacagguuccagaucaagggugucgaacuuaaauccggcuauaaggauuggauucuguggauaucuuuugccaucucuugcuucuugcucugugugguacuguuaggguuuauuaugugggcaugccaaaaaggaaauauccgguguaacauuugcaucuga

SEQ ID NO: 123004 - RNA, 1701 nt, Artificial Sequence
  derived and/or modified sequence opt3 from hemagglutinin__InfluenzaA__ABG37285
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcgacaguccgcacaggauucucgauggcaaaaauuguacccugaucgacgcucuacugggggauccccauugcgacggauuucagaacaaggagugggauuuguucguggaacggagcaaagccuauuccaauuguuacccuuaugacgucccagauuacgcaucucuccgcucgcugguggccucaagcggcacucuggaguuuacaaacgaaaauuucaacuggaccgguguugcucaggacgggaagaguuaugcaugcaagcgaggauccgugaauagcuuuuucucucgucucaacugguuacacaaacuggauuacaaguaucccgcccuuaaugucacgaugccuaacaauggcaaauuugacaaguuguacauauggggcgugcaucacccauccacugauucagaccaaaccagucuguacguaagagcuagcgggaaaguuacagugucuacuaagaggucccagcagaccgucauccccgacauuggauaucggccuugggugcgcggucuaucaagcagaaucaguauuuacuggacaaucgugaagccaggcgauauacuccugauuaacucuaccgggaaccuuaucgccccgaggggauauuucaaaauucggaauggcaaguccagcaucaugcgcucggacgcgcccaucgguaacuguucuuccgagugcauuacgccuaaugggucaauaccaaacgauaaacccuuucagaaugucaaccgaaucacuuacggagcauguccuagauauguuaagcaaaauacacugaaauuggccaccggcaugaggaacgugccagagaagcagacucggggcauuuucggggcuaucgccggauuuauagaaaaugguugggagggcaugguagacgggugguacggauuccgucaccagaacagugaaggcacaggucaggcagcugaucucaaaagcacccaagccgcgauugaccagaucaaugggaagcugaaccgcuuaguggagaagacgaaugagaaauuucaucagaucgaaaaggaguucuccgaagucgagggcaggauucaagaucuggaaaaauauguggaggacaccaagaucgaucucuggucuuacaacgccgagcuucugguugcauuggaaaaucagcacacaauugaccuaacugauagcgagaugaacaaacuguucgaaagaacccggaagcagcuccgagagaacgcugaagacaugggaaauggcugcuuuaagauauaccauaaaugugacaacgccugcaucgggucaauucgcaauggaacauaugaucacgacguguacagagaugaggcucugaacaauagguuccagaucaagggugucgagcuuaaaaguggcuauaaggacuggauccuguggauuuccuuugccauaagcugcuucuugcucuguuuugugcuguuaggguucaucaugugggcaugccaaaaaggaaacauucgguguaauaucugcauuuga

SEQ ID NO: 123005 - RNA, 1701 nt, Artificial Sequence
  derived and/or modified sequence opt3 from hemagglutinin__InfluenzaA__ABG37296
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaaggaagguuucaacuggaccgggguugcucaggacggaaaguccuaugcaugcaaacgaggcucugugaauagcuuuuucucccgucucaacugguuacacaagcuggaguacaaauauccagcccuuaaugucacgaugcccaacaaugauaaguuugacaaauuguacauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccaucuauuggacaauagugaagccuggcgacauucuacucaucaauagcaccgggaaccugauugccccaaggggauacuucaaaauccggaacggcaagucgucuaucaugcgcuccgaugcgccgauugguaauuguaacucagagugcauaacgcccaaugggaguaucccuaacgacaaaccauuucaaaaugucaaccgaauuacuuauggagcaugucccagauacguuaagcagaauacacuuaaacuggccaccggcaugaggaacgugccugaaaagcagacucggggcaucuucggggcuauagccggauuuauugagaaugguugggaaggcaugguagaugggugguauggauuccgucaccagaacagcgagggcacaggucaagcagcugacuugaaauccacccaggccgcgaucgaucagaucaaugggaagcucaaccgccugauugagaagacgaaugaaaaauuucaucaaaucgagaaggaguucucugaaguggaaggcaggauucaggacuuagagaaauacgucgaggauaccaagauagaccuguggagcuauaacgccgaacuccuuguggcacuggagaaucagcacacaaucgauuugacugacucagaaaugaacaaacuauucgagagaacccggaagcagcugcgagaaaacgcugaggauaugggaaauggcugcuuuaagauuuaccauaaaugugacaacgccugcaucgggaguauccgcaauggaacauacgaccacgauguuuauagagacgaggcucucaacaauagguuccaaauuaaggguguggaacugaaauccggcuacaaggauuggauacuuuggaucagcuuugccauuucuugcuuccuguugugugucgugcuccugggguuuaucaugugggcaugccagaaaggaaacauucgguguaauaucugcauauga

SEQ ID NO: 123006 - RNA, 1701 nt, Artificial Sequence; identical to SEQ ID NO: 123000
  derived and/or modified sequence opt3 from hemagglutinin__InfluenzaA__ABG37307

SEQ ID NO: 123007 - RNA, 1701 nt, Artificial Sequence; identical to SEQ ID NO: 123005
  derived and/or modified sequence opt3 from hemagglutinin__InfluenzaA__ABG37318

SEQ ID NO: 123008 - RNA, 1701 nt, Artificial Sequence
  derived and/or modified sequence opt3 from hemagglutinin__InfluenzaA__ABG37329
augaagaccaucauugcccugagcuacauacucugccuuguguucgcucagaaacugcccgagaacgacaauuccacagcaacuuuguguuuaggccaccaugccgucccuaacgggacgcugguuaagaccaucacaaaugaucaaauugaagugacuaacgcgaccgagcuaguacagucuucaccaacaggaagaaucugcgacaguccgcacaggauucucgaugguaaaaauuguacccugaucgacgcucugcuuggcgauccccauugcgacggguuucagaacaaggaaugggauuuguucguggagcggagcaaagccuauuccaauuguuacccuuaugacgucccagauuacgcaucucuccgcucgcugguggccucaagcggaacucuggaauuuacaaacgagaauuucaacuggaccggcguugcucaggacgguaagaguuaugcaugcaagcgaggguccgugaauagcuuuuucucucgucucaacugguuacacaaacuggaguacaaguaucccgcccuuaaugucacgaugccuaacaauggaaaauuugauaaguuguacauauggggcgugcaucacccauccacugacucagaucaaaccagucuguacguaagagcuagcggcaaaguuacagugucuacuaagaggucccagcagaccgucauccccgacauuggguaucggccuugggugcgcggacuaucaagcagaaucaguauuuacuggacaaucgugaagccaggugacauacuccugauuaacucuaccggcaaccuuaucgccccgaggggguauuucaaaauucggaauggaaaguccagcaucaugcgcucggaugcgcccaucggcaacuguucuuccgaaugcauuacgccuaaugguucaauaccaaacgacaaacccuuucagaaugucaaccgaaucacuuacggggcauguccuagauauguuaagcaaaauacacugaaauuggccaccggaaugaggaacgugccagagaagcagacucggggcauuuucggcgcuaucgccggguuuauagaaaauggaugggaggguaugguagauggcugguacggguuccgucaccagaacagugagggaacaggccaggcagcugaccucaaaagcacccaagccgcgauugaucagaucaaugguaagcugaaccgcuuaguggaaaagacgaaugagaaauuucaucagaucgaaaaggaguucuccgaagucgaggggaggauucaagaccuggagaaauauguggaagauaccaagaucgaccucuggucuuacaacgccgagcuucugguugcauuggaaaaucagcacacaauugaucuaacugacagcgagaugaacaaacuguucgaaagaacccggaagcagcuccgagagaacgcugaggauaugggcaauggaugcuuuaagauauaccauaaaugugacaacgccugcaucggcucaauucgcaaugggacauaugaccacgauguguacagagacgaagcucugaacaauagguuccagaucaagggagucgagcuuaaaagugguuauaaggauuggauccuguggauuuccuuugccauaagcugcuucuugcucugugugguacuguuaggcuuuaucaugugggcaugccaaaaagggaacauucgguguaauaucugcauuuga

SEQ ID NO: 123009 - RNA, 1701 nt, Artificial Sequence
  derived and/or modified sequence opt3 from hemagglutinin__InfluenzaA__ABG37340
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuuuuccaacagguagaaucugcgacucaccgcacaggauucucgauggcaaaaauuguacccugaucgacgcucuacugggggauccccauugcgacggauuccagaacaaggagugggauuuguuuguggaacggaguaaagccuauagcaauuguuacccuuaugacgucccagauuacgcaucccuccgcucucugguggccucgucaggcacucuggaguucacaaacgaaaauuuuaacuggaccgguguugcucaggacgggaagucuuauaguugcaagcgaggauccgugaauagcuucuuuagccgucucaacugguuacacaaacuggaguacaaguaucccgcacuuaaugucacgaugccuaacaauggcaaauucgauaaguuguacauauggggcgugcaucacccauccacugacucagaucaaaccagucuguacguaagagccagcgggaaaguuacagugucuacuaagaggucccagcagaccgucauccccgacauuggauaucggccuugggugcgcggucuaucaagcagaaucaguauuuacuggacaaucgugaagccaggcgacauacuccugauuaacucuaccgggaaccuuaucgcuccgaggggauauuuuaaaauucggaauggcaaguccagcaucaugcgcucggaugcccccaucgguaacuguucuuccgagugcauuacgccuaaugggucaauaccaaacgacaaacccuuccagaaugucaaccgaaucacuuacggagcguguccuagauauguuaagcaaaauacacugaaauuggcaaccggcaugaggaacgugccagaaaagcagacucggggcauuuuuggggccaucgcuggauucauagagaaugguugggaaggcaugguagaugggugguacggauuucgucaccagaacagugagggcacaggucaggccgcagaccucaaaagcacccaagcugccauugaucagaucaaugggaagcugaaccgcuuaguggagaagacgaaugaaaaauuccaucagaucgagaaggaguucuccgaagucgaaggcaggauucaagaccuggagaaauauguggaggauaccaagaucgaccucuggucuuacaacgcggaacuucugguugccuuggagaaucagcacacaauugaucuaacugacagcgaaaugaacaaacuguuugagagaacccggaagcagcuccgagaaaacgcagaggauaugggaaauggcugcuucaagauauaccauaaaugugacaacgcuugcaucgggucaauucgcaauggaacauaugaccacgauguguacagagacgaggcccugaacaauagguuucagaucaagggugucgaacuuaaaaguggcuauaaggauuggauccuguggauuuccuucgcuauaagcugcuuuuugcucugugugguacuguuaggguucaucaugugggccugccaaaaaggaaacauucgguguaauaucugcauuuga

SEQ ID NO: 123010 - RNA, 1701 nt, Artificial Sequence
  derived and/or modified sequence opt3 from hemagglutinin__InfluenzaA__ABG37351
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucgauuccacagggaaccuuauugccccacggggauacuuuaagauccgcaacggcaaaagcucgaucaugcgaucugacgcgccgauugguaauuguuccucagagugcauaacccccaacgggaguaucccuaaugauaagccauuccagaacgucaauagaauuacguauggagcaugucccagguacguuaaacaaaacacucugaaguuggccacaggcaugcggaaugugccugaaaaacagacccguggcaucuuuggggcuauagccggauucauugagaacgguugggaaggcaugguagacgggugguauggauuucgccaccagaauagcgagggcacuggucaggcagcugaucucaaguccacacaagccgcgaucgaccagaucaacgggaaacugaauagauuaauugagaagaccaacgaaaaguuccaucagaucgagaaagaguucucugaaguggaaggcaggauucaagaucuggagaaguacgucgaggacacgaaaauagaucucuggagcuauaaugccggacuucugguggcauuggaaaaccagcacaccaucgaccuaacagauucagagaugaauaagcuguuugaacggacucgaaaacagcuccgcgagaacgcugaagacaugggcaacgggugcuucaagauuuaccauaagugugacaaugccugcaucggaaguaucagaaacgguaccuacgaucacgacguuuauagggaugaggcucugaauaaccgguuucagauuaaaggcguggagcuuaaguccggguacaaagacuggauacuguggaucagcuucgccauuucuugcuuuuugcucugugucgugcuguuaggauucaucaugugggcaugccaaaagggcaauauucgcuguaacaucugcauauga

SEQ ID NO: 123011 - RNA, 1698 nt, Artificial Sequence
  derived and/or modified sequence opt3 from hemagglutinin__InfluenzaA__ABG37362
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggaggugcuaguucucuggggcgugcaucacccuccaaacaucgggaaccagcgcgcccuguaccacacugaaaaugcuuaugucuccguggugucaagccauuacagucgacguuucacccccgagauagcaaaaagaccuaaggucagggaucaggaaggacggaucaacuauuacuggacacuucuggagccaggugacacuauuaucuuugaggccaauggcaacuugauugcuccgugguaugccuucgcgcucucucgcggguuuggauccggcaucauaaccagcaaugcacccauggaugaaugugacgccaagugccagacaccucaaggugcuauuaacucgucucugccauuccagaauguucaccccgugaccaucggggaguguccuaaauacguaagauccgccaaguuaaggauggugacgggacugcggaacauuccaucaauccagagucgcggccucuuuggcgcaaucgcuggguucauugaaggagguuggacuggcauggucgaugggugguauggauaccaucaccagaaugagcaaggcagcgguuacgccgcggaccagaaauccacacagaacgccauaaaugggaucaccaacaagguaaauucuguuauugaaaagaugaacacucaguuuacagcagugggcaaagaguucaauaaacuugagcgaagaauggaaaaccugaacaagaaggucgaugacggauucuuggauaucuggaccuauaaugcugagcuacuggugcuccuggaaaacgagaggacgcuugacuuucacgacagcaauguuaaaaaccuguacgaaaagguaaaaucacaauugaagaauaacgccaaagagauaggcaaugggugcuucgaguuuuaucauaaguguaacaaugaaugcauggagagugugaagaacggaaccuacgauuaucccaaauacuccgaagagagcaagcucaaucgggagaaaauugacggugucaagcuggaaucuaugggcguguaucagaucuuagcuaucuacucaacagucgccaguagccuggugcuacucguuucccugggggcaauuucuuucuggaugugcucgaacggaagccuucagugucguaucugcauuuga

SEQ ID NO: 123012 - RNA, 1698 nt, Artificial Sequence; identical to SEQ ID NO: 122816
  derived and/or modified sequence opt3 from hemagglutinin__InfluenzaA__ABG37384

SEQ ID NO: 123013 - RNA, 1698 nt, Artificial Sequence; identical to SEQ ID NO: 122886
  derived and/or modified sequence opt3 from hemagglutinin__InfluenzaA__ABG37395

SEQ ID NO: 123014 - RNA, 1701 nt, Artificial Sequence; identical to SEQ ID NO: 122793
  derived and/or modified sequence opt3 from hemagglutinin__InfluenzaA__ABG37406

SEQ ID NO: 123015 - RNA, 1701 nt, Artificial Sequence
  derived and/or modified sequence opt3 from hemagglutinin__InfluenzaA__ABG37428
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacagaauacucuuaagcuggccacaggaaugaggaacgugccugagaaacaaacccggggcaucuucggcgcuauagccggguuuauugaaaauggaugggaggguaugauggacggcugguacggguuccgucaccagaacucugagggaacuggccaggcagcugaucuaaagagcacacaagccgcgaucaaucagaucaacgguaaacucaaucgccugauugaaaagaccaacgagaagucacaucagaucgaaaaagaguuuagugaaguagaggggaggauucaggacuuagagaaguauguggaagauacgaaaauagaccugugguccuacaaugccgagcuccuugucgcacuggaaaaccaacacaccaucgauuugacagacagcgagaugaacaagcuauucgaaagaacuaaaaagcagcugcgggagaaugcugaggauaugggcaacggaugcuucaagauuuaucauaaaugugacaaugccugcaucggcucuauccgaaacgggaccuacgaucacgacguguaccgcgacgaagcucucaauaacagauuucagauuaagggaguugagcugaaaucagguuauaaggauugggugcuuuggauaaguuucgccaucagcugcuuucuguuguguauuguccuccugggcuucaucaugugggcaugccagaaagggaauauuagguguaacaucugcauauga

SEQ ID NO: 123016 - RNA, 1701 nt, Artificial Sequence; identical to SEQ ID NO: 122578
  derived and/or modified sequence opt3 from hemagglutinin__InfluenzaA__ABG37439

SEQ ID NO: 123017 - RNA, 1701 nt, Artificial Sequence; identical to SEQ ID NO: 122656
  derived and/or modified sequence opt3 from hemagglutinin__InfluenzaA__ABG37461

SEQ ID NO: 123018 - RNA, 1701 nt, Artificial Sequence
  derived and/or modified sequence opt3 from hemagglutinin__InfluenzaA__ABG37472
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccaggugcucgauggcgagaauuguacccugauugacgcccuucugggggauccgcauugcgacggauuucagaacaaagaaugggauuuguucgucgagagguccaaggcuuauucuaauuguuaccccuaugacgugccugauuacguuucgcuccggucacugguggcaagcaguggcacucuggaauuuaacaaugaguccuucaacuggacaggugucgcccaaaaugggaccucuagcgcuugcaaacgccgauccgacaagucauuuuucagucgucucaacugguuacaccagcugaaguauaaauacccagcacuuaaugugacgaugcccaacaaugagaaguuugauaaauuguauaucuggggaguacaucacccuggcacugacagcgaucagauaucucuguacgcccaggcuuccggcagaguuaccgugucaacaaagaggagccaacagacugucaucccaaacauugggagucggcccugggugcgcggagugucuuccagaaucagcauuuacuggaccaucgucaaaccuggugacauacuacucauuaacucgacaggcaaucugaucgccccaaggggguauuucaagauucggucuggaaaguccucaaucaugcgcagugacgcgccgaucggcaaauguaacagcgaaugcauuacccccaaugguuccauaccuaacgauaagccauuucagaauguuaaccgaaucacguacgggcccuguccuagauaugugaaacagaauacucuuaagcuggcaacaggaaugaggaacguaccagagaaacaaacccggggcauuuucggcgccaucgcuggguuuauagaaaauggaugggaggguaugauggacggcugguacggguuccgucaccagaacucugagggaacuggccaggccgcagaucuaaagagcacacaagcugccauuaaucagaucaacgguaaacucaaucgccugaucgaaaagaccaacgagaaguuucaucagauugaaaaagaguucucagaaguggaggggagaauccaggacuuagagaaguaugucgaagauacgaaaauugaccuguggaguuacaaugcggagcuccuuguggcccuggaaaaccaacacaccauagauuugacagacuccgagaugaacaagcuauucgaaaggacuaaaaagcagcugcgggagaaugcagaggauaugggcaacggaugcuuuaagaucuaucauaaaugugacaaugcuugcauuggcagcauccgaaacgggaccuacgaucacgacguuuaccgcgacgaagcccucaauaacagauuccagaucaagggaguggagcugaaaucugguuauaaggauuggauucuuuggauaucauuugcuaucaguugcuuccuguuguguauuguccuccugggcuuuaucaugugggccugccagaaagggaauauuagguguaacaucugcauauga

SEQ ID NO: 123019 - RNA, 1701 nt, Artificial Sequence; identical to SEQ ID NO: 122578
  derived and/or modified sequence opt3 from hemagglutinin__InfluenzaA__ABG37483

SEQ ID NO: 123020 - RNA, 1701 nt, Artificial Sequence; identical to SEQ ID NO: 122656
  derived and/or modified sequence opt3 from hemagglutinin__InfluenzaA__ABG37494

SEQ ID NO: 123021 - RNA, 1701 nt, Artificial Sequence
  derived and/or modified sequence opt3 from hemagglutinin__InfluenzaA__ABG37505
augaagaccaucauugcccugagcuacauacucugccuuguguucgcucagaaacugcccggcaacgacaauuccauggcaacauuguguuuagggcaccaugccgucccuaacggaacucugguuaagacgaucaccaaugaucaaauugaggugacaaacgcgacugaacuuguacagucuucaaguaccgguagaaucugcgacagcccacaccagauucucgauggcgagaauuguacacugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacccuggaauuuaacaaugaguccuucaacuggacugguguggcccaaaaugggacaucuagcgcuugcaaacgccgauccgacaagucauuuuucagucgucucaacugguuacaccagcugaaguauaaauacccagcacuuaaugucaccaugcccaacaaugagaaguuugauaaauuguauauauggggagugcaucacccuggcacggacagcgaucagaucucucuguacgcccaggcuuccggcagaguaacuguuucaaccaagaggagccaacagacagugauuccaaacaucgggagucggcccuggguccgcggagugucuuccagaauuagcaucuacuggacuauagugaaaccuggugacauucuacucaucaacucgaccggcaaucugauugccccaaggggguauuucaagauccggucuggaaaguccucaaucaugcgcagugacgcgccgauugauaaauguaacagcgaaugcauaacacccaauggcuccaucccuaacgacaagccauuucagaaugucaaccgaauuaccuacggucuuugucccagauauguuaaacagaauacgcugaaguuggcaacugggaugaggaacgugccugagaaacaaacacggggaaucuucggcgccauagcuggcuuuauugaaaaugggugggagggaaugauggaugguugguacggcuuccgucaccagaacucugaggggaccggacaggccgcagaccucaagagcacucaagcugccaucaaucagaucaacggcaaacugaaucgcuuaauugaaaagacaaacgagaaguuucaucagaucgaaaaagaguucucagaaguagaggguaggauucaggaucuggagaaguauguggaagacaccaaaauagaucucuggaguuacaaugcggagcuucuggucgccuuggaaaaccaacacacgaucgaccuaaccgauuccgagaugaacaagcuguucgaaagaacuaaaaagcagcuccgggagaaugcagaggacauggggaacggcugcuuuaagauuuaucauaaaugugauaaugcuugcaucggaagcauccgaaacggcacauacgaccacgacguguaccgcgaugaagcccugaauaacagauuccagauuaaggggguugagcuuaaaucuggauauaaggacuggauacuguggaucucauuugcuauuaguugcuucuugcucuguaucgugcuguuagguuuuauuaugugggccugccagaaaggcaauaucagguguaacauaugcaucuga

SEQ ID NO: 123022 - RNA, 1701 nt, Artificial Sequence; identical to SEQ ID NO: 122532
  derived and/or modified sequence opt3 from hemagglutinin__InfluenzaA__ABG37516

SEQ ID NO: 123023 - RNA, 1701 nt, Artificial Sequence; identical to SEQ ID NO: 122532
  derived and/or modified sequence opt3 from hemagglutinin__InfluenzaA__ABG37527

SEQ ID NO: 123024 - RNA, 1701 nt, Artificial Sequence; identical to SEQ ID NO: 122532
  derived and/or modified sequence opt3 from hemagglutinin__InfluenzaA__ABG37538

SEQ ID NO: 123025 - RNA, 1701 nt, Artificial Sequence; identical to SEQ ID NO: 122532
  derived and/or modified sequence opt3 from hemagglutinin__InfluenzaA__ABG37549

SEQ ID NO: 123026 - RNA, 1701 nt, Artificial Sequence; identical to SEQ ID NO: 122532
  derived and/or modified sequence opt3 from hemagglutinin__InfluenzaA__ABG37560

SEQ ID NO: 123027 - RNA, 1701 nt, Artificial Sequence; identical to SEQ ID NO: 122532
  derived and/or modified sequence opt3 from hemagglutinin__InfluenzaA__ABG37571

SEQ ID NO: 123028 - RNA, 1701 nt, Artificial Sequence
  derived and/or modified sequence opt3 from hemagglutinin__InfluenzaA__ABG37582
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugaucaugcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucacuuaaaauacaaguauccagcacugaaugugaccaugcccaacaaugagaaauuugauaaacuuuacauuuggggcguccaucacccuggcacagacagugaucagaucagcuuguaugcccaggcuucugggcguauuacuguguccaccaagagaucacaacagacaguaaucccaaacauaggaagcaggccccggguucgcgacgugaguucuagaauuuccaucuacuggaccauugucaagccuggugacauccugcuaaucaacagcacgggcaaucucauugccccaaggggguacuucaagauacggucgggaaaaucuuccaucaugcgcucagaugcgccgauuggcaaguguaacagugagugcaucacucccaaugguagcauaccuaacgacaaaccauuucagaaugugaaccgaauuacauauggggcaugucccagauacgugaagcagaauacccugaaacuugccacuggaaugaggaacgucccugaaaagcaaacacggggcaucuucggcgcuaucgccggguuuauugagaauggaugggaagguaugguugauggcugguauggguuccgucaccagaacuccgagggaaccggccaggcagcugaccugaaaucuacgcaagccgcgaucaaucagauuaacgguaaguugaaucgccucauagggaagaccaacgagaaauuucaucagaucgaaaaggaguucagcgaaguggagggcaggauucaggaucuggaaaaauacguagaggacacaaagaucgauuuauggucauauaaugccgagcugcucguggcacuugaaaaccaacacacuaucgaccugaccgauagugagaugaacaaauuguucgaaagaacaaagaagcagcuacgggagaaugcugaagacaugggaaacggcugcuuuaaaauuuaccauaagugugauaaugccugcauaggguccauccgaaacggaacuuaugaccacgacgucuaccgcgaugaggcucugaauaacagauuccagauuaaagguguggagcucaagagcggcuacaaagacuggauccuguggauuucuuuugccaucucaugcuuccuucuguguguugcauugcucggguuuauaaugugggccugccagaagggaaauaucagguguaacauuugcaucuga

SEQ ID NO: 123029 - RNA, 1701 nt, Artificial Sequence; identical to SEQ ID NO: 122532
  derived and/or modified sequence opt3 from hemagglutinin__InfluenzaA__ABG37604

SEQ ID NO: 123030 - RNA, 1701 nt, Artificial Sequence; identical to SEQ ID NO: 122532
  derived and/or modified sequence opt3 from hemagglutinin__InfluenzaA__ABG37615

SEQ ID NO: 123031 - RNA, 1698 nt, Artificial Sequence; identical to SEQ ID NO: 122758
  derived and/or modified sequence opt3 from hemagglutinin__InfluenzaA__ABG47807

SEQ ID NO: 123032 - RNA, 1698 nt, Artificial Sequence; identical to SEQ ID NO: 122757
  derived and/or modified sequence opt3 from hemagglutinin__InfluenzaA__ABG47818

SEQ ID NO: 123033 - RNA, 1701 nt, Artificial Sequence
  derived and/or modified sequence opt3 from hemagglutinin__InfluenzaA__ABG47829
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugaaaagaacggacuguaucccaaucuuagcaagucuuacgucaacaauaaagagaaggaaguguugguacuguggggcguucaucacccuuccaacaucggcgaucagcgcgcaauuuaccacaccgagaacgccuaugugucagucgugagcagucauuacucucgacguuuuacaccagaaaucacuaagagacccaaagugaggaaucaggaggggcggauaaacuauuacuggacccuacucgagccuggagacacaaucauuuucgaagcuaaugguaaccugaucgccccaugguaugcguuugcacuuucccgcggcuucgggagcggaauuaucaccucgaaugccucuaugggcgagugugaugcuaagugccagacgccgcaaggugccauaaacuccucacugcccuuucagaauguccacccuguuacuauuggggaauguccaaaauacgugagaaguacaaaguugaggaugguaaccggacuccggaacauccccagcauucagucccgcggccuguucggcgcaaucgcuggguuuaucgagggagguuggacuggcaugauugacgggugguauggauaccaucaccagaaugaacaaggcucugguuacgccgcggaucagaaaagcacacagaacgccauagacgggaucaccaauaaggugaacucagucauugagaaaaugaauacgcaguucaccgcagugggcaaggaguucaacaaguuagaacgaagaauggagaaucugaacaaaaagguugaugacggauuucucgauaucuggacauauaacgcugaacuucugguguugcuagagaaugaaaggacucuggacuuccacgacaguaacgucaaaaaucucuacgagaaggugaaaacccaacugaagaacaaugccaaggagauaggcaacgggugcuuugaguucuaucauaaauguaauaacgaaugcauggaauccguaaagaauggaacauacgauuauccuaaauacagcgaggagucuaaacuuaaccgggagaaaauugacgguguuaagcuggaaucaaugggcguguaucagaucuuggcuaucuacaguacugucgccagcucccucgugcuguuagucucucugggggcaauuucguuuuggaugugcagcaauggaucccuacagugucguaucugcauuuga

SEQ ID NO: 123034 - RNA, 1701 nt, Artificial Sequence
  derived and/or modified sequence opt3 from hemagglutinin__InfluenzaA__ABG47840
augaaggugaaacugcucguccuucugugcgccuucaccgcuacauacgcagacacuaucuguauuggcuaucacgccaacaauagcacggauaccguugacacaguguuggagaagaacguaacugugacccauuccgucaauuuacuggaagauucucacaacgggaaacuaugcagacucaagggaacagcgccccugcagcuugguaauuguucaguggcuggcuggauacuggggaacccugagugcgaaaguuuguuuagcaaagaguccuggucuuacaucgccgaaaccccaaauccggagaacggaacuuguuaucccggcuacuucgcagacuaugaggaacucagggagcaacugucgucaguuagcaguuuugaacgguucgagauuuuuccuaaggaguccucuuggccaaaucauacagugaccaagggugucacggccagcugcucccacaacgggaaaucaaguuucuacaagaaucugcucugguuaacugaaaagaacggacuguaucccaaucuuagcaagucuuacgugaacaauaaagagaaggaaguauugguucuguggggcgugcaucacccuuccaacaucggcgaucagcgcgcuauuuaccacaccgagaacgcauaugucucaguggugagcagucauuacucucgacguuuuacaccagaaaucgccaagagacccaaagucagggaccaggaggggcggauaaauuauuacuggacucuacucgagccuggagauaccaucauuuucgaagcuaacgguaaucugaucgccccaugguaugcguuugcacuuucccgcggcuucgggagcggaauuaucacaucgaacgccucuauguccgagugugacgcuaagugccagaccccgcaaggcgccauaaauucaagucugcccuuucagaacguucacccugugacgauuggugaauguccaaaauacguaagaagcacuaaguugaggauggugacagggcuccggaauauccccuccauucagucucgcggacuguucggcgcaaucgcuggcuuuaucgaagggggauggaccgguaugauugauggcugguauggguaccaucaccagaacgaacaaggaagcggcuacgccgcggaccagaaaucaacucagaaugccauagaugguaucacaaacaaggucaauagugugauugagaaaaugaacacccaguucacggcaguugggaaggaguucaauaaguuagaacgaagaauggagaaccugaauaaaaagguggacgauggcuuucucgacaucuggaccuauaacgcugaacuucuggucuugcuagagaacgaaaggacacuggacuuccacgauuccaaugugaaaaaccucuacgagaagguuaaaaaucaacugaagaacaaugccaaggagauaggaaacggcugcuuugaguucuaucauaaauguaauaacgagugcauggaaagcguaaagaaugggacuuacgacuauccuaaauacucugaggagucaaaacuuaaccgggagaaaauugauggagugaagcuggaaaguaugggugucuaucagaucuuggcuaucuacagcaccguggccuccucucucguccuguuagugucgcugggcgcaauuagcuuuuggaugugcuccaaugggucacuacagugucguaucugcauuuga

SEQ ID NO: 123035 - RNA, 1701 nt, Artificial Sequence
  derived and/or modified sequence opt3 from hemagglutinin__InfluenzaA__ABG47851
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaaaguccuaugcaugcaagcgaggcucugugaacagcuuuuucucccgucucaauugguuacacaaacuggaguacaaguauccagcccuuaacgucacgaugcccaauaacgauaaauuugacaaguuguacauauggggcgugcaucacccuucaacugauagugaccaaaccagccuguacguacaggcuucugggagaguuacaguguccacuaaaaggucacagcagaccgucaucccaaauauuggaagccggcccugggugcgcgguaucaguucuagaauuuccaucuauuggacaauagugaagccuggcgacauucuacucaucaacagcaccgggaaccugauugccccaaggggauacuucaagauccggaauggcaaaucgucuaucaugcgcuccgaugcgccgauugacaacuguaauucagagugcauaacgcccaacgguaguaucccuaaugauaagccauuucaaaacgucaaucgaauuacuuauggggcaugucccagauacguuaaacagaacacacuuaagcuggccaccggaaugaggaaugugccugaaaaacagacucggggcaucuucggcgcuauagccggguuuauugagaacggaugggaagguaugguagacggcugguauggguuccgucaccagaauagcgagggaacaggccaagcagcugauuugaaguccacccaggccgcgaucgaccagaucaacgguaaacucaaucgccugauugagaagacgaacgaaaaguuucaucaaaucgagaaagaguucucugaaguggaagggaggauucaggauuuagagaaguacgucgaggacaccaaaauagaucuguggagcuauaaugccgaacuccuuguggcacuggagaaccagcacacaaucgacuugacugauucagaaaugaacaagcuauucgagagaacccggaaacagcugcgagaaaaugcugaggacaugggcaacggaugcuuuaagauuuaccauaagugugacaaugccugcaucggcaguauccgcaacgggacauacaaucacgauguuuauagagacgaggcucucaacaauagguuccaaauuaaaggaguggaacugaaguccgguuacaaagauuggauacuuuggaucagcuuugccauuucuugcuuccuguugugugucgugcuccugggcuuuaucaugugggcaugccagaaggggaacauucgguguucaaucugcauauga

SEQ ID NO: 123036 - RNA, 1701 nt, Artificial Sequence
  derived and/or modified sequence opt3 from hemagglutinin__InfluenzaA__ABG47862
augagaaccaucauugcccugagcuacauacucugccuuguguucgcucagaagcugcccggcaacgacaauuccacagcaacuuuguguuuagggcaccaugccgucccuaacggaacgcugguuaaaaccaucacaaaugaucaaauugaggugacuaacgcgaccgaacuuguacagucuucaaguacagguaggaucugcaauagcccacaccggauucucgacggcaagaacuguacccugaucgaugcucuacugggggacccgcauugcgauggauuucagaauaaagagugggacuuguucguggaacgcuccaaggccuauucuaacuguuaccccuaugaugucccugacuacgcaucgcuccgaucacugauagccagcaguggcacucuggaguuuacaaaugaagguuucaacuggaccgggguggcucaggauggaacguccuaugcaugcaaacguggcucuguuaagagcuuuuucuccagacucaauugguuacacaagcuggaguacaaauauccagcccuuaacgugacuaugcccaauaacgacaaguuugauaaauuguacaucuggggcguccaucacccuucaaccgacagugaucaaacaagccuguacgugcaggcuucugggaggguaacuguuuccaccaagcggucacagcagacagugauuccaaauaucggaagccgccccugggucagaggugugaguucuaggauuuccaucuauuggaccauagugaaaccuggcgacauucuacucaucaacagcacggggaaccugauugccccacggggauacuucaagauccgcucgggcaagucuuccaucaugcgaucagacgcgccgauugguaauuguaacagugagugcauaacucccaaugggagcaucccuaacgauaaaccauuucaaaaugucaacagaauuacauauggagcaugucccagguacguuaagcagaauacccuuaaacuggccacuggcaugcggaacgugccugaaaagcagacacguggcaucuucggggcuauagccggauuuauugagaaugguugggaaggcaugguagacgggugguauggauuccgccaccagaacuccgagggcaccggucaagcagcugauuugaaaucuacgcaggccgcgaucaaucagaucaacgggaagcucaauagacugauugagaaaaccaacgaaaaguuucaucaaaucgagaaggaguucagcgaaguggaaggcaggauucaggacuuagagaaauacgucgaggauacaaagauagaccuguggucauauaaugccgaacuccuuguggcacuggagaaccagcacacuaucgauuugaccgacagugaaaugaacaaacuauucgagcggacacgaaagcagcugcgcgaaaaugcugaggauaugggaaacggcugcuuuaaaauuuaccauaagugugacaaugccugcaucggguccaucagaaacggaacuuacgaucacgacguuuauagggacgaggcucucaauaaccgguuccaaauuaaggguguggaacugaaaagcggcuacaaggauuggauacuuuggaucucuuuugccauuucaugcuuccuguugugugucgugcuccugggguuuaucaugugggcaugccagaaaggaaauauucgcuguaacaucugcauauga

SEQ ID NO: 123037 - RNA, 1701 nt, Artificial Sequence; identical to SEQ ID NO: 123000
  derived and/or modified sequence opt3 from hemagglutinin__InfluenzaA__ABG47873

SEQ ID NO: 123038 - RNA, 1701 nt, Artificial Sequence; identical to SEQ ID NO: 123005
  derived and/or modified sequence opt3 from hemagglutinin__InfluenzaA__ABG47895

SEQ ID NO: 123039 - RNA, 1701 nt, Artificial Sequence; identical to SEQ ID NO: 123000
  derived and/or modified sequence opt3 from hemagglutinin__InfluenzaA__ABG47906

SEQ ID NO: 123040 - RNA, 1701 nt, Artificial Sequence
  derived and/or modified sequence opt3 from hemagglutinin__InfluenzaA__ABG47917
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaagauccgcaauggcaaaagcucgaucaugcgaucugaugcgccgauugguaacuguuccucagagugcauaacccccaaugggaguaucccuaacgacaagccauuccagaaugucaacagaauuacguauggagcaugucccagguacguuaaacaaaauacucugaaguuggccacaggcaugcggaacgugccugaaaaacagacccguggcaucuuuggggcuauagccggauucauugagaaugguugggaaggcaugguagaugggugguauggauuucgccaccagaacagcgagggcacuggucaggcagcugaccucaaguccacacaagccgcgaucgaucagaucaaugggaaacugaacagauuaauugagaagaccaaugaaaaguuccaucagaucgagaaagaguucucugaaguggaaggcaggauucaagaccuggagaaguacgucgaggauacgaaaauagaccucuggagcuauaacgccggacuucugguggcauuggaaaaucagcacaccaucgaucuaacagacucagagaugaacaagcuguuugaacggacucgaaaacagcuccgcgagaacgcugaagauaugggcaaugggugcuucaagauuuaccauaagugugacaacgccugcaucggaaguaucagaaaugguaccuacgaccacgauguuuauagggacgaggcucugaacaaucgguuucagauuaaaggcguggagcuuaaguccggguacaaagauuggauacuguggaucagcuucgccauuucuugcuuuuugcucugugucgugcuguuaggauucaucaugugggcaugccaaaagggcaacauucgcuguaauaucugcauauga

SEQ ID NO: 123041 - RNA, 1701 nt, Artificial Sequence; identical to SEQ ID NO: 123040
  derived and/or modified sequence opt3 from hemagglutinin__InfluenzaA__ABG47928

SEQ ID NO: 123042 - RNA, 1701 nt, Artificial Sequence
  derived and/or modified sequence opt3 from hemagglutinin__InfluenzaA__ABG47939
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccauauaggauucucgauggcaaaaauuguacccugaucgacgcucuacugggggauccgcacugcgacggauuucagaacaaggagugggauuuguucguggaacgguccaaagccuacucuaauuguuaucccuacgacgucccugauuaugcaucgcuccgcucacugguggccagcaguggcacucuggaguuuauaaacgaagacuucaauuggacagguguugcucaggaugggaaguccuacgcaugcaagcgaggaucugugaacagcuuuuucucccgucucaauugguuacauaaacuggaguauaaguacccagcccuuaacgucaccaugcccaauaacggcaaauuugacaaguuguacaucuggggcgugcaccauccuucaacggauagugaccaaacuagccuguauguaagagcuucugggaggguuaccguguccacaaaacggucacagcagacugucauuccaaauaucggauuccgccccugggugagaggucuaagcaguaggauuucuaucuacuggaccauagugaagccuggcgacauucuccugaucaacuccacagggaaccuuauugccccacggggauauuuuaagauccgcaauggcaaaagcucgaucaugcgaucugaugcgccgauugguaacuguuccucagagugcauaacccccaaugggaguaucccuaacgacaagccauuccagaaugucaacagaauuacguacggagcaugucccagguauguuaaacaaaauacucugaaguuggccacaggcaugcggaacgugccugaaaaacagacccguggcaucuuuggggcuauagccggauucauugagaaugguugggaaggcaugguagaugggugguacggauuucgccaccagaacagcgagggcacuggucaggcagcugaccucaaguccacacaagccgcgaucgaucagaucaaugggaaacugaacagauuaauugagaagaccaaugaaaaguuccaccagaucgagaaagaguucucugaaguggaaggcaggauucaagaccuggagaaguaugucgaggauacgaaaauagaccucuggagcuacaacgccggacuucugguggcauuggaaaaucagcauaccaucgaucuaacagacucagagaugaacaagcuguuugaacggacucgaaaacagcuccgcgagaacgcugaagauaugggcaaugggugcuucaagauuuaccacaagugugacaacgccugcaucggaaguaucagaaaugguaccuaugaccaugauguuuacagggacgaggcucugaacaaucgguuucagauuaaaggcguggagcuuaaguccggguauaaagauuggauacuguggaucagcuucgccauuucuugcuuuuugcucugugucgugcuguuaggauucaucaugugggcaugccaaaagggcaacauucgcuguaauaucugcauauga

SEQ ID NO: 123043 - RNA, 1701 nt, Artificial Sequence
  derived and/or modified sequence opt3 from hemagglutinin__InfluenzaA__ABG47950
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagccugggcacucucgaguuuauaaacgaagacuucaauuggacagguguugcucaggaugggaagaguuauuccugcaagcgaggaucugugaacagcuuuuucucccguuuaaauuggcugcacaaacuugaguacaaguauccagcauugaacgucaccaugcccaauaacggcaaauuugacaagcuguacaucuggggcgugcaucacccuucaacggauagugaccaaacuagccuauacgccagagcuucugggaggguaaccguuuccacaaaacggucacagcagacugugauuccaaauaucggauuccgccccugggucagaggucucagcaguaggauuucuaucuauuggaccauagugaagccuggcgacauucugcuuaucaacuccacagggaaccugauugccccacggggauacuuuaagauccgcaccggcaaaagcucgaucaugcgaucugaugcgccgauugguaauuguuccucagagugcauaacgcccaacgggaauaucccuaacgacaagccauuccagaaugugaacagaauuacuuauggagcaugucccagguacgucaaacaaaauacauugaagcucgccaccggcaugcggaacguuccugaaaaacagacucguggcaucuuuggggcuauagccggauucauugagaaugguugggaaggcaugguggaugggugguauggauuucgccaccagaacagugagggcacaggucaggcagcugaccuuaagagcacccaagccgcgaucgaucagaucaaugggaaauuaaacagacugauugagaagacgaaugaaaaguuccaucagaucgagaaagaguucuccgaaguagaaggcaggauucaagaccucgagaaguacguggaggauaccaaaauagaccuuuggucuuauaacgccggauuucuggucgcauuggaaaaucagcacacaaucgaucuaacugacagcgagaugaacaagcuguucgaacggacccgaaaacagcuccgcgagaacgcugaagauaugggcaaugggugcuuuaagauuuaccauaagugugacaacgccugcaucggaucaaucagaaaugguacauacgaccacgauguguauagggacgaggcucugaacaaucgguuccagauuaaaggcguugagcuuaagaguggguacaaagauuggauacuguggaucuccuuugccauuagcugcuucuugcucugugugguccuguuaggauuuaucaugugggcaugccaaaagggcaacauucgcuguaauaucugcauauga

SEQ ID NO: 123044 - RNA, 1701 nt, Artificial Sequence
  derived and/or modified sequence opt3 from hemagglutinin__InfluenzaA__ABG47961
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuauucuugcaagcgaggaagcgugaacuccuuuuucucacgucucaauugguuacacaaacuggaguacaaguauccagcacuuaacgucaccaugcccaauaacggcaaauuugacaaguuguacaucuggggcgugcaucacccuaguacggauagcgaccaaacuucucuguacguaagagccuccgggggaguuaccgugucaacaaaaaggagccagcagacugucauuccaaauaucgguagucggcccugggugcgcggccuaucuuccagaauuagcaucuauuggaccauagugaagccuggggacauucuccugaucaacucgacaggaaaccuuauugcuccaaggggcuacuucaagaugcggaaugguaaaucuuccaucaugcgcucagaugccccgaucgggaacuguaguagcgagugcauuacccccaauggauccauaccuaacgacaagccauuucagaaugucaaccgaaucacguauggcgcgugucccagauacguuaaacaaaauacucugaaguuggcaacaggcaugaggaacgugccugaaaaacagacccgggggauuuucggagccaucgcugguuuuauagagaauggcugggaagggaugguagauggaugguauggcuuccgucaccagaacucugaggguacugggcaggccgcagaccucaagagcacacaagcugccauugaucagaucaauggcaaacugaaccgcuuaaucggaaagaccaaugagaaguuucaucagauugaaaaagaguucucagaaguggagggcagaauccaagaccuggaaaaguacgucgaggauacgaaaauugaccucuggaguuauaacgcggagcuucugguggccuuggaaaaucagcacaccauagaucuaacagacuccgagaugaacaagcuguucgaaaggacucggaaacagcuccgagagaacgcagaagauauggggaauggaugcuuuaagaucuaccauaagugugacaacgcuugcauugguagcauccgcaauggcaccuacgaccacgauguuuauagagacgaggcccugaacaauagguuccagaucaaagggguggagcuuaagucuggauacaaagauuggauucuguggauaucauuugcuaucaguugcuucuugcucugugucgugcuguuaggcuuuauuaugugggccugccaaaaggguaacauccgguguaauauuugcaucuga

SEQ ID NO: 123045 - RNA, 1701 nt, Artificial Sequence; identical to SEQ ID NO: 123040
  derived and/or modified sequence opt3 from hemagglutinin__InfluenzaA__ABG47972

SEQ ID NO: 123046 - RNA, 1701 nt, Artificial Sequence; identical to SEQ ID NO: 123040
  derived and/or modified sequence opt3 from hemagglutinin__InfluenzaA__ABG47983

SEQ ID NO: 123047 - RNA, 1701 nt, Artificial Sequence; identical to SEQ ID NO: 123040
  derived and/or modified sequence opt3 from hemagglutinin__InfluenzaA__ABG47994

SEQ ID NO: 123048 - RNA, 1701 nt, Artificial Sequence
  derived and/or modified sequence opt3 from hemagglutinin__InfluenzaA__ABG48005
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaagauccgcaauggcaaaagcucgaucaugcgaucugaugcgccgauugguaacuguuccucagagugcauaacccccaaugggaguaucccuaacgacaagccauuccagaaugucaacagaauuacguauggagcaugucccagguacguuaaacaaaauacucugaaguuggccacaggcaugcggaacgugccugaaaaacagacccguggcaucuuuggggcuauagccggauucauugagaaugguugggaaggcaugguagaugggugguauggauuucgccaccagaacagcgagggcacuggucaggcagcugaccucaaguccacacaagccgcgaucaaucagaucaacgggaaacugaauagauuaauugagaagaccaacgaaaaguuccaucagaucgagaaagaguucucugaaguggaaggcaggauucaagaucuggagaaguacgucgaggacacgaaaauagaucucuggagcuauaaugccggacuucugguggcauuggaaaaccagcacaccaucgaccuaacagauucagagaugaacaagcuguuugaacggacucgaaaacagcuccgcgagaaugcugaagacaugggcaacgggugcuucaagauuuaccauaagugugauaaugccugcaucggaaguaucagaaacgguaccuacgaccacgacguuuauagggaugaggcucugaauaaccgguuucagauuaaaggcguggagcuuaaguccggguacaaagacuggauacuguggaucagcuucgccauuucuugcuuuuugcucugugucgugcuguuaggauucaucaugugggcaugccaaaagggcaauauucgcuguaacaucugcauauga

SEQ ID NO: 123049 - RNA, 1701 nt, Artificial Sequence; identical to SEQ ID NO: 123040
  derived and/or modified sequence opt3 from hemagglutinin__InfluenzaA__ABG48016

SEQ ID NO: 123050 - RNA, 1701 nt, Artificial Sequence; identical to SEQ ID NO: 123040
  derived and/or modified sequence opt3 from hemagglutinin__InfluenzaA__ABG48027

SEQ ID NO: 123051 - RNA, 1698 nt, Artificial Sequence
  derived and/or modified sequence opt3 from hemagglutinin__InfluenzaA__ABG48049
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaacccauuacagccgacguuucacacccgagauagcaaaaagaccuaaggucagggaccaggaaggacggaucaauuauuacuggacucuucuggagccaggugauaccauuaucuuugaggccaacggcaauuugauugcuccgcgcuaugccuucgcgcucaguagaggguuuggaucuggcaucauaacauccaacgcacccauggacgaaugugaugccaagugccagaccccucaaggugcuauuaauagcucgcugccauuccagaacguucaccccgugacgaucggggaguguccuaaauacguaaggucugccaaguuacggauggugacuggacugcgcaauauuccauccauccagucacgaggccucuuuggcgcaaucgcuggguucauugaaggagguuggacaggcauggucgacgggugguauggauaccaucaccagaacgagcaaggcagugguuacgccgcggaucagaaaagcacccagaaugccauaaacgggaucacuaauaaggugaacuccguuauugaaaagaugaauacacaguuuaccgcagugggcaaagaguucaacaaacuugagagaaggauggaaaaucugaacaagaaggucgacgauggauucuuggacaucuggacguauaacgcugagcuacuggugcuccuggaaaaugagcggacccuugacuuucacgauucuaacguuaaaaaucuguacgaaaagguaaaaagccaauugaagaacaaugccaaagagauaggcaacgggugcuucgaguuuuaucauaaguguaauaacgaaugcauggagucagugaagaauggaacauacgacuaucccaaauacagugaagaguccaagcucaaccgugagaaaauugauggugucaagcuggaaagcaugggcguguaucagaucuuagcuaucuacucuacugucgccucaagucuggugcuacucguuagccugggggcaauuuccuucuggaugugcucuaauggaucgcuucagugucgcaucugcauuuga

SEQ ID NO: 123052 - RNA, 1701 nt, Artificial Sequence; identical to SEQ ID NO: 122666
  derived and/or modified sequence opt3 from hemagglutinin__InfluenzaA__ABG48060

SEQ ID NO: 123053 - RNA, 1701 nt, Artificial Sequence; identical to SEQ ID NO: 122666
  derived and/or modified sequence opt3 from hemagglutinin__InfluenzaA__ABG48071

SEQ ID NO: 123054 - RNA, 1701 nt, Artificial Sequence
  derived and/or modified sequence opt3 from hemagglutinin__InfluenzaA__ABG48082
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcugcauccuggcacugacagcgaucagaucucucuauacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuccugaucaacucgacaggcaaucuuauugccccaaggggguauuucaagauccggucuggaaaguccucaaucaugcgcagugacgcgccgauuggcaaauguaacagcgaaugcauaacccccaaugguuccaucccuaacgggaagccauuucagaaugucaaccgaauuacguacggagcaugucccagauauguuaaacagaauacucugaaguuggccacaggcaugaggaacgugccugagaaacaaacccggggcaucuucggggcuauagccggauuuauugaaaaugguugggagggcaugauggaugggugguacggauuccgucaccagaacucugagggcacuggucaggcagcugaccucaagagcacacaagccgcgaucaaucagaucaacgggaaacugaaucgcuuaauugaaaagaccaacgagaaguuucaccagaucgaaaaagaguucucagaaguagagggcaggauucaggaucuggagaaguauguggaagacacgaaaauagaucucuggaguuacaaugccgagcuucuggucgcauuggaaaaccaacauaccaucgaccuaacagauuccgagaugaacaagcuguucgaaagaacuaaaaagcagcuccgggagaaugcugaggacaugggaaacggcugcuuuaagauuuaucacaaaugugauaaugccugcaucgggagcauccgaaacggaaccuacgaccaugauguguaccgcgacgaagcucugaauaacagauuccagauuaaggguguugagcuuaaaucuggcuauaaggacuggauacuguggaucucauuugccauuaguugcuucuugcucuguaucgugcuguuaggguuuauuaugugggcaugccagaaaggaaauaucagguguaacauaugcaucuga

SEQ ID NO: 123055 - RNA, 1701 nt, Artificial Sequence
  derived and/or modified sequence opt3 from hemagglutinin__InfluenzaA__ABG48104
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagaggucccgggccuauucuaauuguuaccccuaugacgucccugauuacgugucgcuccgcucacugguugcaagcaguggcacucuggaauuuaacaaugaguccuucaacuggacagguguggcccaaaaugggaccucuagcgcuugcaagcgacguuccgacaaaucauuuuucaguagacucaacugguuacaccagcugaaguauaaguacccagcacuuaaugucacgaugcccaacaaugagaaauuugauaaguuguauauauggggagugcaucacccuggcacugacagcgaucagaucucucuguacgcccaggcuuccggcaggguaaccguuucaacaaaacggagccaacagacugugauuccaaacaucgggagucgccccugggucagaggagugucuuccaggauuagcaucuacuggaccauagugaagccuggugacauucuacucaucaacucgacaggcaaucugauugccccacggggguauuucaaaauccgcucuggaaaguccucaaucaugcgaagugacgcgccgauuggcaaguguaacagcgaaugcauaacccccaaugguuccaucccuaacgauaaaccauuucagaaugucaacagaauuacguacgggcccuguccuagguauguuaagcagaauacucuuaaacuggcaacaggaaugcggaacgugccagagaagcaaacccguggcaucuucggcgccauagcuggguuuauugaaaauggaugggaggguaugauggacggcugguacggguuccgccaccagaacucugagggaacuggccaggccgcagauuugaaaagcacacaagcugccaucaaucagaucaacgguaagcucaauagacugauugagaaaaccaacgaaaaguuucaucagaucgaaaaggaguucucagaaguagaggggaggauucaggacuuagagaaauauguggaagauacgaagauagaccuguggaguuacaaugcggagcuccuugucgcccuggaaaaccaacacaccaucgauuugacagacuccgagaugaacaaacuauucgaacggacuaagaaacagcugcgagagaaugcagaggauaugggcaacggaugcuuuaagauuuaucauaagugugacaaugcuugcaucggcagcauccgcaacgggaccuacgaucacgacguguacagagacgaagcccucaauaacagguuccagauuaaaggaguugagcugaagucugguuauaaagauuggauacuuuggaucucauuugcuauuaguugcuuccuguuguguaucgugcuccugggcuuuauuaugugggccugccagaaggggaauauccgguguaacauaugcaucuga

SEQ ID NO: 123056 - RNA, 1701 nt, Artificial Sequence; identical to SEQ ID NO: 122656
  derived and/or modified sequence opt3 from hemagglutinin__InfluenzaA__ABG48115

SEQ ID NO: 123057 - RNA, 1701 nt, Artificial Sequence; identical to SEQ ID NO: 122663
  derived and/or modified sequence opt3 from hemagglutinin__InfluenzaA__ABG48126

SEQ ID NO: 123058 - RNA, 1701 nt, Artificial Sequence; identical to SEQ ID NO: 122578
  derived and/or modified sequence opt3 from hemagglutinin__InfluenzaA__ABG48148

SEQ ID NO: 123059 - RNA, 1701 nt, Artificial Sequence; identical to SEQ ID NO: 122578
  derived and/or modified sequence opt3 from hemagglutinin__InfluenzaA__ABG48159

SEQ ID NO: 123060 - RNA, 1701 nt, Artificial Sequence
  derived and/or modified sequence opt3 from hemagglutinin__InfluenzaA__ABG48170
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugaaaagugacgcgccgauuggcaaguguaacuuugaaugcauaacccccaaugguagcaucccuaacgggaaaccauuccagaaugucaaccgcauuacguacggagcauguccccgauauguuaagcagaauacucuuaaacuggccacaggcaugagaaacgugccugagaagcaaaccaggggcaucuuuggggcuauagccggauucauugaaaaugguugggagggcaugauggaugggugguacggauuucggcaccagaacuccgagggcacuggucaggcagcugacuugaaaucuacacaagccgcgaucaaucagaucaacgggaagcucaaucgucugauugaaaagaccaacgagaaauuccaucagaucgaaaaggaguucagcgaaguagagggccgcauucaggauuuagagaaauauguggaagacacgaagauagaucuguggucauacaaugccgagcuccuugucgcacuggaaaaccaacacaccaucgacuugacagauagugagaugaacaaacuauuugaaagaacuaagaagcagcugagggagaaugcugaggacaugggaaacggcugcuucaaaauuuaucauaagugugauaaugccugcaucggguccauccggaacggaaccuacgaccacgauguguaccgagacgaagcucucaauaaccgcuuucagauuaaagguguugagcuaaagagcggcuauaaagacuggauacuuuggaucucuuucgccauuucaugcuuucuguuguguaucgugcuccugggguucauuaugugggcaugccagaagggaaauaucagauguaacauaugcaucuga

SEQ ID NO: 123061 - RNA, 1701 nt, Artificial Sequence
  derived and/or modified sequence opt3 from hemagglutinin__InfluenzaA__ABG48181
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuuaugcuugcaaacgccgaagcgacaaguccuuuuucucacgucucaacugguuacaccagcugaaguacaaauauccagcacuuaaugucacgaugcccaacaaugagaaguuugauaaauuguacauauggggagugcaucacccuggcacugacagugaucagaucagccuguacgcccaggcuucuggcagaguaaccguuuccacaaagaggucacaacagacugugauuccaaacaucgggagccggcccuggguccgcggagugaguucuagaauuuccaucuauuggaccauagugaaaccuggugacauucuacucaucaacagcacaggcaaucugauugccccaaggggguacuucaagauccggucgggaaagucuuccaucaugcgcucagacgcgccgauuggcaaauguaacagugaaugcauaacccccaaugguagcaucccuaacgauaagccauuucagaaugucaaccgaauuacguauggggcaugucccagauacguuaaacagaauacucuuaagcuggccacaggaaugaggaacgugccugagaaacaaacccggggcaucuucggcgcuauagccggguuuauugaaaauggaugggaggguaugauggacggcugguauggguuccgucaccagaacuccgagggaacuggccaggcagcugauuugaagucuacacaagccgcgaucaaucagaucaacgguaaacucaaucgccugauugaaaagaccaacgagaaguuucaucagaucgaaaaagaguucagcgaaguagaggggaggauucaggacuuagagaaguacguggaagauacgaaaauagaccuguggucauauaaugccgagcuccuugucgcacuggaaaaccaacacaccaucgauuugacagacagugagaugaacaagcuauucgaaagaacuaaaaagcagcugcgggagaaugcugaggauaugggcaacggaugcuuuaagauuuaccauaaaugugacaaugccugcaucggcuccauccgaaacgggaccuacgaucacgacguguaucgcgacgaagcucucaauaacagauuccagauuaagggaguugagcugaaaagcgguuacaaggauugggugcuuuggauaucuuuugccaucucaugcuuccuguuguguauuguccuccugggcuuuaucaugugggcaugccagaaagggaauauuagguguaacaucugcauauga

SEQ ID NO: 123062 - RNA, 1701 nt, Artificial Sequence; identical to SEQ ID NO: 122578
  derived and/or modified sequence opt3 from hemagglutinin__InfluenzaA__ABG48192

SEQ ID NO: 123063 - RNA, 1701 nt, Artificial Sequence
  derived and/or modified sequence opt3 from hemagglutinin__InfluenzaA__ABG48203
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacagcgaucagauuucuuuguaugcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguacuucaagauucggucuggaaaauccucaauaaugcgcagugaugcgccgaucggcaaguguaacagcgagugcauuacucccaaugguuccaucccuaacgacaaaccauuucagaaugugaaccgaauaacauauggggcaugucccagauacgugaagcagaauacccugaaacuugccacuggaaugaggaacgucccugaaaagcaaacacggggcauuuucggcgcuaucgccggguuuaucgagaauggaugggaagguaugguugauggcugguauggguuccgucaccagaacucugagggaaccggccaggcagcugaccugaaaagcacgcaagccgcgauuaaucagaucaacgguaaguugaaucgccucauugggaagaccaacgagaaauuucaucagauagaaaaggaguucucagaaguggagggcagaauccaggaucuggaaaaauacguagaggacacaaagauugauuuauggaguuauaaugccgagcugcucguggcacuugaaaaccaacacacuaucgaccugaccgauuccgagaugaacaaauuguucgaaaggacaaagaagcagcuacgggagaaugcugaagacaugggaaacggcugcuuuaaaaucuaccauaagugugauaaugccugcauugggagcauacgaaacggaacuuaugaccacgacgucuaccgcgaugaggcucugaauaacagauuccagaucaaagguguggagcucaagucuggcuacaaagacuggauucuguggaucucauuugccauuaguugcuuccuucuguguguugcauugcucggguuuaucaugugggccugccagaagggaaauauaagguguaacgugugcaucuga

SEQ ID NO: 123064 - RNA, 1701 nt, Artificial Sequence; identical to SEQ ID NO: 122532
  derived and/or modified sequence opt3 from hemagglutinin__InfluenzaA__ABG48214

SEQ ID NO: 123065 - RNA, 1701 nt, Artificial Sequence; identical to SEQ ID NO: 122532
  derived and/or modified sequence opt3 from hemagglutinin__InfluenzaA__ABG48236

SEQ ID NO: 123066 - RNA, 1701 nt, Artificial Sequence
  derived and/or modified sequence opt3 from hemagglutinin__InfluenzaA__ABG48247
augaagaccaucauugcccugagcuacauacucugccuuguguucgcucagaaacugcccggcaacgacaauaacacagcaacuuuguguuuagggcaccaugccgucccuaauggaacgaucguuaagaccauuacaaacgaucaaaucgaggugacuaaugcgaccgaacugguacaguccucuucaacagguggcauuugcgacaguccacaccagauccuagauggggagaacuguacccucauagacgcucugcuuggagauccgcagugcgacggcuuucaaaauaaaaagugggaucuguucguggaaagaagcaaagccuauuccaacuguuaccccuaugacgucccugaucaugcaucuuugaggucgcucguggccucaagcgguacucuggaguuuaauaacgaaaguuucgacuggacagggguuacccagaauggaacguccucugcuugcaagcggcgcagcaacaaguccuuuuucucacgacugaauuggcucacucacuuaaaauacaaguauccagcacugaacgugaccaugcccaauaacgagaaauuugauaaacuuuacaucuggggcguccaucacccuggcacagacagugaucagauuagcuuguaugcccaggcuucugggcguaucacuguguccaccaagagaucacaacagacaguaauuccaaacaucggaagcaggccccggguucgcgacgugaguucuagaauauccauuuacuggaccaucgucaagccuggugacauucugcuaaucaauagcacgggcaaccucaucgccccaaggggguacuucaagauucggucgggaaaaucuuccauaaugcgcucagaugcgccgaucggcaaguguaauagugagugcauuacucccaacgguagcaucccuaaugacaaaccauuucagaacgugaaucgaauaacauauggggcaugucccagauacgugaagcagaacacccugaaacuugccacuggaaugaggaaugucccugaaaagcaaacacggggcauuuucggcgcuaucgccggguuuaucgagaacggaugggaagguaugguugauggcugguauggguuccgucaccaaaauuccgagggaaccggccaggcagcugaccugaaaucuacgcaggccgcgauuaaccagaucaaugguaaguugaaccgccucauugggaagaccaaugagaaauuucaucagauagaaaaggaguucagcgaaguggagggcagaauccaggaucuggaaaaauacguagaggacacaaagauugauuuauggucauauaacgccgagcugcucguggcacuugaaaaccaacacacuaucgaccugaccgauagugagaugaauaaauuguucgaaaggacaaagaagcagcuacgggagaacgcugaagacaugggaaauggcugcuuuaaaaucuaccauaagugugauaacgccugcauuggguccauacgaaauggaacuuaugaccacgacgucuaccgcgaugaggcucugaacaauagauuccagaucaaagguguggagcucaagagcggcuacaaagacuggauucuguggaucucuuuugccauuucaugcuuccuucuguguguugcauugcucggguuuaucaugugggccugccagaagggaaacauaagguguaauaucugcauuuga

SEQ ID NO: 123067 - RNA, 1701 nt, Artificial Sequence
  derived and/or modified sequence opt3 from hemagglutinin__InfluenzaA__ABG48269
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaccaacagguggcauuugcgacaguccgcaccagauccuagauggggagaauuguacccucauagacgcucugcuuggagauccccagugcgacggcuuucaaaacaaaaagugggaucuguucguggaaagaagcaaagcccauuccaauuguuauccuuacgacgucccagauuaugcaucuuugaggucgcucguggccucaagcgguacucuggaguuuaacaaugaaaguuucaacuggacagggguuacccagaauggaacguccucugcuugcaagcggcgcagcaacaaguccuuuuucucacgacugaauuggcucacucacuuaaaauuuaaguaccccgcacugaacgugaccaugccuaauaacgagaaauucgacaaacuuuauaucuggggcguccaucacccaggcacagauaacgaccagauuaguuuguacgcccaggcuagcgggcguaucacugugucuaccaagagaucccaacagacaguaauucccaauaucggaucaaggccucggguucgcgaugugccaagcagaauaaguauuuauuggaccaucgucaagccgggugacauucugcuaaucaacucuacgggcaaucucaucgcccccaggggguacuuuaagauucgguccggaaaaagcucgauaaugcgcucugacgcgccuaucggcaaguguaacuccgagugcauuacuccaaaugguucaauccccaacgauaaaccuuuccagaaugugaaccgaauaacauacggggcauguccaagauaugugaagcagaauacccugaaacuugccacuggaaugaggaacguccccgaaaagcaaacacggggcauuuuuggcgcuaucgccggguucaucgagaauggaugggaagguaugguugacggcugguacggguuucgucaccagaacagugagggaaccggccaggcagcugaucugaaaagcacgcaagccgcgauuaaucagaucaacgguaaguugaaucgccucauugggaagaccaacgagaaauuccaucagauagaaaaggaguucuccgaaguggagggcagaauccaggaccuggaaaaauauguagaggauacaaagauugacuuauggucuuacaacgccgagcugcucguggcacuugaaaaucaacacacuaucgaucugaccgacagcgagaugaacaaauuguuugaaaggacaaagaagcagcuacgggagaaugcugaagauaugggaaacggcugcuucaaaaucuaucauaagugugacaaugccugcauugggucaauacgaaacggaacuuacgaucacgacgucuaucgcgacgaggcucugaauaacagauuucagaucaaagguguggagcucaagaguggcuacaaagauuggauucuguggaucuccuucgccauuagcugcuuucuucuguguguugcauugcucggguucaucaugugggccugccagaagggaaauauaagguguaacaucugcauuuga

SEQ ID NO: 123068 - RNA, 1701 nt, Artificial Sequence
  derived and/or modified sequence opt3 from hemagglutinin__InfluenzaA__ABG48291
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggggauccuaugcaugcaagcgaggcucugugaacagcuuuuucucccgucucaauugguuacacaagucagaguacaaauauccagcccugaacgucaguaugcccaauaacggcaaguuuaauaaacuuuacaucuggggagugcaucacccuagcaccgacucugaucaaacguccuuguacguaagagcuucagggaggguuacugugagcaccaagcggagucagcagacagucacuccaaacauugguucucgccccugggugagaggccuguccagcaggaucucgauuuauuggaccaucgugaaaccuggggacauacuacucauuaacucuacaggaaaucugaucgccccacggggcuacuucaagauucgcaacgguaaguccucaaucaugcgaagugacgcgccgaucgggaccuguagcuuugagugcauuacgcccaauggauccauaccuaacgauaaaccauuccagaaugucaacagaaucacuuauggcgcaugucccagguacguuaagcaaaauacacuuaaacuggccaccggcaugcggaacgugccugaaaagcagacucgugggauuuuuggagcuaucgccgguuucauagagaauggcugggaagggaugguagacggaugguauggcuuucgccaccagaacucugaggguacagggcaggcagcugauuugaaaagcacccaagccgcgauugaccagaucaauggcaagcucaacagacugaucgagaaaacgaaugaaaaguuccaucagauugagaaggaguucucagaaguggaaggaaggauccaagauuuagagaaauacgucgaggacaccaagauugaucuguggaguuauaacgccgaacuccuuguggcacuggagaaucagcacacaauagacuugacugauuccgaaaugaacaaacuauuugagaagacccggaaacagcugcgagaaaacgcugaggacaugggcaaugggugcuucaagaucuaccauaagugugauaacgccugcauuggaagcauccgcaaugguacauacgaccacgacguuuauagagaugaggcucucaacaauagguuucagaucaaaggcguggaacugaagucuggguacaaagacuggauucuuuggauaucauucgccaucaguugcuuucuguugugugucgugcuccugggauucauuaugugggcaugccaaaagggcaacauccgguguaauauuugcaucuga

SEQ ID NO: 123069 - RNA, 1701 nt, Artificial Sequence
  derived and/or modified sequence opt3 from hemagglutinin__InfluenzaA__ABG48335
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggaagccgccccugggugagaggucuaaguucuaggauuuccaucuauuggaccauagugaagccuggcgacauucuccugaucaacagcacagggaaccuuauugccccacggggauacuucaagauccgcaauggcaaaucgucuaucaugcgauccgaugcgccgauugguaacuguucaagugagugcauaacccccaaugggagcaucccuaacgacaagccauuucagaaugucaacagaauuacguauggagcaugucccagguacguuaaacaaaauacucugaaguuggccacaggcaugcggaacgugccugaaaaacagacccguggcaucuucggggcuauagccggauuuauugagaaugguugggaaggcaugguagaugggugguauggauuccgccaccagaacuccgagggcacuggucaggcagcugaccucaagucuacacaagccgcgaucgaucagaucaaugggaaacugaacagauuaauugagaagaccaaugaaaaguuucaucagaucgagaaagaguucagcgaaguggaaggcaggauucaagaccuggagaaguacgucgaggauacgaaaauagaccucuggucauauaacgccgaacuucugguggcauuggagaaucagcacaccaucgaucuaacagacagugaaaugaacaagcuguucgagcggacucgaaaacagcuccgcgaaaacgcugaggauaugggaaauggcugcuuuaagauuuaccauaagugugacaacgccugcaucggguccaucagaaauggaaccuacgaccacgauguuuauagggacgaggcucugaacaaucgguuccagauuaaagguguggaacuuaagagcggcuacaaagauuggauacuguggaucucuuuugccauuucaugcuucuugcucugugucgugcuguuaggguuuaucaugugggcaugccaaaagggaaacauucgcuguaauaucugcauauga

SEQ ID NO: 123070 - RNA, 1701 nt, Artificial Sequence
  derived and/or modified sequence opt3 from hemagglutinin__InfluenzaA__ABG48346
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacggaauaaagccuauuccaacuguuaccccuaugacgucccugauuacgcaucucuccgcucgcugguggccucaagcggcacucuggaguuuauaaaugaagacuucaacuggacagguguugcucaggaugggaagaguuaugcaugcaagcgaggauccgugaauaguuucuucagccgucucaacugguuacacaaacuggaguacaaguauccagcccuuaaugucaccaugcccaacaauggcaaauuugacaaguuguacaucuggggcgugcaucacccuuccacggauucagaccaaacuucucuguacguaagagcuagcgggaggguuaccgugucuacaaaacggucccagcagacugucauuccaaacaucggaucacgccccugggugagaggucuaagcaguaggauuucuaucuauuggaccauagugaagccuggcgacauucuccugaucaacuccacagggaaucuuauugccccacggggauacuucaagauccgcaacggcaaaagcucgaucaugcgaucugaugcgccgauugguaauuguuccucagagugcauaacccccaacgggaguaucccuaaugacagaccauuucagaacgucaauaggauuacguauggagcauguccccgguacguuaagcaaaacacucugaaauuggccacaggcaugcguaaugugccugaaaagcagacccgcggcaucuucggggcuauagccggauuuauugagaacgguugggaaggcaugguagaugggugguauggauucagacaccagaauagcgagggcacuggucaggcagcugaccucaaauccacacaagccgcgaucgaucagaucaacgggaagcugaauagguuaauugagaaaaccaacgaaaaguuucaucagaucgagaaggaauuuucugagguggaaggccggauucaagaccuggagaaauacgucgaggauacgaagauagaccucuggagcuauaaugccgaacuucugguggcauuggagaaccagcacaccaucgaucuaacagacucagaaaugaacaaacuguucgagcgaacucgcaagcagcucagagaaaaugcugaggauaugggaaacggcugcuuuaaaauuuaccauaagugugacaaugccugcaucgggaguaucaggaacggaaccuacgaccacgauguuuaucgggacgaggcucugaauaaccgcuuccagauuaaggguguggaacuuaaauccggcuacaaggauuggauacuguggaucagcuuugccauuucuugcuucuugcucugugucgugcuguuaggguuuaucaugugggcaugccaaaaaggaaauauuagauguaacaucugcauauga

SEQ ID NO: 123071 - RNA, 1701 nt, Artificial Sequence; identical to SEQ ID NO: 123069
  derived and/or modified sequence opt3 from hemagglutinin__InfluenzaA__ABG48357

SEQ ID NO: 123072 - RNA, 1701 nt, Artificial Sequence
  derived and/or modified sequence opt3 from hemagglutinin__InfluenzaA__ABG48368
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggaagccgccccugggugagaggucuaaguucuaggauuuccaucuauuggaccauagugaagccuggcgacauucuccugaucaacagcacagggaaccuuauugccccacggggauacuucaagauccgcaauggcaaaucgucuaucaugcgauccgaugcgccgauugguaacuguucaagugagugcauaacccccaaugggagcaucccuaacgacaagccauuucagaaugucaacagaauuacguauggagcaugucccagguacguuaaacaaaauacucugaaguuggccacaggcaugcggaacgugccugaaaaacagacccguggcaucuucggggcuauagccggauuuauugagaaugguugggaaggcaugguagaugggugguauggauuccgccaccagaacuccgagggcacuggucaggcagcugaccucaagucuacacaagccgcgaucgaucagaucaaugggaaacugaacagauuaauugagaagaccaaugaaaaguuucaucagaucgagaaagaguucagcgaaguggaaggcaggauucaagaccuggagaaguacgucgaggauacgaaaauagaccucuggucauauaacgccgaacuucugguggcauuggagaaucagcacaccaucgaucuaacagacagugaaaugaacaagcuguucgagcggacucgaaaacagcuccgcgaaaacgcugaggauaugggaaauggcugcuuuaagguuuaccauaagugugacaacgccugcauugaguccaucagaaaugggaccuacgaccacgauguguauagggacgaagcucugaacaaucgguuccagaucaaaggagucgagcuuaagagcgguuacaaagauuggauucuguggauaucuuuugccaucucaugcuucuugcucugugugguacuguuaggcuuuauuaugugggcaugccaaaaggggaacauccgcuguaauauuugcaucuga

SEQ ID NO: 123073 - RNA, 1701 nt, Artificial Sequence; identical to SEQ ID NO: 122923
  derived and/or modified sequence opt3 from hemagglutinin__InfluenzaA__ABG67135

SEQ ID NO: 123074 - RNA, 1701 nt, Artificial Sequence; identical to SEQ ID NO: 122799
  derived and/or modified sequence opt3 from hemagglutinin__InfluenzaA__ABG67146

SEQ ID NO: 123075 - RNA, 1701 nt, Artificial Sequence
  derived and/or modified sequence opt3 from hemagglutinin__InfluenzaA__ABG67157
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcaauaguccgcacaggauuaucgacggcaaaaacuguacccucauagaugcucugcuuggggacccccauugcgauggauuucagaauaaggagugggaccuguucguggaacggagcaaagccuauuccaacuguuacccuuaugaugucccagacuacgcaucuuugcgcucgcucguggccucaagcggcacucuggaguuuaucaaugaaaacuucaauuggacagguguugcucaggaugggaagaguuaugcaugcaagcgaggauccgugaacucuuucuucagccgucugaauuggcuccacaaauuagaguacaaguaucccgcccugaacgucaccaugccuaauaacggcaaauuugacaagcuauacauuuggggcgugcaucacccauccacggauucagaccaaaccaguuuguacguaagagcuagcgggaggguuacugugucuacaaaacggucccagcagacugucauccccgauauuggauaucgcccuugggugagaggucugucaagcaggaucaguauauacuggaccauugugaagccaggcgacauccuacucauuaacucuacagggaaucugaucgccccgcggggauauuucaaacuucgcaacggcaaguccagcaucaugcgaucggacgcgcccauugguaauuguucuuccgagugcauaaccccuaacgggucaaucccaaaugauaagcccuuucagaacgucaauagaauuacguacggagcauguccuagguauaucaaacaaaacacucugaaguuggccacaggcaugcggaauguuccagaaaaacagacccguggcauauucggggcuauugccggauuuaucgagaacgguugggaaggcaugguggacgggugguacggauuccgccaccagaauagugagggcacuggucaggcagcugaucucaagagcacacaagccgcgaucgaccagauuaacgggaaacugaauagauuaguagagaagaccaacgaaaaguuucaucagaucgagaaagaauuuuccgagguggaaggcaggauucaagaucuggagaaguaugucgaggacacgaaaauagaucucuggucuuacaaugccgaacuucugguggcauuggagaaccagcacaccaucgaccuaacagauagcgaaaugaacaagcuguucgagcggacuaaaaagcagcuccgagaaaaugcugaggacaugggaaacggcugcuuuaagauuuaccauaaaugugauaaugccugcaucgggucaauccgcaacggaaccuaugaccacgacguuuacagagaugaggcucugaauaacagguuccagauuaaggguguggaacuuaaaaguggcuauaaggacuggauacuguggaucuccuuugccauuagcugcuucuugcucugugucgugcuguuaggguuuaucaugugggcaugccaaaaaggaaauauucgguguaacaucugcauauga

SEQ ID NO: 123076 - RNA, 1701 nt, Artificial Sequence; identical to SEQ ID NO: 123000
  derived and/or modified sequence opt3 from hemagglutinin__InfluenzaA__ABG67168

SEQ ID NO: 123077 - RNA, 1701 nt, Artificial Sequence; identical to SEQ ID NO: 123000
  derived and/or modified sequence opt3 from hemagglutinin__InfluenzaA__ABG67179

SEQ ID NO: 123078 - RNA, 1701 nt, Artificial Sequence
  derived and/or modified sequence opt3 from hemagglutinin__InfluenzaA__ABG67190
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuuuuccaacagguagaaucugcgacucaccgcacaggauucucgauggcaaaaauuguacccugaucgacgcucuacugggggauccccauugcgacggauuccagaacaaggagugggauuuguuuguggaacggaguaaagccuauagcaauuguuacccuuaugacgucccagauuacgcaucccuccgcucucugguggccucgucaggcacucuggaguucacaaacgaaaauuuuaacuggaccgguguugcucaggacgggaaguccuaugcaugcaagcgaggaagugugaauagcuucuuuucucgucucaacugguuacacaaacuggaguacaaguaucccgcccuuaaugucacgaugccuaacaauggcaaauucgauaaguuguacauauggggcgugcaucacccaagcacugacuccgaucaaaccucacuguacguaagagcuagugggaaaguuacagugagcacuaagaggucucagcagaccgucauccccgacauuggauaucggccuugggugcgcggucuauccucaagaaucagcauuuacuggacaaucgugaagccaggcgacauacuccugauuaacaguaccgggaaccuuaucgccccgaggggauauuuuaaaauucggaauggcaagucuuccaucaugcgcagcgaugcgcccaucgguaacuguucgucugagugcauuacgccuaauggguccauaccaaacgacaaacccuuccagaaugucaaccgaaucacuuacggagcauguccuagauauguuaagcaaaauacacugaaauuggccaccggcaugaggaacgugccagaaaagcagacucggggcauuuuuggggcuaucgccggauucauagagaaugguugggaaggcaugguagaugggugguacggauuucgucaccagaacucagagggcacaggucaggcagcugaccucaaaaguacccaagccgcgauugaucagaucaaugggaagcugaaccgcuuaguggagaagacgaaugaaaaauuccaucagaucgagaaggaguucagcgaagucgaaggcaggauucaagaccuggagaaauauguggaggauaccaagaucgaccucugguccuacaacgccgaacuucugguugcauuggagaaucagcacacaauugaucuaacugacucugaaaugaacaaacuguuugagagaacccggaagcagcuccgagaaaacgcugaggauaugggaaauggcugcuucaagauauaccauaaaugugacaacgccugcaucgggagcauucgcaauggaacauaugaccacgauguguacagagacgaggcucugaacaauagguuucagaucaagggugucgaacuuaaaucaggcuauaaggauuggauccuguggauuaguuucgccauauccugcuuuuugcucugugugguacuguuaggguucaucaugugggcaugccaaaaaggaaacauucgguguaauaucugcauuuga

SEQ ID NO: 123079 - RNA, 1701 nt, Artificial Sequence
  derived and/or modified sequence opt3 from hemagglutinin__InfluenzaA__ABG67212
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacagauauccagcccuuaacgucaccaugcccaauaacggcaaguuugacaaauuguacaucuggggcgugcaucacccuucaacggauagugaccaaacuagccuguacguaagggcuucugggcggguuaccguguccacaaagcgcucacagcagacugucauuccaaauaucggauucagacccugggugaggggucuaagcagucggauuucuaucuauuggaccauagugaaaccuggcgacauucuccugaucaacuccacagggaaccuuauugccccacgcggauacuuuaagauccgaaauggcaagagcucgaucaugagaucugaugcgccgauugguaacuguuccucagagugcauaacccccaaugggaguaucccuaacgacaaaccauuccagaaugucaacaggauuacguauggagcauguccccgguacguuaagcaaaauacucugaaauuggccacaggcaugcguaacgugccugaaaagcagacccgcggcaucuuuggggcuauagccggauucauugagaaugguugggaaggcaugguagaugggugguauggauuuagacaccagaacagcgagggcacuggucaggcagcugaccucaaauccacacaagccgcgaucgaucagaucaaugggaagcugaacagguuaauugagaaaaccaaugaaaaguuccaucagaucgagaaggaguucucugaaguggaaggccggauucaagaccuggagaaauacgucgaggauacgaagauagaccucuggagcuauaacgccggacuucugguggcauuggaaaaucagcacaccaucgaucuaacagacucagagaugaacaaacuguuugaacgaacucgcaagcagcucagagagaacgcugaagauaugggcaaugggugcuucaaaauuuaccauaagugugacaacgccugcaucggaaguaucaggaaugguaccuacgaccacgauguuuaucgggacgaggcucugaacaaucgcuuucagauuaagggcguggagcuuaaauccggguacaaggauuggauacuguggaucagcuucgccauuucuugcuuuuugcucugugucgugcuguuaggauucaucaugugggcaugccaaaaaggcaacauuagauguaauaucugcauauga

SEQ ID NO: 123080 - RNA, 1701 nt, Artificial Sequence; identical to SEQ ID NO: 123040
  derived and/or modified sequence opt3 from hemagglutinin__InfluenzaA__ABG67223

SEQ ID NO: 123081 - RNA, 1701 nt, Artificial Sequence
  derived and/or modified sequence opt3 from hemagglutinin__InfluenzaA__ABG67234
augaagaccaucauugcccugagcuacauacucugccuuguguucgcucagaaacugcccggcgacgauaacuccacagcaacuuuguguuuagggcaccaugccgucccuaauggaacgcugguuaagaccaucacaaacgaccaaauugaggugacuaaugcgaccgaacuuguacagucuucaaguacagguagaaucugcgauagcccacacaggauucucgacggcaaaaacuguacccugaucgaugcucuacugggggacccgcauugcgauggauuucagaauaaggagugggacuuguucguggaacgguccaaagccuauucuaacuguuaccccuaugaugucccugacuacgcaucgcuccgcucacugguggccagcaguggcacucuggaguuuauaaaugaagauuucaacuggacagguguugcucaggacgggaaguccuaugcaugcaagcgaggaucugugaauagcuuuuucucccgucucaacugguuacacaaacuggaguacaaguauccagcccuuaaugucaccaugcccaacaauggcaaauuugauaaguuguacaucuggggcgugcaucacccuucaacggacagugaccaaacuagccuguacguaagagcuucugggaggguuaccguguccacaaaacggucacagcagacugucauuccaaacaucggauuccgccccugggugagaggucuaagcaguaggauuucuaucuauuggaccauaguggagccuggcgauauucuccugaucaauuccacagggaaccuuauugccccacggggauacuuuaagauccgcaacggcaagagcucgaucaugcgaucugacgcgccgauugguaauuguuccucagaaugcauaacccccaacgggaguaucccuaaugauaaaccauuccagaacgucaauagaauuacguauggagcaugucccagguacguuaagcaaaacacucugaaauuggccacaggcaugcggaaugugccugagaagcagacccguggcaucuuuggggcuauagccggauucauugaaaacgguugggagggcaugguagacgggugguauggauuucgccaccagaauagcgagggcacuggucaggcagcugaucucaaauccacacaagccgcgaucgaccagaucaacgggaagcugaauagauuaauugagaaaaccaacgaaaaguuccaucagaucgaaaaggaguucucugaaguggagggcaggauucaagaucuggagaaauacgucgaagacacgaagauagaucucuggagcuauaaugccggacuucugguggcauuggagaaccagcacaccaucgaccuaacagauucagaaaugaauaaacuguuugagcggacucgaaagcagcuccgcgaaaacgcugaggacaugggcaacgggugcuucaaaauuuaccauaagugugacaaugccugcaucggaaguaucagaaacgguaccuacgaucacgacguuuauagggaugaggcucugaauaaccgguuucagauuaagggcguggaacuuaaauccggguacaaggacuggauacuguggaucagcuucgccauuucuugcuuuuugcucugugucgugcuguuaggauucaucaugugggcaugccaaaaaggcaauauucgcuguaacaucugcauauga

SEQ ID NO: 123082 - RNA, 1701 nt, Artificial Sequence
  derived and/or modified sequence opt3 from hemagglutinin__InfluenzaA__ABG67245
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaagauccgcaauggcaaaagcucgaucaugcgaucugaugcgccgauugguaacuguuccucagagugcauaacccccaaugggaguaucccuaacgacaagccauuccagaaugucaacagaauuacguauggagcaugucccagguacguuaaacaaaauacucugaaguuggccacaggcaugcggaacgugccugaaaaacagacccguggcaucuuuggggcuauagccggauucauugagaaugguugggaaggcaugguagaugggugguauggauuucgccaccagaacagcgagggcacuggucaggcagcugaccucaaguccacacaagccgcgaucgaucagaucgacgggaaacugaauagauuaauugagaagaccaacgaaaaguuccaucagaucgagaaagaguucucugaaguggaaggcaggauucaagaucuggagaaguacgucgaggacacgaaaauagaucucuggagcuauaaugccggacuucugguggcauuggaaaaccagcacaccaucgaccuaacagauucagagaugaauaagcuguuugaacggacucgaaaacagcuccgcgagaacgcugaagacaugggcaacgggugcuucaagauuuaccauaagugugacaaugccugcaucggaaguaucagaaacgguaccuacgaucacgacguuuauagggaugaggcucugaauaaccgguuucagauuaaaggcguggagcuuaaguccggguacaaagacuggauacuguggaucagcuucgccauuucuugcuuuuugcucugugucgugcuguuaggauucaucaugugggcaugccaaaagggcaauauucgcuguaacaucugcauauga

SEQ ID NO: 123083 - RNA, 1698 nt, Artificial Sequence; identical to SEQ ID NO: 122758
  derived and/or modified sequence opt3 from hemagglutinin__InfluenzaA__ABG67477

SEQ ID NO: 123084 - RNA, 1698 nt, Artificial Sequence; identical to SEQ ID NO: 122816
  derived and/or modified sequence opt3 from hemagglutinin__InfluenzaA__ABG67491

SEQ ID NO: 123085 - RNA, 1701 nt, Artificial Sequence
  derived and/or modified sequence opt3 from hemagglutinin__InfluenzaA__ABG67502
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucucggauuacgugucacuccggagccugguugcaaguuccggcacucuggaauuuaacaaugagucuuucaacuggacagguguggcccaaaaugggaccagcuccgcuugcaaacgccgaucagacaagagcuuuuucagucgucucaacugguuacaccagcugaaguauaaauacccugcacuuaaugucacgaugccaaacaaugagaaguuugauaaauuguauauauggggagugcaucaccccggcacugacucugaucagaucucccuguacgcccaggcuucaggcagaguaaccguuagcacaaagaggagucaacagacugugauuccuaacaucgggucucggccauggguccgcggaauuuccagcagaaucucgauauacuggaccauugugaaacccggugacauccuacucauuaacucuacaggcaaucugaucgccccuaggggguauuucaagauccgguccggaaagucaaguauuaugcgcagcgacgcgccaauaggcaaauguaacuccgaaugcaucaccccgaaugguucuauucccaacgauaagccuuuucagaaugugaaccgaaucacguacgggccaugucccagauaugucaaacagaauacucuuaagcuggcaacaggaaugaggaacguuccugagaaacaaacccggggcauauucggcgccauugcuggguuuaucgaaaauggaugggaggguaugauggacggcugguacggguuccgucaccagaacagcgagggaacuggccaggccgcagauuugaagucaacacaagcugccaucaaucagauuaacgguaaacucaaucgccugaucgaaaagaccaacgagaaguuucaucagauugaaaaagaguucagugaaguggaggggagaauacaggacuuagagaaguauguagaagauacgaaaaucgaccugugguccuacaaugcggagcuccuuguggcccuggaaaaccaacacaccauugauuugacagacagcgagaugaacaagcuauucgaaaggacuaaaaagcagcugcgggagaaugcagaggauaugggcaacggaugcuuuaagaucuaucauaaaugugacaaugcuugcaucggcucuauucgaaacgggaccuacgaucacgacgucuaccgcgacgaagcccucaauaacagauuccagauaaagggaguggagcugaaaucagguuauaaggauuggauccuuuggauuaguuuugcuaucagcugcuuccuguuguguauuguucuccugggcuuuaucaugugggccugccagaaagggaauauaagguguaacaucugcauuuga

SEQ ID NO: 123086 - RNA, 1701 nt, Artificial Sequence
  derived and/or modified sequence opt3 from hemagglutinin__InfluenzaA__ABG67524
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagaggucccgggccuauucuaauuguuaccccuaugacgucccugauuacgugucgcuccgcucacugguugcaagcaguggcacucuggaauuuaacaaugaguccuucaacuggacagguguggcccaaaaugggaccucuagcgcuugcaagcgacguuccgacaaaucauuuuucaguagacucaacugguuacaccagcugaaguauaaguacccagcacuuaaugucacgaugcccaacaaugagaaauuugauaaguuguauauauggggagugcaucacccuggcacugacagcgaucagaucucucuguacgcccaggcuuccggcaggguaaccguuucaacaaaacggagccaacagacugugauuccaaacaucgggagucgccccugggucagaggagugucuuccaggauuagcaucuacuggaccauagugaagccuggugacauucuacucaucaacucgacaggcaaucugauugccccacggggguauuucaaaauccgcucuggaaaguccucaaucaugcgaagugacgcgccgauuggcaaguguaacagcgaaugcauaacccccaaugguuccaucccuaacgauaaaccauuucagaaugucaacagaauuacguacgggcccuguccuagguauguuaagcagaauacucuuaaacuggcaacaggaaugcggaacgugccagagaagcaaacccguggcaucuucggcgccauagcuggguuuauugaaaauggaugggaggguaugauggacggcugguacggguuccgccaccagaacucugagggaacuggccaggccgcagauuugaaaagcacacaagcugccguaaaucagaucaacgguaagcucaauagacugaucgagaaaaccaacgaaaaguuucaucagauugaaaaggaguucucagaaguggaggggaggauccaggacuuagagaaauaugucgaagauacgaagauugaccuguggaguuacaaugcggagcuccuuguggcccuggaaaaccaacacaccauagauuugacagacuccgagaugaacaaacuauucgaacggacuaagaaacagcugcgagagaaugcagaggauaugggcaacggaugcuuuaagaucuaucauaagugugacaaugcuugcauuggcagcauccgcaacgggaccuacgaucacgacguuuacagagacgaagcccucaauaacagguuccagaucaaaggaguggagcugaagucugguuauaaagauuggauucuuuggauaucauuugcuaucaguugcuuccuguuguguauuguccuccugggcuuuaucaugugggccugccagaaggggaauauucgguguaacaucugcauauga

SEQ ID NO: 123087 - RNA, 1701 nt, Artificial Sequence; identical to SEQ ID NO: 122578
  derived and/or modified sequence opt3 from hemagglutinin__InfluenzaA__ABG67535

SEQ ID NO: 123088 - RNA, 1701 nt, Artificial Sequence; identical to SEQ ID NO: 122532
  derived and/or modified sequence opt3 from hemagglutinin__InfluenzaA__ABG67546

SEQ ID NO: 123089 - RNA, 1701 nt, Artificial Sequence
  derived and/or modified sequence opt3 from hemagglutinin__InfluenzaA__ABG67557
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacagcgaucagauuucuuuguaugcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguacuucaagauucggucuggaaaauccucaauaaugcgcagugaugcgccgaucggcaaguguaacagcgagugcauuacucccaaugguuccaucccuaacgacaaaccauuucagaaugugaaccgaauaacauauggggcaugucccagauacgugaagcagaauacccugaaacuugccacuggaaugaggaacgucccugaaaagcaaacacggggcauuuucggcgcuaucgccggguuuaucgagaauggaugggaagguaugguugauggcugguauggguuccgucaccagaacucugagggaaccggccaggcagcugaccugaaaagcacgcaagccaccauuaaucagaucaacgguaaguugaaucgccucauugggaagacaaacgagaaauuucaucagauagaaaaggaguucucagaaguggagggcagaauccaggaucuggaaaaauacguagaggacacuaagauugauuuauggaguuauaaugcggagcugcucguggcccuugaaaaccaacacaccaucgaccugacagauuccgagaugaacaaauuguucgaaaggacuaagaagcagcuacgggagaaugcagaagacaugggaaacggcugcuuuaaaaucuaccauaagugugauaaugcuugcauugggagcauacgaaacggaaccuaugaccacgacgucuaccgcgaugaggcccugaauaacagauuccagaucaaagguguggagcucaagucuggcuacaaagacuggauucuguggaucucauuugcuauuaguugcuuccuucuguguguugccuugcucggguuuaucaugugggcaugccagaagggaaauauaagguguaacaucugcauuuga

SEQ ID NO: 123090 - RNA, 1701 nt, Artificial Sequence; identical to SEQ ID NO: 122532
  derived and/or modified sequence opt3 from hemagglutinin__InfluenzaA__ABG67568

SEQ ID NO: 123091 - RNA, 1701 nt, Artificial Sequence; identical to SEQ ID NO: 122532
  derived and/or modified sequence opt3 from hemagglutinin__InfluenzaA__ABG67579

SEQ ID NO: 123092 - RNA, 1701 nt, Artificial Sequence; identical to SEQ ID NO: 122532
  derived and/or modified sequence opt3 from hemagglutinin__InfluenzaA__ABG67590

SEQ ID NO: 123093 - RNA, 1701 nt, Artificial Sequence; identical to SEQ ID NO: 122532
  derived and/or modified sequence opt3 from hemagglutinin__InfluenzaA__ABG67601

SEQ ID NO: 123094 - RNA, 1701 nt, Artificial Sequence; identical to SEQ ID NO: 122532
  derived and/or modified sequence opt3 from hemagglutinin__InfluenzaA__ABG67612

SEQ ID NO: 123095 - RNA, 1701 nt, Artificial Sequence; identical to SEQ ID NO: 122532
  derived and/or modified sequence opt3 from hemagglutinin__InfluenzaA__ABG67623

SEQ ID NO: 123096 - RNA, 1701 nt, Artificial Sequence
  derived and/or modified sequence opt3 from hemagglutinin__InfluenzaA__ABG67634
augaagaccaucauugcccugagcuacauacucugccuuguguucgcucagaaacugcccggcaacgacaauaacacagcaacuuuguguuuagggcaccaugccgucccuaauggaacgaucguuaagaccauuacaaacgaucaaaucgaggugacuaaugcgaccgaacugguacaguccucuucaacagguggcauuugcgacaguccacaccagauccuagauggggagaacuguacccucauagacgcucugcuuggagauccgcagugcgacggcuuucaaaauaaaaagugggaucuguucguggaaagaagcaaagccuauuccaacuguuaccccuaugacgucccugaucaugcaucuuugaggucgcucguggccucaagcgguacucuggaguuuaauaacgaaaguuucgacuggacagggguuacccagaauggaacguccucugcuugcaagcggcgcagcaacaaguccuuuuucucacgacugaauuggcucacucacuuaaaauacaaguauccagcacugaacgugaccaugcccaauaacgagaaauuugauaaacuuuacaucuggggcguccaucacccuggcacagacagugaucagauuagcuuguaugcccaggcuucugggcguaucacuguguccaccaagagaucacaacagacaguaauuccaaacaucggaagcaggccccggguucgcgacgugaguucuagaauauccauuuacuggaccaucgucaagccuggugacauucugcuaaucaauagcacgggcaaccucaucgccccaaggggguacuucaagauucggucgggaaaaucuuccauaaugcgcucagaugcgccgaucggcaaguguaauagugagugcauuacucccaacgguagcaucccuaaugacaaaccauuucagaacgugaaucgaauaacauauggggcaugucccagauacgugaagcagaacacccugaaacuugccacuggaaugaggaaugucccugaaaagcaaacacggggcauuuucggcgcuaucgccggguuuaucgagaacggaugggaagguaugguugauggcugguauggguuccgucaccaaaauuccgagggaaccggccaggcagcugaccugaaaucuacgcaggccgcgauuaaccagaucaaugguaaguugaaccgccucauugggaagaccaaugagaaauuucaucagauagaaaaggaguucagcgaaguggagggcagaauccaggaucuggaaaaauacguagaggacacaaagauugauuuauggucauauaacgccgagcugcucguggcacuugaaaaccaacacacuaucgaccugaccgauaguaaaaugaauaaguuguucgagaggacaaagaaacagcuacgggaaaacgcugaggacaugggaaauggcugcuuuaagaucuaccauaaaugugauaacgccugcauuggguccauacgaaauggaacuuaugaccacgacgucuaccgcgaugaagcucugaacaauagauuccagaucaaggguguggagcucaaaagcggcuacaaggacuggauucuguggaucucuuuugccauuucaugcuuccuucuguguguugcauugcucggguuuaucaugugggccugccagaagggaaacauaagguguaauaucugcauuuga

SEQ ID NO: 123097 - RNA, 1701 nt, Artificial Sequence; identical to SEQ ID NO: 122532
  derived and/or modified sequence opt3 from hemagglutinin__InfluenzaA__ABG67645

SEQ ID NO: 123098 - RNA, 1701 nt, Artificial Sequence
  derived and/or modified sequence opt3 from hemagglutinin__InfluenzaA__ABG67656
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacugggcugggguuacacagaacggaaccucuagcgcaugcaagcggcgcuccaauaagucauuuuucagucgacugaacuggcucacgcacuuaaaauacaaguauccagcccugaaugugacuaugcccaacaaugagaaauuugauaaacuuuacaucuggggcguccaucacccuggcaccgacagcgaucagauuucuuuguaugcucaggccuccgggcguaucacagugucaacuaagagaagccaacagaccguaauuccaaacaucggaaguaggccccggguucgcgacgugucuuccagaauaagcauuuacuggacaaucgucaagccuggugacauucugcuaaucaacucgaccggcaaucucaucgcgccaaggggguacuucaagauucggucuggaaaauccucaauaaugcgcagugaugcaccgaucggcaaguguaacagcgagugcauuacgcccaaugguuccaucccuaacgacaaaccauuucagaaugugaaccgaauaacuuauggggccugucccagauacgugaagcagaauacacugaaacuugcuaccggaaugaggaacgucccugaaaagcaaacucggggcauuuucggcgccaucgcaggguuuaucgagaauggaugggaagguaugguugauggcugguauggguuccgucaccagaacucugagggaacaggccaggcugccgaccugaaaagcacccaagcggccauuaaucagaucaacgguaaguugaaucgccucauugggaagacgaacgagaaauuucaucagauagaaaaggaguucucagaaaucgagggcaggauucaggaucuggaaaaauacguggaggacaccaagaucgauuuauggaguuauaaugcagagcugcucguagcucuugaaaaccaacacacaaucgaccugacugauuccgagaugaacaaauuguucgaaagaaccaagaagcagcuacgggagaaugccgaagacaugggaaacggcugcuuuaaaauuuaccauaagugugauaaugcuugcauagggagcauccgaaacggaacauaugaccacgacguguaccgcgaugaggcccugaauaacagauuccagauuaaaggugucgagcucaagucuggcuacaaagacuggauccuguggauuucauuugcaaucaguugcuuccuucuguguguggccuugcucggguuuauaaugugggcuugccagaagggaaauaucagguguaacauuugcaucuga

SEQ ID NO: 123099 - RNA, 1701 nt, Artificial Sequence
  derived and/or modified sequence opt3 from hemagglutinin__InfluenzaA__ABG67667
augaagaccaucauugcccugagcuacauacucugccagguguucgcucaaaaacuucccggcaacgacaauuccacagcaacucuguguuuggggcaccaugccgucccuaacggaacguuaguuaagaccaucacaaaugaucagauugaggugacuaacgcgaccgaacugguacagucuucaaguacagguagaaucugcgacagcccacacaggauucuagauggcaaaaauuguacccucaucgacgcucugcuuggggauccgcauugcgacggauuucagaacaaggagugggaucuguucguggaacgguccaaagccuauucuaauuguuaccccuaugacgucccugauuacgcaucguugcgcucacucguggccagcaguggcacucuggaguuuacaaacgaagguuucaauuggauagggguugcucaagacggaaaguccuaugcaugcaagcgaggcucugugaacagcuuuuucucccgucugaauuggcuccacaaauuagaguacaaguauccagcccugaacgucaccaugcccaauaacgauaaauuugacaaacuuuacaucuggggcgugcaucacccuucaacggauagugaccagacuagcuuguacguacaggcuucugggagaguuaccguguccacaaagaggucacagcaaacugucauuccaaauaucggaagccggcccugggugcgcgguauuaguucuagaaucuccauauauuggaccauugugaagccuggcgacauccugcuaauuaacagcacagggaaccucaucgccccaaggggauacuucaagauccggaauggcaaaucgucuauuaugcgcuccgaugcgccgauagacaacuguaauucagagugcaucacccccaacgguaguauuccuaaugauaagccauuucagaacgucaaucgaaucacguauggggcaugucccagauacguuaaacagaacacucugaaacuugccacaggaaugaggaaugugccugaaaagcagacccggggcauauucggcgcuauugccggguuuaucgagaacggaugggaagguaugaucgacggcugguauggguuccgucaccaaaauagcgagggaacuggccaggcagcugaucugaaguccacacaggccgcgauugaccaaaucaacgguaaauugaaucgccucauugagaagaccaacgaaaaguuucaucagauagagaaagaguucucugaaguagaagggagaauccaggaucuggagaaguacguggaggacacgaaaauugauuuauggagcuauaaugccgaacugcucgucgcacuugagaaccagcacaccaucgaccugacagauucagaaaugaacaaguuguucgagaggacucggaaacaacuacgagaaaaugcugaggacaugggcaacggaugcuuuaagaucuaccauaagugugacaaugccugcauuggcaguauacgcaacgggaccuacgaucacgacguguauagagaugaggcucugaauaacagguuccagaucaaaggaguugaacucaaguccgguuacaaagacuggauucuguggaucagcuuugccauuucuugcuuccuucuguguguggucuugcucggcuuuaucaugugggcaugccagaaggggaauauacgguguaacaucugcauuuga

SEQ ID NO: 123100 - RNA, 1701 nt, Artificial Sequence
  derived and/or modified sequence opt3 from hemagglutinin__InfluenzaA__ABG79941
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucuacacaagcggccaucaaccagaucaaugguaaacucaaccgucugauugaaaagaccaaugagaaguuucaucagaucgaaaaagaguucucagaaguagaggggcgcauucaggauuuagagaaguauguggaagacacgaaaauagaucuguggaguuacaacgcagagcuccuugucgcucuggaaaaccaacacaccaucgacuugacagauuccgagaugaauaagcuauucgaaagaacuaaaaagcagcugagggagaacgccgaggacaugggcaauggauguuuuaagauuuaucauaaaugcgauaacgcuugcaucggcagcauccggaaugggaccuacgaccacgauguguaccgagacgaagcccucaacaaucgcuuccagauuaagggaguugagcugaaaucugguuauaaggacuggauacuuuggaucucauuugcaauuaguuguuuccuguugugcgugguccuccugggcuuuaucaugugggccugucagaaagggaacauuagaugcagcaucuguauauga

SEQ ID NO: 123101 - RNA, 1701 nt, Artificial Sequence; identical to SEQ ID NO: 122937
  derived and/or modified sequence opt3 from hemagglutinin__InfluenzaA__ABG79952

SEQ ID NO: 123102 - RNA, 1701 nt, Artificial Sequence; identical to SEQ ID NO: 123000
  derived and/or modified sequence opt3 from hemagglutinin__InfluenzaA__ABG79974

SEQ ID NO: 123103 - RNA, 1701 nt, Artificial Sequence; identical to SEQ ID NO: 123000
  derived and/or modified sequence opt3 from hemagglutinin__InfluenzaA__ABG79985

SEQ ID NO: 123104 - RNA, 1701 nt, Artificial Sequence
  derived and/or modified sequence opt3 from hemagglutinin__InfluenzaA__ABG79996
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcgacaguccgcacaggauucucgauggcaaaaauuguacccugaucgacgcucuacugggggauccccauugcgacggauuucagaacaaggagugggauuuguucguggaacggagcaaagccuauuccaauuguuacccuuaugacgucccagauuacgcaucucuccgcucgcugguggccucaagcggcacucuggaguuuacaaacgaaaauuucaacuggaccgguguugcucaggacgggaagaguuauuccugcaagcgaggaucugugaauagcuuuuucucccgucucaacugguuacacaaacuggaguacaaguaucccgcacuuaaugucacgaugccuaacaauggcaaauuugauaaguuguacauauggggcgugcaucacccaucaacugacagugaucaaaccagccuguacguaagagccucugggaaaguuacaguguccacuaagaggucacagcagaccgucauccccgacauuggauaucggccuugggugcgcggucuaagcaguagaaucucuauuuacuggacaaucgugaagccaggcgacauacuccugauuaacuccaccgggaaccuuaucgcuccgaggggauauuucaaaauucggaauggcaagagcucgaucaugcgcucugaugcccccaucgguaacuguuccucagagugcauuacgccuaaugggaguauaccaaacgacaaacccuuucagaaugucaaccgaaucacuuacggagcguguccuagauauguuaagcaaaauacacugaaauuggcaaccggcaugaggaacgugccagaaaagcagacucggggcauuuucggggccaucgcuggauuuauagagaaugguugggaaggcaugguagaugggugguacggauuccgucaccagaacagcgagggcacaggucaggccgcagaccucaaauccacccaagcugccauugaucagaucaaugggaagcugaaccgcuuaguggagaagacgaaugaaaaauuucaucagaucgagaaggaguucucugaagucgaaggcaggauucaagaccuggagaaauauguggaggauaccaagaucgaccucuggagcuacaacgcggaacuucugguugccuuggagaaucagcacacaauugaucuaacugacucagaaaugaacaaacuguucgagagaacccggaagcagcuccgagaaaacgcagaggauaugggaaauggcugcuuuaagauauaccauaaaugugacaacgcuugcaucgggaguauucgcaauggaacauaugaccacgauguguacagagacgaggcccugaacaauagguuccagaucaagggugucgaacuuaaauccggcuauaaggauuggauccuguggauuagcuuugcuauaucuugcuucuugcucugugugguacuguuaggguuuaucaugugggccugccaaaaaggaaacauucgguguaauaucugcauuuga

SEQ ID NO: 123105 - RNA, 1701 nt, Artificial Sequence; identical to SEQ ID NO: 123000
  derived and/or modified sequence opt3 from hemagglutinin__InfluenzaA__ABG80007

SEQ ID NO: 123106 - RNA, 1701 nt, Artificial Sequence; identical to SEQ ID NO: 123000
  derived and/or modified sequence opt3 from hemagglutinin__InfluenzaA__ABG80018

SEQ ID NO: 123107 - RNA, 1701 nt, Artificial Sequence; identical to SEQ ID NO: 123005
  derived and/or modified sequence opt3 from hemagglutinin__InfluenzaA__ABG80029

SEQ ID NO: 123108 - RNA, 1701 nt, Artificial Sequence; identical to SEQ ID NO: 123005
  derived and/or modified sequence opt3 from hemagglutinin__InfluenzaA__ABG80040

SEQ ID NO: 123109 - RNA, 1701 nt, Artificial Sequence; identical to SEQ ID NO: 123000
  derived and/or modified sequence opt3 from hemagglutinin__InfluenzaA__ABG80051

SEQ ID NO: 123110 - RNA, 1701 nt, Artificial Sequence
  derived and/or modified sequence opt3 from hemagglutinin__InfluenzaA__ABG80062
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaaggaagguuucaacuggaccgggguugcucaggacggaaaguccuaugcaugcaaacgaggcucugugaauagcuuuuucucccgucucaacugguuacacaagcuggaguacaaauauccagcccuuaaugucacgaugcccaacaaugauaaguuugacaaauuguacauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccaucuauuggacaauagugaagccuggcgacauucuacucaucaauagcaccgggaaccugauugccccaaggggauacuucaaaauccggaacggcaagucgucuaucaugcgcuccgaugcgccgauugguaauuguaacucagagugcauaacgcccaaugggaguaucccuaacgacaaaccauuucaaaaugucaaccgaauuacuuauggagcaugucccagauacguuaagcagaauacacuuaaacuggccaccggcaugaggaacgugccugaaaagcagacucggggcaucuucggggcuauagccggauuuauugagaaugguugggaaggcaugguagaugggugguauggauuccgucaccagaacagcgagggcacaggucaagcagcugacuugaaauccacccaggccgcgaucgaucagaucaaugggaagcucaaccgccugauugagaagacgaaugaaaaauuucaucaaaucgagaaggaguucucugaaguggaaggcaggauucaggacuuagagaaauacgucgaggauaccaagauagaccuguggagcuauaacgccgaacuccuuguggcacuggagaaucagcacacaaucgauuugacugacucagaaaugaacaaacuauucgagagaacccggaagcagcugcgagaaaacgcugaggauaugggaaauggcugcuuuaagauuuaccauaaaugugacaacgccugcaucgggaguauccgcaauggaacauacgaccacgauguuuauagagacgaggcucucaacaauagguuccaaauuaaggguguggaacugaaaacuggcuacaaggauuggauacuuuggaucuccuuugccauuagcugcuuccuguugugugucgugcuccugggguuuaucaugugggcaugccagaaaggaaacauucgguguaauaucugcauauga

SEQ ID NO: 123111 - RNA, 1701 nt, Artificial Sequence
  derived and/or modified sequence opt3 from hemagglutinin__InfluenzaA__ABG80073
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgaacugcgacggauuucagaauaaggagugggauuuguucguggaacgguccaaagccuauucuaacuguuaccccuaugacgucccugauuacgcaucgcuccgcucacugguggccagcaguggcacucuggaguuuacaaaugaagacuucaacuggaccgguguugcucaggaugggggauccuaugcaugcaagcgaggcucugugaauagcuuuuucucccgucucaacugguuacauaagcuggaguacaaauauccagcccuuaaugucacgaugcccaacaauggcaaguuugacaaauuguacauauggggagugcaccauccuucaacugauagugaccaaaccagccuguacguaagagcuucugggaggguuacaguguccacuaagcggucacagcagaccgucacaccaaacaucgguagccgccccugggugagaggccuaaguucuaggauuuccaucuauuggaccauugugaaaccuggggacauccuccugauaaacagcacgggaaaucuuauugccccacggggcuacuucaagauccgcaacgguaagucgucuauuaugcgauccgaugcgccgaucgggacuuguucaagugagugcaucacacccaauggaagcauuccuaacgacaaaccauuucagaaugucaacagaauaaccuauggcgcaugucccagguacguuaagcaaaauacucugaaauuggccacaggcaugcggaacgugccugaaaagcagacccgugggaucuucggagcuauugccgguuuuaucgagaauggcugggaagggaugguagauggaugguauggcuuccgccaccagaacuccgaggguacggggcaggcagcugaccucaaaucuacccaagccgcgauagaucagauuaauggcaagcugaacagauuaaucgagaaaacaaaugaaaaguuucaccagaucgagaaggaguucagcgaaguggaaggaaggauucaagaccuggagaaauacgucgaggauacuaagaucgaccucuggucauauaacgccgaacuucugguggcauuggagaaucagcauaccauugaucuaacagacagugaaaugaacaaacuguucgagaagacucggaaacagcuccgagaaaacgcugaggauaugggcaaugggugcuuuaagauauaccacaagugugacaacgccugcaucggauccauucgcaaugguaccuacgaccaugauguuuauagagacgaggcucugaacaauagguuccagaucaaaggcguggaacuuaagagcggguacaaagauuggauccuguggauuucuuuugccauaucaugcuucuugcucugugucgugcuguuaggauuuaucaugugggcaugccaaaagggcaacauucgguguaauaucugcauuuga

SEQ ID NO: 123112 - RNA, 1701 nt, Artificial Sequence
  derived and/or modified sequence opt3 from hemagglutinin__InfluenzaA__ABG80084
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguggcauuucuaucuauuggaccauagugaagccuggggacauucuccugaucaacuccacaggaaaccuuauugccccaaggggcuacuuuaagauccggaaugguaaaagcucgaucaugcgcucugaugcgccgauugggaacuguuccucagagugcauaacccccaauggaaguaucccuaacgacaagccauuccagaaugucaaccgaauuacguauggcgcaugucccagauacguuaaacaaaauacucugaaguuggccacaggcaugaggaacgugccugaaaaacagacccgggggaucuuuggagcuauagccgguuucauugagaauggcugggaagggaugguagauggaugguauggcuuucgucaccagaacagcgaggguacugggcaggcagcugaccucaaguccacacaagccgcgaucgaucagaucaauggcaaacugaaccgcuuaauugagaagaccaaugaaaaguuccaucagaucgagaaagaguucucugaaguggaaggaaggauucaagaccuggagaaguacgucgaggauacgaaaauagaccucuggagcuauaacgccggccuucugguggcauuggaaaaucagcacaccaucgaucuaacagacucagagaugaacaagcuguuugaaagaacucggaaacagcuccgagagaacgcugaagauauggggaauggaugcuucaagauuuaccauaagugugacaacgccugcaucgguaguauccgcaauggcaccuacgaccacgauauuuauagagacgaggcucugaacaauagguuucagauaaaagggguugagcuuaaguccggauacaaagauuggauccuguggauuagcuucgccaucucuugcuuuuugcucugugugguccuguuaggcuucauuaugugggcaugccaaaaggguaacauccgguguaauauaugcaucuga

SEQ ID NO: 123113 - RNA, 1701 nt, Artificial Sequence
  derived and/or modified sequence opt3 from hemagglutinin__InfluenzaA__ABG80095
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaaguggacaaguuguacaucuggggcguacaucacccuucaacggauagugaccaaacuagccuguacguuagagcuucugggagggugaccgucuccacaaaacggucacagcagacugugauuccaaauaucggauuucgccccugggugagaggucuaagcaguaggauuucuaucuauuggaccauagucaagccuggcgacauucuccugaucaacuccacagggaaccuuauugccccacggggauacuucaagauccgcaauggcaaaagcucgaucaugcgaucugaugcgccgauugguaacuguuccucagagugcauaacccccaaugggaguaucccuaacgacaagccauuucagaauguuaacagaauuacguauggagcaugucccagguacgugaaacaaaauacucugaaguuggccacaggcaugcggaacguaccugaaaaacagacccguggcaucuucggggcuauagccggauuuauugagaaugguugggaaggcaugguggaugggugguauggauuccgccaccagaacagcgagggcacuggucaggcagcugaccucaaguccacacaagccgcgaucgaucagaucaaugggaaacugaacagauuaauugagaagaccaaugaaaaguuucaucagaucgagaaagaguucucugaagucgaaggcaggauucaagaccuggagaaguacguggaggauacgaaaauagaccucuggagcuauaacgccggacuucugguugcauuggaaaaucagcacaccaucgaucuaacagacucagagaugaacaagcuguucgaacggacucgaaaacagcuccgcgagaacgcugaagauaugggcaaugggugcuuuaagauuuaccauaagugugacaacgccugcaucggaaguaucagaaaugguaccuacgaccacgauguguauagggacgaggcucugaacaaucgguuccagauuaaaggcgucgagcuuaaguccggguacaaagauuggauacuguggaucagcuuugccauuucuugcuucuugcucugugugguacuguuaggauuuaucaugugggcaugccaaaagggcaacauucgcuguaauaucugcauauga

SEQ ID NO: 123114 - RNA, 1701 nt, Artificial Sequence; identical to SEQ ID NO: 123040
  derived and/or modified sequence opt3 from hemagglutinin__InfluenzaA__ABG80106

SEQ ID NO: 123115 - RNA, 1701 nt, Artificial Sequence
  derived and/or modified sequence opt3 from hemagglutinin__InfluenzaA__ABG80117
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaagauccgcaauggcaaaagcucgaucaugcgaucugaugcgccgauugguaacuguuccucagagugcauaacccccaaugggaguaucccuaacgacaagccauuccagaaugucaacagaauuacguauggagcaugucccagguacguuaaacaaaauacucugaaguuggccacaggcaugcggaacgugccuguaaaacagacccguggcaucuuuggggcuauagccggauucauugaaaaugguugggagggcaugguggaugggugguauggauuucgccaccagaacagcgaaggcacuggucaggcagcugaccucaaguccacacaagccgcgaucgaucagaucaaugggaaacugaacagauuaauugagaagaccaaugagaaguuccaucagaucgaaaaagaguucucugaagucgagggcaggauucaagaccuggaaaaguacguggaggauacgaaaauagaccucuggagcuauaacgccggacuucugguugcauuggagaaucagcacaccaucgaucuaacagacucagaaaugaacaagcuguuugagcggacucgaaaacagcuccgcgaaaacgcugaggauaugggcaaugggugcuucaagauuuaccauaagugugacaacgccugcaucggaaguaucagaaaugguaccuacgaccacgauguguauagggacgaagcucugaacaaucgguuucagauuaaaggcgucgagcuuaaguccggguacaaagauuggauacuguggaucagcuucgccauuucuugcuuuuugcucugugugguacuguuaggauucaucaugugggcaugccaaaagggcaacauucgcuguaauaucugcauauga

SEQ ID NO: 123116 - RNA, 1701 nt, Artificial Sequence
  derived and/or modified sequence opt3 from hemagglutinin__InfluenzaA__ABG80128
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugauagaauugaggugacuaacgcgaccgaacuuguacaaucuucaaguacagguaggaucugcgacagcccacaccggauucucgauggcaaaaauuguacccugaucgacgcucuacugggggauccgcauugcgacggauuucagaacaaggagugggauuuguucguggaacgcuccaaagccuauucuaauuguuaccccuaugacgucccugauuacgcaucgcuccgaucacugguggccagcaguggcacucuggaguuuauaaacgaagacuucaauuggacagguguugcucaggaugggaaguccuaugcaugcaagcguggaucugugaacagcuuuuucuccagacucaauugguuacacaaacuggaguacaaguauccagcccuuaacgucaccaugcccaauaacggcaaauuugacaaguuguacaucuggggcgugcaucacccuucaacggauagugaccagacuagccuguacguaagggcuucugggcggguuaccguguccacaaaacgcucacaacagacugucauuccaaauaucggauucagacccugggugaggggucuaagcagucggauuucuaucuauuggaccauagugaagccuggcgacauucuccugaucaacuccacagggaaccuuauugccccacgcggauacuuuaagauccgaaauggcaaaagcucgaucaugagaucugaugcgccgauugguaacuguuccucagagugcauaacccccaaugggaguaucccuaacgacaagccauuccagaaugucaacaggauuacguauggagcauguccccgguacguuaaacagaauacucugaaguuggccacaggcaugcguaacgugccugaaaaacaaacccgcggcaucuuuggggcuauagccggauucauugagaaugguugggaaggcaugguagaugggugguauggauuuagacaccagaacagcgagggcacuggucaggcagcugaccucaaguccacacaggccgcgaucgaucaaaucaaugggaaacugaacagguuaauugagaagaccaaugaaaaguuccaucagaucgagaaagaguucucugaaguggaaggccggauucaggaccuggagaaguacgucgaggauacgaaaauagaccucuggagcuauaacgccggacuucugguggcauuggaaaaucaacacaccaucgaucuaacagacucagagaugaacaagcuguuugaacgaacucgcaaacagcucagagagaacgcugaagauaugggcaaugggugcuucaagauuuaccauaagugugacaacgccugcaucggaaguaucaggaaugguaccuacgaccacgauguuuaucgggacgaggcucugaacaaucgcuuucagauuaaaggcguggagcuuaaguccggguacaaagauuggauacuguggaucagcuucgccauuucuugcuuuuugcucugugucgugcuguuaggauucaucaugugggcaugccagaagggcaacauuagauguaauaucugcauauga

SEQ ID NO: 123117 - RNA, 1701 nt, Artificial Sequence
  derived and/or modified sequence opt3 from hemagglutinin__InfluenzaA__ABG80139
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaagauccgcaauggcaaaagcucgaucaugcgaucugaugcgccgauugguaacuguuccuaugagugcauaacccccaaugggucaaucccuaacgacaagccauuccagaaugucaacagaauuacguacggagcaugucccagguauguuaaacaaaauacucugaaguuggccacaggcaugcggaacgugccugaaaaacagacccguggcaucuuuggggcuauagccggauucauugagaaugguugggaaggcaugguagaugggugguacggauuucgccaccagaacagugagggcacuggucaggcagcugaccucaagagcacacaagccgcgaucgaucagaucaaugggaaacugaacagauuaauugagaagaccaaugaaaaguuccaucagaucgagaaagaguucuccgaaguggaaggcaggauucaagaccuggagaaguaugucgaggauacgaaaauagaccucuggucuuacaacgccggacuucugguggcauuggaaaaucagcacaccaucgaucuaacagacagcgagaugaacaagcuguuugaacggacucgaaaacagcuccgcgagaacgcugaagauaugggcaaugggugcuucaagauuuaccauaagugugacaauaccugcaucggaucaaucagaaacgguacauaugaccacgauguuuacagggacgaggcccugaacaaucgguuucagauuaaaggcguggagcuuaagaguggguauaaagauuggauacuguggaucuccuucgcuauuagcugcuuuuugcucugugucgugcuguuaggauucaucaugugggccugccaaaagggcaacauucgcuguaauaucugcauauga

SEQ ID NO: 123118 - RNA, 1701 nt, Artificial Sequence
  derived and/or modified sequence opt3 from hemagglutinin__InfluenzaA__ABG80150
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaaaauuucaacuggacagguguugcucaggacgggaaguccuaugcaugcaagcgaggaucugugaauagcuuuuucucccgucucaacugguuacacaaacuggaguacaaguauccagcccuuaaugucaccaugcccaacaauggcaaauuugauaaguuguacaucuggggcgugcaucacccuucaacggacagugaucaaacuagccuguacguaagagcuucugggaggguuaccguguccacaaaacggucacagcagacugucauuccaaacaucggauuccgccccugggugagaggucuaagcaguggcauuucuaucuauuggaccauagugaagccuggggacauucuccugaucaacuccacaggaaaucuuauugccccaaggggcuacuuuaagauccggaacgguaaaagcucgaucaugcgcucugacgcgccgauugggaauuguuccucagagugcauaacccccaacggaaguaucccuaaugauaagccauuccagaacgucaaucgaauuacguauggcgcaugucccagauacguuaaacaaaacacucugaaguuggccacaggcaugaggaaugugccugaaaaacagacccgggggaucuuuggagcuauagccgguuucauugagaacggcugggaagggaugguagacggaugguauggcuuucgucaccagaauagcgaggguacugggcaggcagcugaucucaaguccacacaagccgcgaucgaccagaucaacggcaaacugaaucgcuuaauugagaagaccaacgaaaaguuccaucagaucgagaaagaguucucugaaguggaaggaaggauucaagaucuggagaaguacgucgaggacacgaaaauagaucucuggagcuauaaugccggccuucugguggcauuggaaaaccagcacaccaucgaccuaacagauucagagaugaacaagcuguuugaaagaacucggaaacagcuccgagagaaugcugaagacauggggaacggaugcuucaagauuuaccauaagugugauaaugccugcaucgguaguauccgcaacggcaccuacgaccacgacguuuauagagaugaggcucugaauaacagguuucagauuaaagggguggagcuuaaguccggauacaaagacuggauacuguggaucagcuucgccauuucuugcuuuuugcucugugucgugcuguuaggcuucaucaugugggcaugccaaaaggguaauauucgguguaacaucugcauauga

SEQ ID NO: 123119 - RNA, 1701 nt, Artificial Sequence
  derived and/or modified sequence opt3 from hemagglutinin__InfluenzaA__ABG80161
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcaaaaauuguacccucaucgacgcucugcuuggggauccgcauugcgacggauuucagaacaaggagugggaucuguucguggaacggucuaaagccuauucgaauuguuaccccuaugacgucccugauuacgcaucauugcgcagccucguggccaguuccggcacucuggaguuuauaaacgaagacuucaauuggacagguguugcucaggaugggaagucuuaugcaugcaagcgaggaagcgugaacuccuuuuucucacgucugaauuggcuccacaaauuagaguacaaguauccagcccugaacgucaccaugcccaauaacggcaaauuugacaagcuguacaucuggggcgugcaucacccuaguacggauagcgaccaaacuucuuuguacguacaggcuuccgggagaguuaccgugucaacaaaaaggagccagcagacugucauuccaaauaucggauuccggcccugggugcgcggucugaguucuagaauuuccaucuauuggaccauagugaagccuggcgacauucuacucaucaacagcacagggaaccugauugccccaaggggauacuuuaagauccggaauggcaaaucgucuaucaugcgcuccgaugcgccgauugguaacuguucaagugagugcauaacccccaaugggagcaucccuaacgacaagccauuccaaaaugucaaccgaauuacguauggagcaugucccagauacguuaaacagaauacucuuaagcuggccacaggcaugaggaacgugccugaaaaacagacccggggcaucuuuggggcuauagccggauucauugagaaugguugggaaggcaugguagaugggugguauggauuucgucaccagaacuccgagggcacuggucaagcagcugacuugaagucuacacaggccgcgaucgaucagaucaaugggaaacucaaccgccugauugagaagaccaaugaaaaguuccaucaaaucgagaaagaguucagcgaaguggaaggcaggauucaggacuuagagaaguacgucgaggauacgaaaauagaccuguggucauauaacgccggacuccuuguggcacuggaaaaucagcacaccaucgauuugacagacagugagaugaacaagcuauuugaaagaacucggaaacagcugcgagagaacgcugaagauaugggcaaugggugcuucaagauuuaccauaagugugacaacgccugcaucggauccauccgcaaugguaccuacgaccacgauguuuauagagacgaggcucucaacaauagguuucaaauuaaaggcguggagcuuaagagcggguacaaagauuggauacuuuggaucucuuucgccauuucaugcuuucuguugugugucgugcuccugggauucaucaugugggcaugccagaagggcaacauucgguguaauaucugcauauga

SEQ ID NO: 123120 - RNA, 1698 nt, Artificial Sequence
  derived and/or modified sequence opt3 from hemagglutinin__InfluenzaA__ABG80172
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuaugccuucgcgcucucuagaggguuuggauccggcaucauaaccagcaacgcacccauggacgaaugugaugccaagugccagacaccucaaggugcuauuaauucgucucugccauuccagaacguucaccccgugaccaucggggaguguccuaaauacguaagguccgccaaguuacggauggugacgggacugcgcaauauuccaucaauccagagucgaggccucuuuggcgcaaucgcuggguucauugaaggagguuggacuggcauggucgacgggugguauggauaccaucaccagaacgagcaaggcagcgguuacgccgcggaucagaaauccacacagaaugccauaaacgggaucaccaauaaggugaacucuguuauugaaaagaugaauacucaguuuacagcagugggcaaagaguucaacaaacuugagagaaggauggaaaaucugaacaagaaggucgacgauggauucuuggacaucuggaccuauaacgcugagcuacuggugcuccuggaaaaugagcggacgcuugacuuucacaacagcaauguuaaaaaccuguacgaaaagguaaaaucacaauugaagaauaacgccaaagagauaggcaaugggugcuucgaguuuuaucauaaguguaacaaugaaugcauggagagugugaagaacggaaccuacgauuaucccaaauacuccgaagagagcaagcucaaucgugagaaaauugacggugucaagcuggaaucuaugggcguguaucagaucuuagcuaucuacucaacagucgccaguagccuggugcuacucguuucccugggggcaauuucuuucuggaugugcucgaacggaagccuucagugucgcaucugcauuuga

SEQ ID NO: 123121 - RNA, 1698 nt, Artificial Sequence
  derived and/or modified sequence opt3 from hemagglutinin__InfluenzaA__ABG80183
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucgggggacagcgcgcccuguaccacacugaaaacgcuuaugucuccguggugucaagccauuacagucgacguuucacccccgagauagcaaaaagaccuaaggucagggaucaggaaggucggaucaauuauuacuggacacuucuggagccaggcgacacuauuaucuuugaggccaacgggaauuugauugcuccgcgcuaugccuucgcgcucucuagaggauuuggcuccgguaucauaaccagcaacgcacccauggaugaaugugacgccaagugccagacaccucaaggggcuauuaauucgucucugccauuccagaacguucaccccgugaccaucggagaguguccuaaauacguaagguccgccaaguuacggauggugacgggccugcgcaauauuccaucaauccagagucgaggccucuuuggggcaaucgcuggauucauugaagguggcuggacugggauggucgauggaugguauggcuaccaucaccagaacgagcaagguagcggguacgccgcggaccagaaauccacacagaaugccauaaacggcaucaccaauaaggugaacucuguuauugaaaagaugaauacucaguuuacagcagugggaaaagaguucaacaaacuugagagaaggauggaaaaucugaacaagaaggucgaugacggcuucuuggauaucuggaccuauaacgcugagcuacuggugcuccuggaaaaugagcggacgcuugacuuucacgacagcaacguuaaaaaucuguacgaaaagguaaaaucacaauugaagaacaaugccaaagagauagggaacggaugcuucgaguuuuaucauaaguguaauaacgaaugcauggagagugugaagaaugguaccuacgauuaucccaaauacuccgaagagagcaagcucaaccgugagaaaauugacggcgucaagcuggaaucuauggggguguaucagaucuuagcuaucuacucaacagucgccaguagccuggugcuacucguuucccugggagcaauuucuuucuggaugugcucgaauggcagccuucagugucgcaucugcauuuga

SEQ ID NO: 123122 - RNA, 1701 nt, Artificial Sequence
  derived and/or modified sequence opt3 from hemagglutinin__InfluenzaA__ABG80194
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaauggaauuuguucgucgagagguccacugccuauucuaacuguuaccccuaugaugugccugacuacgcaucgcuccggucacugguugccagcaguggaacacuggaauuuaauaacgaguccuucaauuggaccggcguggcucagaacgguacgucuagcgcaugcaagcgccgauccauaaaaucauuuuucagucgucucaauugguuacaucaacugaaguauaaguacccagcccuuaacgucacuaugcccaauaacgagaaauuugauaaguuguauaucuggggagugcaccacccuagcaccgacucugaucagauuucccuguacgcucaggccucagggagaguaacaguuagcacuaaaaggagucagcaaaccgugaucccaaacauuggcucucggcccuggguccgcggcguguccagcaucauaucgauuuacuggacaaucgugaagccuggggacauucuacucaucaauucuaccggaaaccugaucgcgccaagagguuauuucaaaauuagguccggcaagucaaguauaaugcggagcaaugcaccgaucgggaaguguaacuccgaaugcauuacgcccaauggaucuaucccuaacgauaaaccauuucagaaugucaaccgcauaacuuacggcgccuguccccgauauguuaagcagaauacacuuaaacuggcuaccgguaugagaaacgugccugagaagcagacuagggggauuuucggagccaucgcaggcuuuaucgaaaauggcugggaggggaugguagacggaugguacgguuuccggcaucaaaacagcgagggcacagggcaggcugccgacuugaaaucaacccaggcggccauuaaucaaaucaacggaaagcucaaucgucugauugagaaaacgaacgaaaaguuucaccagauagaaaaggaguucagugaaguggagggccgcauccaggauuuagagaaauaugucgaagacaccaagauugaucugugguccuacaacgcagagcuccuuguggcucuggaaaaucagcauacaaucgacuugacugauagcgagaugaacaaacuauucgaaagaaccaggaagcaacugcgggagaaugccgaggacauggguaacgggugcuuuaaaaucuaucacaagugugauaaugcuugcauuggcucuauacgaaacggaacauacgaccacgauguuuaccgcgacgaagcccucaauaacagauuccagaucaagggcguggagcugaaaucaggguauaaggauuggauucuuuggaucaguuuugcaauuagcugcuuccuguugugugucgugcuccugggauuuaucaugugggccugccagaaagguaauauaagguguaacaucugcauuuga

SEQ ID NO: 123123 - RNA, 1701 nt, Artificial Sequence
  derived and/or modified sequence opt3 from hemagglutinin__InfluenzaA__ABG80205
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacguggcuaugcccaauaacgagaaguuugacaaauuguauauauggggcguccaucacccuagcacggauucugaccagaucucccuguacgcccaggcgccaggccgugugacuguaucaaccaagagaagccaacagacaguuauucccaacaucgggaguaggccuugggugcggggagucucuucccgcauuagcaucuacuggacuauagugaaaccaggugauauucuacucaucaauuguaccggcaaccugauugcaccgagaggguauuucaagaucaggucgggaaagucuuccaucaugcggucagacgccaguauuggcaaaugcaauagcgaauguauaacacccaacgguuccaucccuaaugacaagccauuucagaacgugaaucgcauuaccuacggggcuugcccccgauaugucaaacagaacacgcuuaagcuggccacuggaaugagaaauguuccugagaaacaaacaaggggcaucuucggcgcaauagcuggguuuauugaaaacggaugggaggguaugguggauggcugguacggguuccggcaccaaaauucugagggaaccggccaggccgcggacuugaaaagcacucaggccgcaaucaaccagaucaaugguaaacucaaccgucugauugaaaagacaaaugagaaguuucaucagaucgaaaaagaguucucagaaguagaggggcgcauucaggauuuagagaaguauguggaagacaccaaaauaaaccuguggaguuacaacgcugagcuccuugucgcccuggaaaaucaacacacgaucgauuugaccgacuccgagaugaacaagcuauucgaaagaacaaagaagcagcugagggagaaugcugaggauaugggcaacggauguuuuaagauuuaucauaaaugcgacaaugccugcaucggcagcauccggaacgggacuuacgaucacgacguguaccgagaugaagcacucaauaaccgcuuccagauuaagggaguugagcugaaaucugguuauaaggacuggauacuuuggaucucauuugccauuaguuguuuccuguugugcgugguccuccugggcuuuaucaugugggcuugucagaaagggaauauuagaugcaacaucuguauauga

SEQ ID NO: 123124 - RNA, 1701 nt, Artificial Sequence
  derived and/or modified sequence opt3 from hemagglutinin__InfluenzaA__ABG80216
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaccaacaggaagaaucugcgacaguccgcaucagauucucgauggugagaauuguacccugaucgacgcucuacugggcgauccccacugcgacggguuucagaacaaagaaugggauuuguucgucgagaggagcacugccuauuccaauuguuacccuuaugacgugccagauuacgcaucucuccggucgcugguugccucaagcggaacacuggaauuuaacaaugagaguuucaacuggaccggcguggcucagaaugguacguccucugcaugcaagcgccgaagcauaaaauccuuuuucucacgucucaacugguuacaucaacugaaguauaaguaccccgcccuuaaugucacuaugccuaacaaugagaaauuugacaaguuguauaucuggggagugcaccacccaaguaccgauagcgaccagauuucucuguacgcucaggcccccgggagaguaacaguuuccacuaaaaggucacagcaaaccgugaucccuaacauuggcagccggccauggguccgcggcgugaguucuagaaucuccauauacuggacaauugugaagccgggggauauccuacucauuaacagcaccggaaaucugaucgcgcccagggguuauuucaaaauccggucgggcaagucuuccauuaugcgcucaaacacgccuauagggaaguguaauagugaaugcaucacuccaaacggaagcauucccaaugacaaaccuuuucagaacgucaaucgaaucacauacggcgcauguccaagauauguuaagcagaacacccuuaaacuggccacugguaugaggaaugugcccgagaagcagacacgggggauauucggagcuauugccggcuuuaucgaaaacggcugggaggggaugguagacggaugguacgguuuccgucaucaaaauuccgagggcaccgggcaggcagcugauuugaaaucuacgcaggccgcgaucaaccaaauuaauggaaagcucaaccgccugaucgagaaaaccaaugaaaaguuucaccagauugaaaaggaguucagcgaaguggagggcagaauacaggacuuagagaaauaugucgaagauacaaagaucgaccuguggucauacaacgccgagcuccuuguggcacuggaaaaccagcauacuauugauuugaccgacagugagaugaauaaacuauucgaaaggacacggaagcaacugcgagagaacgcugaggauauggguaaugggugcuuuaaaaucuaucacaagugugacaacgccugcaucggcuccauucgcaauggaacuuacgaucacgacguuuacagagaugaagcucucaacaauagguuccagauaaagggcguggagcugaaaagcggguauaaggacuggauccuuuggauuucuuuugccaucucaugcuuccuguugugugucgugcuccugggauuuauuaugugggcaugccagaaagguaacauccgguguaauauaugcaucuga

SEQ ID NO: 123125 - RNA, 1701 nt, Artificial Sequence; identical to SEQ ID NO: 122656
  derived and/or modified sequence opt3 from hemagglutinin__InfluenzaA__ABG80227

SEQ ID NO: 123126 - RNA, 1701 nt, Artificial Sequence; identical to SEQ ID NO: 122532
  derived and/or modified sequence opt3 from hemagglutinin__InfluenzaA__ABG80238

SEQ ID NO: 123127 - RNA, 1701 nt, Artificial Sequence; identical to SEQ ID NO: 122532
  derived and/or modified sequence opt3 from hemagglutinin__InfluenzaA__ABG80249

SEQ ID NO: 123128 - RNA, 1701 nt, Artificial Sequence; identical to SEQ ID NO: 122532
  derived and/or modified sequence opt3 from hemagglutinin__InfluenzaA__ABG80260

SEQ ID NO: 123129 - RNA, 1701 nt, Artificial Sequence
  derived and/or modified sequence opt3 from hemagglutinin__InfluenzaA__ABG80271
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcagucuucaaguacagguggcaucugcgacagcccacaccagauucuagauggggagaauuguacccucauggacgcucugcuuggagauccgcagugcgacggcuuucaaaacaaaaagugggaucuguucgucgaaagauccaaagccuauucuaauuguuaccccuaugacgugccugauuacgcaucguugaggucacucguugccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaaugucaccaugcccaacaacgagaaguucgacaaacuuuacaucuggggcgugcaccauccuggcacagauaaugaccagaucagcuuguaugcccaggcuucugggcguauaacuguauccaccaagagaucacaacagacaguuauuccaaacaucggaagcaggccccgggugcgcgauauuccuaguagaaucucuauauacuggaccauugucaaaccaggugacauccugcuaauuaauuccacgggcaaccucaucgccccgaggggguacuuuaagauccggagcggaaagucgucuauuaugcgcuccgacgcgcccauaggcaaauguaauucagagugcaucacuccuaacgguaguauuccaaaugauaagcccuuccagaacgugaaucgaaucacauauggggcauguccuagauacgugaaacagaacacccugaaacuugccacuggaaugaggaaugucccagaaaaacaaacacggggcauauuuggcgcuauugccggguucaucgagaacggaugggaagguaugguugacggcugguauggguuucgucaccagaauagcgagggaaccggccaggcagcugaucugaaguccacgcaagccgcgaucaaccagauuaaugguaaauugaaccgccucaucgggaagaccaacgagaaguuccaccagauugaaaaagaguucucugaaguggagggcagaauacaggaccuggaaaaguacguagaggauacaaaaaucgacuuauggagcuauaaugccgagcugcucguggcacuugaaaaccaacauacuauugaucugaccgacucagagaugaauaaguuguuugaaaggacaaagaagcagcuacgggagaacgcugaagauaugggaaauggcugcuucaagaucuaccacaaaugugacaacgccugcaucgggaguauucgaaauggaacuuaugaucaugacgucuaccgcgacgaggcucugaacaauagauuucagauaaaggguguggagcucaaauccggcuacaaggauuggauccuguggauuagcuucgccaucucuugcuuucuucuguguguugcauugcucggguucauuaugugggccugccagaaaggaaacaucagguguaauauaugcaucuga

SEQ ID NO: 123130 - RNA, 1701 nt, Artificial Sequence; identical to SEQ ID NO: 122607
  derived and/or modified sequence opt3 from hemagglutinin__InfluenzaA__ABG80282

SEQ ID NO: 123131 - RNA, 1701 nt, Artificial Sequence; identical to SEQ ID NO: 122259
  derived and/or modified sequence opt3 from hemagglutinin__InfluenzaA__ABG80293

SEQ ID NO: 123132 - RNA, 1701 nt, Artificial Sequence
  derived and/or modified sequence opt3 from hemagglutinin__InfluenzaA__ABG80304
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacaaauaacgaucagauuaauuuguaugcccaggcuagcgggcguaucacugugucuaccaagagaucccaacagacaguaauuccaaacaucggaucaaggccccggguucgcgacauaccuagcagaauuaguaucuacuggaccauugugaaaccaggugauauccugcuaaucaauucuacgggcaaccucauugccccgaggggguacuuuaagauacgguccggaaagagcucgaucaugcgcucugacgcgcccauuggcaaauguaauuccgagugcaucacuccuaacgguucaauaccaaaugacaagcccuuccagaacgucaaucgaauuacauauggggcauguccuagauacgugaaacagaacacccugaagcuggccacuggaaugaggaaugugccagaaaaacaaacacggggcaucuuuggcgcuaucgccggguucauugagaacggaugggaagguauggucgauggcugguauggguuucgucaccagaauagugagggaaucggccaggcagcugaccuuaagagcacccaagccgcgauuaaccagauaaacgguaaauugaaucgccucaucgggaagacgaacgagaaguuccaccagauugaaaaagaguucuccgaaguugagggcagaauccaggaucuggaaaaguacguggaggacaccaaaaucgauuuauggucuuauaaugccgagcugcucguagcacuugaaaaccaacauacaauugaccugacugauagcgagaugaauaaguuguuugaaaggaccaaaaagcagcuacgggagaacgcugaagacaugggaaauggcugcuucaagauauaccacaaaugugauaacgccugcaucgggucaauucgaaauggaacauaugaccaugauguguaccgcgacgaggcucugaacaauagauuucagaucaagggugucgagcucaaaaguggcuacaaggacuggauucuguggaucuccuucgccauaagcugcuuucuucuguguguggcauugcucggguucaucaugugggccugccagaaaggaaacauuagguguaauaucugcauuuga

SEQ ID NO: 123133 - RNA, 1701 nt, Artificial Sequence
  derived and/or modified sequence opt3 from hemagglutinin__InfluenzaA__ABG80315
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugauucagucuucaaguacagguggcaucugcgacagcccacaccagauacuagauggggagaauuguacccucaucgacgcucugcuuggagauccgcagugcgacggcuuucaaaacaaaaagugggaucuguucguagaaagauccaaagccuauucuaauuguuaccccuaugacgugccugauuacgcaucguugaggucacucgucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagauaaugaccagaucagcuuguaugcccaggcuucugggcguauuacugucuccaccaagagaucacaacagacagugaucccaaacauaggaagcaggccccggguacgcgauauuccuaguagaaucucuauuuacuggaccaucguuaaaccaggugacaugcugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgugaaucgaauuacauauggggcauguccuagauacgucaaacagaacacccugaaacuugccacuggaaugaggaaugugccagaaaaacaaacacggggcaucuuuggcgcuaucgccggguucauugagaacggaugggaagguaugguggacggcugguauggguuucgucaccagaauagcgagggaaccggccaggcagcugaucugaaguccacgcaagccgcgaucaaccagauuaaugguaaauugaaccgccucauagggaagaccaacgagaaguuccaccagaucgaaaaagaguucucugaagucgagggcaggauucaggaccuggaaaaguacguugaggauacaaaaaucgacuuauggagcuauaaugccgagcugcucguggcacuugaaaaccaacauacuaucgaucugaccgacucagagaugaauaaguuguuugaaagaacaaagaagcagcuacgggagaacgcugaagauaugggaaauggcugcuucaagauuuaccacaaaugugacaacgccugcauagggaguauccgaaauggaacuuaugaucaugacguauaccgcgacgaggcucugaacaauagauuucagauuaaggguguggagcucaaauccggcuacaaggauuggauccuguggauuagcuucgccaucucuugcuuucuucugugugucgcauugcucggguucauaaugugggccugccagaaaggaaacaucagguguaauauuugcaucuga

SEQ ID NO: 123134 - RNA, 1701 nt, Artificial Sequence; identical to SEQ ID NO: 122298
  derived and/or modified sequence opt3 from hemagglutinin__InfluenzaA__ABG80326

SEQ ID NO: 123135 - RNA, 1701 nt, Artificial Sequence; identical to SEQ ID NO: 122298
  derived and/or modified sequence opt3 from hemagglutinin__InfluenzaA__ABG80337

SEQ ID NO: 123136 - RNA, 1701 nt, Artificial Sequence
  derived and/or modified sequence opt3 from hemagglutinin__InfluenzaA__ABG80359
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggggauccuaugcaugcaagcgaggcucugugaacagcuuuuucucccgucucaauugguuacacaagcuggaguacaaauauccagcccuuaacgucaccaugcccaauaacggcaaguuugacaaauuguacaucuggggagugcaucacccuucaacggauagugaccaaacuagccuguacguaagagcuucugggaggguuaccguguccacaaagcggucacagcagacugucaccccaaauauugguagccgccccugggugagaggccuaaguucuaggaucuccauuuauuggacaaucgugaaaccuggggacauacuccugauuaacagcaccggaaaccuuaucgccccacggggcuacuucaagauucgcaaugguaagucgucuaucaugcgauccgaugcgccgaucgggaacuguucaagugagugcauuacgcccaauggaagcauaccuuccgacaaaccauuucagaacgucaauagaaucacuuauggcgcaugucccagguacguuaagcaaaacacacugaaauuggccaccggcaugcggaaugugccugaaaagcagacucgugggauuuucggagcuaucgccgguuuuauagagaacggcugggaagggaugguagauggaugguauggcuuccgccaccaaaauucugaggguacagggcaggcagcugaccucaaaagcacccaggccgcgguggaucagauuaacggcaagcugaauagauuaaucgagaggacgaacgaaaaauuucaucagaucgagaaggaguucucagaagucgaaggacggauucaagaccuggagaaguacguggaggauaccaaaaucgaccucuggaguuauaaugccgaacuucugguugcauuggagaaccagcacacaauugaucuaacugacuccgaaaugaauaagcuguucgagaaaacccgaaagcagcuccgcgaaaacgcugaggauaugggcaacgggugcuuuaaaauauaccauaagugugacaaugccugcaucggaagcauuagaaacgguacauacgaccacgauguguauagggacgaggcucugaauaaccgguuccagaucaagggcgucgaacuuaaaucuggguacaaggauuggauccuguggauuucauuugccauaaguugcuucuugcucugugugguacuguuaggauuuaucaugugggcaugccaaaaaggcaauauucgcuguaacaucugcauuuga

SEQ ID NO: 123137 - RNA, 1701 nt, Artificial Sequence
  derived and/or modified sequence opt3 from hemagglutinin__InfluenzaA__ABG80370
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaaauccuuuuucucccgucucaacugguuacacaagcuggaguacaaauauccagcccuuaaugucaccaugcccaacaauggcaaguuugacaaauuguacaucuggggcgugcaucacccuucaacggauagugaccaaacuagccuguacguaagagcuucugggaggguuaccguguccacaaagcggucacagcagacugucauuccaaacaucggaagccgccccugggugagaggucuaaguucuaggauuuccaucuauuggaccauagugaagccuggcgacauucuccugaucaauagcacagggaaccuuauugccccacggggauacuucaaaauccgcaacggcaagucgucuaucaugcgauccgaugcgccgauugguaauuguucaagugagugcauaacccccaacgggagcaucccuaaugacaaaccauuucagaacgucaauagaauuacguauggagcaugucccagguacguuaagcaaaacacucugaaauuggccacaggcaugcggaaugugccugaaaagcagacccguggcaucuucggggcuauagccggauuuauugagaacgguugggaaggcaugguagaugggugguauggauuccgccaccagaauagcgagggcacuggucaggcagcugaccucaaaucuacacaagccgcgaucgaucagaucaacgggaagcugaauagauuaauugagaagaccaacgaaaaauuucaucagaucgagaaggaguucagcgaaguggaaggcaggauucaagaccuggagaaauacgucgaggauacgaagauagaccucuggucauauaaugccgaacuucugguggcauuggagaaccagcacaccaucgaucuaacagacagugaaaugaauaaacuguucgagcggacucgaaagcagcuccgcgaaaacgcugaggauaugggaaacggcugcuuuaagauuuaccauaaaugugacaaugccugcaucggguccaucagaaacggaaccuacgaccacgauguuuauagggacgaggcucugaauaaccgguuccagauuaaggguguggaacuuaaaagcggcuacaaggauuggauacuguggaucucuuuugccauuucaugcuucuugcucugugucgugcuguuaggguuuaucaugugggcaugccaaaaaggaaauauucgcuguaacaucugcauauga

SEQ ID NO: 123138 - RNA, 1701 nt, Artificial Sequence; identical to SEQ ID NO: 123069
  derived and/or modified sequence opt3 from hemagglutinin__InfluenzaA__ABG80392

SEQ ID NO: 123139 - RNA, 1701 nt, Artificial Sequence; identical to SEQ ID NO: 123069
  derived and/or modified sequence opt3 from hemagglutinin__InfluenzaA__ABG80403

SEQ ID NO: 123140 - RNA, 1701 nt, Artificial Sequence; identical to SEQ ID NO: 123069
  derived and/or modified sequence opt3 from hemagglutinin__InfluenzaA__ABG80414

SEQ ID NO: 123141 - RNA, 1701 nt, Artificial Sequence; identical to SEQ ID NO: 123069
  derived and/or modified sequence opt3 from hemagglutinin__InfluenzaA__ABG80425

SEQ ID NO: 123142 - RNA, 1701 nt, Artificial Sequence; identical to SEQ ID NO: 122799
  derived and/or modified sequence opt3 from hemagglutinin__InfluenzaA__ABG88289

SEQ ID NO: 123143 - RNA, 1701 nt, Artificial Sequence
  derived and/or modified sequence opt3 from hemagglutinin__InfluenzaA__ABG88300
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugaaaagaacggacuguaucccgaucuuagcaagucuuacgucaauaacaaagagaaggaaguguugguacuguggggcguucaucacccuuccaauaucggcgaccagcgcgcaauuuaccacaccgagaacgccuaugugucagucgugagcagucauuacucucgacguuuuacaccagaaaucacuaagagacccaaagugagggaucaggaggggcggauaaacuauuacuggacccuacucgagccuggagacacaaucauuuucgaagcuaaugguaaccugaucgccccaugguaugcguuugcacuuucccgcggcuucgggagcggaauuaucaccucgaaugccucuaugggcgagugugaugcuaagugccagacgccgcaaggugccauaaacuccucacugcccuuucagaauguccacccuguuacuauuggggaauguccaaaauacgugagaaguacaaaguugaggaugguaaccggacuccggaacauccccagcauucagucccgcggccuguucggcgcaaucgcuggguuuaucgagggagguuggacuggcaugauugacgggugguauggauaccaucaccagaaugaacaaggcucugguuacgccgcggaucagaaaagcacacagaacgccauagacgggaucaccaauaaggugaacucagucauugagaaaaugaauacgcaguucaccgcagugggcaaggaguucaacaaguuagaacgaagaauggagaaucugaacaaaaagguugaugacggauuucucgacaucuggacauauaaugcugaacuucugguguugcuagagaacgaaaggacucuggauuuccacgacaguaacgucaaaaaucucuacgagaaggugaaaacccaacugaagaacaaugccaaggagauaggcaacgggugcuuugaguucuaucauaaauguaauaacgaaugcauggaauccguaaagaauggaacauacgauuauccuaaauacagcgaggagucuaaacuuaaccgggagaaaauugacgguguuaagcuggaaucaaugggcguguaucagaucuuggcuaucuacaguacugucgccagcucccucgugcuguuagucucucugggggcaauuucguuuuggaugugcagcaauggaucccuacagugucguaucugcauuuga

SEQ ID NO: 123144 - RNA, 1701 nt, Artificial Sequence; identical to SEQ ID NO: 122927
  derived and/or modified sequence opt3 from hemagglutinin__InfluenzaA__ABG88311

SEQ ID NO: 123145 - RNA, 1701 nt, Artificial Sequence
  derived and/or modified sequence opt3 from hemagglutinin__InfluenzaA__ABG88322
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugaaaagaacggacuguaucccauccuuagcaagucuuacgucaauaacaaagagaaggaaguguugguacuguggggcguucaucacccuuccaauauuggcgaucagcgcgcaaucuaccacaccgagaacgccuaugugucagucgugagcagucauuacucucgacguuuuacaccagaaauagcuaagagacccaaagugagggaccaggaggggcggaucaacuauuacuggacucuacucgagccuggagauaccauuaucuucgaagccaaugguaaccugauugcgccaugguaugcauuugcccuuucccgcggcuucgggagcggaaucauaacaucgaaugcuucuaugggcgagugugacgccaagugccagaccccgcaaggugcaauuaacuccucacugcccuuucagaauguccacccuguuacgaucggggaauguccaaaauacgugagaaguacuaaguugaggaugguaacaggacuccggaacauucccagcauccagucccgcggccuguucggcgcuaucgccggguuuauugagggagguuggaccggcaugauagaugggugguauggauaccaucaccagaaugaacaaggcucugguuacgcggccgaccagaaaagcacucagaacgcaaucgaugggauuacaaauaaggugaacucagucaucgagaaaaugaauacccaguucacggcugugggcaaggaguucaacaaguuagaacgaagaauggagaaucugaacaaaaagguugacgauggauuucucgacauauggaccuauaaugccgaacuucugguguugcuagagaacgaaaggacacuggacuuccacgauaguaacgucaaaaaucucuacgagaaggugaaaaaccaacugaagaauaacgcuaaggagauuggcaaugggugcuuugaguucuaucauaaauguaacaaugaaugcauggaauccguaaagaacggaacuuacgacuauccuaaauacagcgaggagucuaaacuuaaucgggagaaaaucgaugguguuaagcuggaaucaaugggcguguaucagaucuuggccauuuacaguaccgucgcaagcucccucgugcuguuagucucucugggggccaucucguuuuggaugugcagcaacggaucccuacagugucguauuugcauauga

SEQ ID NO: 123146 - RNA, 1701 nt, Artificial Sequence
  derived and/or modified sequence opt3 from hemagglutinin__InfluenzaA__ABG88333
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagagcuccuggccuaagcauaacgugacccgcgguguuacugcuucaugcagucacaaaggaaagagcucuuuuuaucgaaaucucuuauggcugacagagaaaaacggguccuacccaaaucuuucaaagagcuaugugaacaauaaggaaaaagaggucuuggugcuguggggcguacaucaccccaguaacaucgaagaccagaagaccauauaccguaaagagaaugcauacguuucuguggucuccagccacuauaacagaagguucacgccugaaaucucgaagcggccaaaagugcgcggccaggaggggagaauuaacuacuauuggacucuacucgagcccggagauaccaucauuuuugaagccaaugguaaccugaucgcuccuugguacgccuucgcgcuuucuaggggcuuuggguccggaauaauuacaucaaaugcaaguauggacgagugugaugccaagugccagacuccacaaggcgcuaucaacagcucccugccguuccagaaugugcaucccgucaccauuggugaauguccuaaauauguucggucuacaaaguugcgcauggugaccgggcuccgaaacaucccaagcauccagucaagaggacuguuuggcgccauugcaggcuucauagaagggggauggacggguaugaucgacggcugguacggguaucaccaucagaaugaacaaggaaguggcuacgcugccgaucagaaguccacucagaacgcgauuaaugguaucacaaacaaaguaaauagcgugauagagaagaugaacacccaguuuacugccgucgggaaagaguucaauaaguuagaaaagaggauggagaaccugaauaagaagguggacgauggcuuccucgacauuuggacauacaacgcagaacuucugguuuugcuagagaacgaacggacccuggacuuucacgauucuaaugugaaaaaccucuaugagaaggucaaaucacaacugaagaauaacgcuaaagagaucggaaauggcugcuucgaauuuuaccacaaguguaacaaugagugcauggaaagugugaagaacgggacguaugacuaccccaaauauagcgaggaguccaaacuuaaucgugagaaaaucgauggaguaaagcuggagucuauggguguuuaccagauuuuggccaucuauucgaccguggcuagcucccucguccuguuagugucacugggcgccauuaguuucuggaugugcucuaacgggagccuacagugucgcauaugcaucuga

SEQ ID NO: 123147 - RNA, 1701 nt, Artificial Sequence
  derived and/or modified sequence opt3 from hemagglutinin__InfluenzaA__ABG88344
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagagcuccuggccuaagcauaacgugacccgcgguguuacugcuucaugcagucacaaagggaaaagcucuuuuuaucgaaaucucuuauggcugacagagaaaaacggauccuacccaaaucuuucaaagagcuaugugaacaauaaggaaaaagaggucuuggugcuguggggcguacaucaccccaguaacaucgaagaccagaagaccauauaccguaaagagaaugcauacguuucuguggucuccagccacuauaacagaagguucacgccugaaaucucgaagcggccaaaagugcgcaaccaggagggcagaauuaauuacuauuggacucuacucgagcccggggauaccaucauuuuugaagccaacggaaaucugaucgcuccuugguacgccuucgcgcuuucuagggguuuuggcuccgggauaauuacaucaaacgcaaguauggacgagugugaugccaagugccagacuccacaaggagcuaucaauagcucccugccguuccagaacgugcaucccgucaccauuggcgaauguccuaaauauguucggucuacaaaguugcgcauggugaccggucuccgaaauaucccaagcauccagucaagagggcuguuuggagccauugcaggcuucauagagggcggguggacgggaaugaucgacgguugguacggcuaucaccaucagaacgaacaagggaguggauacgcugccgaucagaaguccacucagaaugcgauuaacggcaucacaaauaaaguaaacagcgugauagagaagaugaauacccaguuuacugccgucgguaaagaguucaacaaguuagaaaagaggauggagaaucugaacaagaagguggacgauggguuccucgacauuuggacauacaacgcagaacuucugguuuugcuagagaaugaacggacccuggacuuucacgauucuaacgugaaaaaucucuaugagaaggucaaaucacaacugaagaacaaugcuaaagagaucggcaacggaugcuucgaauuuuaccacaaguguaauaacgagugcauggaaagugugaagaauggcacguaugacuaccccaaauauagcgaggaguccaaacuuaaccgugaaaagaucgaugggguaaagcuggagucuaugggaguuuaccagauuuuggccaucuauucgaccguggcuagcucccucguccuguuagugucacugggugccauuaguuucuggaugugcucuaauggcagccuacagugucgcauaugcaucuga

SEQ ID NO: 123148 - RNA, 1701 nt, Artificial Sequence
  derived and/or modified sequence opt3 from hemagglutinin__InfluenzaA__ABG88355
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcgacaguccgcacaggauucucgauggcaaaaauuguacccugaucgacgcucuacugggggauccccauugcgacggauuucagaacaaggagugggauuuguucguggaacggagcaaagccuauuccaauuguuacccuuaugacgucccagauuacgcaucucuccgcucgcugguggccucaagcggcacucuggaguuuacaaacgaaaauuucaacuggaccgguguugcucaggacgggaagaguuaugcaugcaagcgaggauccgugaauagcuuuuucucucgucucaacugguuacacaaacuggaguacaaguaucccgcccuuaaugucacgaugccuaacaauggcaaauuugauaaguuguacauauggggcgugcaucacccauccacugacucagaucaaaccagucuguacguaagagcuagcgggaaaguuacagugucuacuaagaggucccagcagaccgucauccccgacauuggauaucggccuugggugcgcggucuaucaagcagaaucaguauuuacuggacaaucgugaagccaggcgacauacuccugauuaacucuaccgggaaccuuaucgccccgaggggauauuucaaaauucggaauggcgaguccagcaucaugcgcucggaugcgcccaucgguaacuguucuuccgaaugcauuacgccuaaugggucaauaccaaacgacaagcccuuucagaaugucaaccgaaucacuuacggagcauguccuagauauguuaaacaaaauacacugaaguuggccaccggcaugaggaacgugccagagaaacagacucggggcauuuucggggcuaucgccggauuuauagaaaaugguugggagggcaugguagaugggugguacggauuccgucaccagaacagugagggcacaggucaggcagcugaccucaagagcacccaagccgcgauugaucagaucaaugggaaacugaaccgcuuaguggaaaagacgaaugagaaguuucaucagaucgaaaaagaguucuccgaagucgagggcaggauucaagaccuggagaaguauguggaagauaccaaaaucgaccucuggucuuacaacgccgagcuucugguugcauuggaaaaucagcacacaauugaucuaacugacagcgagaugaacaagcuguucgaaagaacccggaaacagcuccgagagaacgcugaggauaugggaaauggcugcuuuaagauauaccauaagugugacaacgccugcaucgggucaauucgcaauggaacauaugaccacgauguguacagagacgaagcucugaacaauagguuccagaucaaaggugucgagcuuaagaguggcuauaaagauuggauccuguggauuuccuuugccauaagcugcuucuugcucugugugguacuguuaggguuuaucaugugggcaugccaaaagggaaacauucgguguaauaucugcauuuga

SEQ ID NO: 123149 - RNA, 1701 nt, Artificial Sequence
  derived and/or modified sequence opt3 from hemagglutinin__InfluenzaA__ABG88366
augaagaccaucauugcccugagcuacuuccucugccuuguguuugcucagaaacugcccggcaacgacaauuccacagcaacuuuguguuuagggcaccaugccgucccuaacggaacgcugguuaagaccauaacaaaugaucaaaucgaggugacuaacgcgaccgaacuuguacagaauagcccaacagguagaauuugcgacucaccgcacaggauccucgauggcaaaaacuguacccugauugacgcucuacugggggauccccauugcgacggauuccagaauaaggagugggauuuguuuguggaacggaguaaagccuauagcaacuguuacccuuaugacgucccagauuacgcaucccuccgcucucugguggccucgucaggcacucuggaguucacaaaugaaaacuuuaauuggaccgguguugcucaggacgggaagucuuaugcaugcaagcgaggaagugugaacuccuucuuuucucgucucaauugguuacacaaacuggaguacaaguaucccgcccuuaacgucacgaugccuaauaacggcaaauucgauaaguuguacaucuggggcgugcaucacccaagcacugacuccgaucaaaccucacuguacguaagagcuagugggaaaguuacagugagcacuaagaggucucagcagaccgucauacccgacaucggauaucggccuugggugcgcggucuauccucaagaauuagcaucuacuggacaauugugaagccaggcgacauccuccugauaaacaguaccgggaaucuuauugccccgaggggauauuuuaaaauccggaacggcaagucuuccauuaugcgcagcgaugcgcccaucgguaauuguucgucugagugcaucacgccuaacggguccauuccaaaugacaaacccuuccagaacgucaaucgaauaacuuacggagcauguccuagauauguuaagcaaaacacacugaaauuggccaccggcaugaggaaugugccagaaaagcagacucggggcaucuuuggggcuauugccggauucaucgagaacgguugggaaggcaugguagaugggugguacggauuucgucaccaaaauucagagggcacaggucaggcagcugaccucaaaaguacccaggccgcgauagaucagauuaacgggaagcugaaucgcuuaguggagaagacgaacgaaaaauuccaucagaucgagaaggaguucagcgaagucgaaggcagaauccaagaccuggagaaauauguggaggauaccaagauugaccucugguccuacaaugccgaacuucugguugcauuggagaaccagcacacaaucgaucuaacugacucugaaaugaacaaacuguuugagaggacccggaagcagcuccgagaaaaugcugaggauaugggaaacggcugcuucaagauuuaccauaaaugugacaaugccugcauagggagcauccgcaacggaacauaugaccacgauguguacagagacgaggcucugaauaacagguuucagauuaagggugucgaacuuaaaucaggcuauaaggauuggauccuguggaucaguuucgccauuuccugcuuuuugcucugugugguacuguuaggguucauaaugugggcaugccaaaaaggaaauauccgguguaacauuugcaucuga

SEQ ID NO: 123150 - RNA, 1701 nt, Artificial Sequence; identical to SEQ ID NO: 123000
  derived and/or modified sequence opt3 from hemagglutinin__InfluenzaA__ABG88377

SEQ ID NO: 123151 - RNA, 1701 nt, Artificial Sequence; identical to SEQ ID NO: 123000
  derived and/or modified sequence opt3 from hemagglutinin__InfluenzaA__ABG88388

SEQ ID NO: 123152 - RNA, 1701 nt, Artificial Sequence
  derived and/or modified sequence opt3 from hemagglutinin__InfluenzaA__ABG88399
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaaggaauccuucaacuggaccgguguugcucaggacgggaagucuuaugcaugcaaacgaggaagcgucaauuccuuuuucucacgucucaacugguuacacaagcuggaguacaaauauccagcccuuaaugugacgaugcccaacaaugauaaguuugacaaauuguacauauggggcgugcaucacccuaguacugauagcgaccaaaccucucuguacguacaggcuuccggcagaguuacagugucaacuaagaggagccagcagaccgucaucccaaacauugggagucggcccugggugcgcggaaucucuuccagaauuagcaucuauuggacaauagugaagccuggugacauucuacucaucaauucgaccggcaaccugauugccccaaggggguacuucaaaauccggaacggaaagucuuccaucaugcgcucagaugcgccgauuggcaauuguaacagugagugcauaacgcccaaugguagcaucccuaacgacaaaccauuucaaaaugucaaccgaauuacuuauggggcaugucccagauacguuaagcagaauacacuuaaacuggccaccggaaugaggaacgugccugaaaagcagacucggggcaucuucggcgcuauagccggguuuauugagaauggaugggaagguaugguagauggcugguauggguuccgucaccagaacuccgagggaacaggccaagcagcugacuugaaaucuacccaggccgcgaucgaucagaucaaugguaagcucaaccgccugauugagaagacgaaugaaaaauuucaucaaaucgagaaggaguucagcgaaguggaagggaggauucaggacuuagagaaauacgucgaggauaccaagauagaccuguggucauauaacgccgaacuccuuguggcacuggagaaucagcacacaaucgauuugacugacagugaaaugaacaaacuauucgagagaacccggaagcagcugcgagaaaacgcugaggauaugggcaauggaugcuuuaagauuuaccauaaaugugacaacgccugcaucggcuccauccgcaaugggacauacgaccacgauguuuauagagacgaggcucucaacaauagguuccaaauuaagggaguggaacugaaaagcgguuacaaggauuggauacuuuggaucucuuuugccauuucaugcuuccuguugugugucgugcuccugggcuuuaucaugugggcaugccagaaagggaacauucgguguaauaucugcauauga

SEQ ID NO: 123153 - RNA, 1701 nt, Artificial Sequence; identical to SEQ ID NO: 123040
  derived and/or modified sequence opt3 from hemagglutinin__InfluenzaA__ABG88410

SEQ ID NO: 123154 - RNA, 1701 nt, Artificial Sequence; identical to SEQ ID NO: 123040
  derived and/or modified sequence opt3 from hemagglutinin__InfluenzaA__ABG88421

SEQ ID NO: 123155 - RNA, 1701 nt, Artificial Sequence
  derived and/or modified sequence opt3 from hemagglutinin__InfluenzaA__ABG88432
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaagaugcgcaauggcaaaagcucgaucaugcgaucugaugcgccgaucgguaacuguuccucagagugcauuacccccaaugggaguauaccuaacgacaagccauuccagaaugucaacagaaucacguauggagcaugucccagguacguuaaacaaaauacucugaaguuggccacaggcaugcggaacgugccugaaaaacagacccguggcauuuuuggggcuaucgccggauucauagagaaugguugggaaggcaugguagaugggugguauggauuucgccaccagaacagcgagggcacuggucaggcagcugaccucaaguccacacaagccgcgauugaucagaucaaugggaaacugaacagauuaaucgagaagaccaaugaaaaguuccaucagauugagaaagaguucucugaaguggaaggcaggauccaagaccuggagaaguacgucgaggauacgaaaauugaccucuggagcuauaacgccggacuucugguggcauuggaaaaucagcacaccauagaucuaacagacucagagaugaacaagcuguuugaacggacucgaaaacagcuccgcgagaacgcugaagauaugggcaaugggugcuucaagaucuaccauaagugugacaacgccugcauuggaaguaucagaaaugguaccuacgaccacgauguuuauagggacgaggcucugaacaaucgguuucagaucaaaggcguggagcuuaaguccggguacaaagauuggauucuguggaucagcuucgccauaucuugcuuuuugcucugugucgugcuguuaggauucauuaugugggcaugccaaaagggcaacauccgcuguaauauuugcaucuga

SEQ ID NO: 123156 - RNA, 1701 nt, Artificial Sequence; identical to SEQ ID NO: 123040
  derived and/or modified sequence opt3 from hemagglutinin__InfluenzaA__ABG88443

SEQ ID NO: 123157 - RNA, 1701 nt, Artificial Sequence
  derived and/or modified sequence opt3 from hemagglutinin__InfluenzaA__ABG88454
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugccaacagcuuuuucucccgucucaauugguuacacaaacuggaguacaaguauccagcucuuaacgugaccaugcccaauaacggcaaauuugacaaguuguacaucuggggcguccaucacccuucaacggauagugaccaaacuagccuguacgugagagccucugggggaguaaccguuuccacaaaaaggucacagcagacugugauuccaaauaucgguagccggcccuggguccgcggccuaaguucuagaauuuccaucuauuggaccauagugaagccuggggacauucuccugaucaacagcacaggaaaccuuauugcgccaaggggcuacuucaagauccggucggguaaaucuuccaucaugcgcucagaugcaaguauugggaauuguagcuccgagugcauaaccccgaacggaucuauccccaaugacaagccuuuucagaacgugaaucgaauuacguauggcgccuguccaagauacgucaaacaaaacacucugaaguuggcuacaggcaugaggaauguucccgaaaaacagacccgggggaucuucggagccauagcagguuuuauugagaacggcugggaagggaugguggauggaugguauggcuuccgucaccagaauagcgaggguacugggcaggcugccgaccucaagucaacacaagcggccaucgaucagaucaacggcaaacugaaucgcuuaauuggaaagaccaacgacaaguuucaucagaucgagaaagaguucagugaaguagaaggcaggauucaagaucuggagaaguacguggaagacacgaaaauagaucucugguccuauaaugcagagcuucuggucgcuuuggagaaccagcacaccaucgaccuaacagauagcgaaaugaauaagcuguucgagagaacucggaaacagcuccgagaaaacgccgaggacauggggaacggaugcuuuaagauuuaccauaagugugacaaugcuugcaucgguucuauccgcaacggcaccuacgaucacgacguguauagagaugaagcccugaauaacagguuccagauuaaagggguugagcuuaagucaggauacaaagacuggauacuguggaucaguuuugcaauuagcugcuucuugcucugugugguccuguuaggcuuuaucaugugggccugccaaaaggguaauauucgguguaacaucugcauauga

SEQ ID NO: 123158 - RNA, 1701 nt, Artificial Sequence
  derived and/or modified sequence opt3 from hemagglutinin__InfluenzaA__ABG88465
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaagauccgcaauggcaaaagcucgaucaugcgaucugaugcgccgauugguaacuguuccucagagugcauaacccccaaugggaguaucccuaacgacaagccauuccagaaugucaacagaauuacguauggagcaugucccagguacguuaaacaaaauacucugaaguuggccacaggcaugcggaacaucccugaaaaacagacccguggcauauuuggggcuauugccggauucaucgagaaugguugggaaggcaugguggaugggugguauggauuucgccaccagaacagcgagggcacuggucaggcagcugaccucaaguccacacaagccgcgaucgaucagauuaaugggaaacugaacagauuaaucgagaagaccaaugaaaaguuccaucagauugagaaagaguucucugaaguagaaggcaggauacaagaccuggagaaguacguggaggauacgaaaaucgaccucuggagcuauaacgccggacuucuggucgcauuggaaaaucagcacaccauugaucuaacagacucagagaugaacaagcuguuugaacggacucgaaaacagcuccgcgagaacgcugaagauaugggcaaugggugcuucaagaucuaccauaagugugacaacgccugcaucggaaguauuagaaaugguaccuacgaccacgauguguauagggacgaggcucugaacaaucgguuucagauaaaaggcguugagcuuaaguccggguacaaagauuggauccuguggauuagcuucgccaucucuugcuuuuugcucugugugguccuguuaggauucauuaugugggcaugccaaaagggcaacauccgcuguaauauaugcaucuga

SEQ ID NO: 123159 - RNA, 1701 nt, Artificial Sequence; identical to SEQ ID NO: 123040
  derived and/or modified sequence opt3 from hemagglutinin__InfluenzaA__ABG88476

SEQ ID NO: 123160 - RNA, 1701 nt, Artificial Sequence; identical to SEQ ID NO: 123040
  derived and/or modified sequence opt3 from hemagglutinin__InfluenzaA__ABG88487

SEQ ID NO: 123161 - RNA, 1701 nt, Artificial Sequence; identical to SEQ ID NO: 123040
  derived and/or modified sequence opt3 from hemagglutinin__InfluenzaA__ABG88498

SEQ ID NO: 123162 - RNA, 1701 nt, Artificial Sequence; identical to SEQ ID NO: 123040
  derived and/or modified sequence opt3 from hemagglutinin__InfluenzaA__ABG88509

SEQ ID NO: 123163 - RNA, 1701 nt, Artificial Sequence
  derived and/or modified sequence opt3 from hemagglutinin__InfluenzaA__ABG88520
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcaaaaauuguacccucaucgacgcucugcuuggggauccgcauugcgacggauuucagaacaaggagugggaucuguucguggaacggucuaaagccuauucgaauuguuaccccuaugacgucccugauuacgcaucauugcgcagccucguggccaguuccggcacucuggaguuuauaaacgaagacuucaauuggacagguguugcucaggaugggaagucuuaugcaugcaagcgaggaagcgugaacuccuuuuucucacgucugaauuggcuccacaaauuagaguacaaguauccagcccugaacgucaccaugcccaauaacggcaaauuugacaagcuguacaucuggggcgugcaucacccuaguacggauagcgaccaaacuucuuuguacguaagagcuuccgggaggguuaccgugucaacaaaacggagccagcagacugucauuccaaauaucggauuccgccccugggugagaggucugaguucuaggauuuccaucuauuggaccauagugaagccuggcgacauucuacucaucaacagcacagggaaccugauugccccacggggauacuuuaagauccgcaauggcaaaucgucuaucaugcgauccgaugcgccgauugguaacuguucaagugagugcauaacccccaaugggagcaucccuaacgacaagccauuccagaaugucaacagaauuacguauggagcaugucccagguacguuaaacaaaauacucuuaagcuggccacaggcaugcggaacgugccugaaaaacagacccguggcaucuuuggggcuauagccggauucauugagaaugguugggaaggcaugguagaugggugguauggauuucgccaccagaacuccgagggcacuggucaggcagcugacuugaagucuacacaagccgcgaucgaucagaucaaugggaaacucaacagacugauugagaagaccaaugaaaaguuccaucagaucgagaaagaguucagcgaaguggaaggcaggauucaagacuuagagaaguacgucgaggauacgaaaauagaccuguggucauauaacgccggacuccuuguggcacuggaaaaucagcacaccaucgauuugacagacagugagaugaacaagcuauuugaacggacucgaaaacagcugcgcgagaacgcugaagauaugggcaaugggugcuucaagauuuaccauaagugugacaacgccugcaucggauccaucagaaaugguaccuacgaccacgauguuuauagggacgaggcucucaacaaucgguuucagauuaaaggcguggagcuuaagagcggguacaaagauuggauacuuuggaucucuuucgccauuucaugcuuucuguugugugucgugcuccugggauucacaaugugggcaugccaaaagggcaacauccgcuguaauauuugcaucuga

SEQ ID NO: 123164 - RNA, 1701 nt, Artificial Sequence
  derived and/or modified sequence opt3 from hemagglutinin__InfluenzaA__ABG88531
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauaguguacaaacuagccuguacguuagagcuucugggagggugaccgucuccacaaaacggucacagcagacugugauuccaaauaucggauuccgccccugggugagaggucuaagcaguaggauuucuaucuauuggaccauagucaagccuggcgacauucuccugaucaacuccacagggaaccuuauugccccacggggauacuuuaagauccgcaauggcaaaagcucgaucaugcgaucugacgcgccgauugguaacuguuccucagagugcauaacccccaaugggaguaucccuaacgauaagccauuccagaauguuaacagaauuacguauggagcaugucccagguacgugaaacaaaauacucugaaguuggccacaggcaugcggaacguaccugaaaaacagacccguggcaucuuuggggcuauagccggauucauugagaaugguugggaaggcaugguggacgggugguauggauuucgccaccagaacagcgagggcacuggucaggcagcugaucucaaguccacacaagccgcgaucgaccagaucaaugggaaacugaacagauuaauugagaagaccaaugaaaaguuccaucagaucgagaaagaguucucugaagucgaaggcaggauucaagaucuggagaaguacguggaggacacgaaaauagaucucuggagcuauaacgccggacuucugguugcauuggaaaaucagcacaccaucgaccuaacagauucagagaugaacaagcuguuugaacggacucgaaaacagcuccgcgagaacgcugaagacaugggcaaugggugcuucaagauuuaccauaagugugauaacgccugcaucggaaguaucagaaaugguaccuacgaccacgacguguauagggaugaggcucugaacaaucgguuucagauuaaaggcgucgagcuuaaguccggguacaaagacuggauacuguggaucagcuucgccauuucuugcuuuuugcucugugugguacuguuaggauucaucaugugggcaugccaaaagggcaacauucgcuguaauaucugcauauga

SEQ ID NO: 123165 - RNA, 1698 nt, Artificial Sequence; identical to SEQ ID NO: 123051
  derived and/or modified sequence opt3 from hemagglutinin__InfluenzaA__ABG88553

SEQ ID NO: 123166 - RNA, 1701 nt, Artificial Sequence; identical to SEQ ID NO: 122726
  derived and/or modified sequence opt3 from hemagglutinin__InfluenzaA__ABG88564

SEQ ID NO: 123167 - RNA, 1701 nt, Artificial Sequence; identical to SEQ ID NO: 122756
  derived and/or modified sequence opt3 from hemagglutinin__InfluenzaA__ABG88575

SEQ ID NO: 123168 - RNA, 1701 nt, Artificial Sequence; identical to SEQ ID NO: 122666
  derived and/or modified sequence opt3 from hemagglutinin__InfluenzaA__ABG88586

SEQ ID NO: 123169 - RNA, 1701 nt, Artificial Sequence
  derived and/or modified sequence opt3 from hemagglutinin__InfluenzaA__ABG88597
augaagaccaucauugcccugagcuacauacucugccuuguguucgcucagaaacugcccgcaaacgacaauuccacagccacuuuguguuuaggccaccaugcggucccuaacgggacgcugguuaagaccaucacaaaugauaacauugaggugacuaaugcuaccgagcuaguacaaucuucaaguacaggaagaaucugcgacagcccacaccagauucucgauggugaaaacuguacccugaucgacgcccuucugggcgauccgcauugcgacggguuucagaauaaagaaugggauuuguucguggagagguccacugcauauucuaacuguuaccccuaugacgucccugauuacgccucgcuccggucacugguggcuagcaguggaacacuggaauuuaauaacgaguccuucaauuggaccggcguugaccagaacgguacgucuagcgcaugcaagcgccgauccaauaaaucauuuuucagucgucucaacugguuacaccaacugaaguauaaguacccagcccuuaaugugacuaugcccaacaacgagaaauuugauaaguuguauauauggggaguccaucacccuagcaccgacucugaucagaucucccuguacgcucaggccucagggagagugacaguaagcacuaaaaggagucagcaaaccguuauuccaaauaucggcucucggcccugggugcgcggcgucuccagcagaauuucgaucuacuggacaauagugaagccuggggacauucuacucaucaacucuaccggaaaucugauugcgccaagggguuauuucaaaauccgguccggcaagucaaguaucaugcgcagcaacgcaccgauugggaaguguaauuccgaaugcauaacgcccaacggaucuaucccuaaugacaaaccauuucagaacgugaaucgaauuacuuacggcgccugucccagauaugucaagcagaacacacuuaaacuggcuaccgguaugaggaauguuccugagaagcagacucgggggaucuucggagccauagcaggcuuuauugaaaacggcugggaggggaugguggauggaugguacgguuuccgucaccaaaauagcgagggcacagggcaggcugccgacuugaaaucaacccaggcggccaucaaccaaaucaauggaaagcucaaccgccugauugagaaaacgaacgaaaaguuucaucagaucgaaaaggaguucagugaaguagagggcaggauucaggauuuagagaaauauguggaagacaccaagauagaucugugguccuacaaugcagagcuccuugucgcucuggaaaaccagcacacaaucgacuugacugauagcgagaugaauaaacuauucgaaagaacccggaagcaacugcgagagaacgccgaggacauggguaaugggugcuuuaaaauuuaucauaagugugauaacgcuugcaucggcucuauccgcaauggaacauacgaccacgauguguacagagacgaagcccucaacaauagguuccagauuaagggcguugagcugaaaucaggguauaaggacuggauacuuuggaucaguuuugcaauuagcugcuuccuguugugugugguccuccugggauuuaucaugugggccugccagaaagguaacauucgguguaauaucugcauauga

SEQ ID NO: 123170 - RNA, 1701 nt, Artificial Sequence
  derived and/or modified sequence opt3 from hemagglutinin__InfluenzaA__ABG88608
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagaggucccgggccuauucuaauuguuaccccuaugacgucccugauuacgugucgcuccgcucacugguugcaagcaguggcacucuggaauuuaacaaugaguccuucaacuggacagguguggcccaaaaugggaccucuagcgcuugcaagcgacguuccgacaaaucauuuuucaguagacucaacugguuacaccagcugaaguauaaguacccagcacuuaaugucacgaugcccaacaaugagaaauuugauaaguuguauauauggggagugcaucacccuggcacugacagcgaucagaucucucuguacgcccaggcuuccggcaggguaaccguuucaacaaaacggagccaacagacugugauuccaaacaucgggagucgccccugggucagaggagugucuuccaggauuagcaucuacuggaccauagugaagccuggugacauucuacucaucaacucgacaggcaaucugauugccccacggggguauuucaaaauccgcucuggaaaguccucaaucaugcgaagugacgcgccgauuggcaaguguaacagcgaaugcauaacccccaaugguuccaucccuaacgauaaaccauuucagaaugucaacagaauuacguacgggcccuguccuagguauguuaagcagaauacucuuaaacuggcaacaggaaugcggaacgugccagagaagcaaacccguggcaucuucggcgccauagcuggguuuauugaaaauggaugggaggguaugauggacggcugguacggguuccgccaccagaacucugagggaacuggccaggccgcagauuugaaaagcacacaagcugccaucaaucagaucaacgguaagcucaauagacugauugagaaaaccaacgaaaaguuucaucagaucgaaaaggaguucucagaaguagaggggaggauucaggacuuagagaaauauguggaagauacgaagauagaccuguggaguuacaaugcggagcuccuugucgcccuggaaaaccaacacaccaucgauuugacagacuccgagaugaacaaacuauucgaacggacuaagaaacagcugcgagagaaugcagaggauaugggcaacggaugcuuuaagauuuaucauaagugugacaaugcuugcaucggcagcauccgcaacgggaccuacgaucacgacguguacagagacgaagcccucaauacaagguuccagauuaaaggaguugagcugaagucugguuauaaagauuggauacuuuggaucucauuugcuauuaguugcuuccuguuguguaucgugcuccugggcuuuauuaugugggccugccagaaggggaacauccgguguaauauaugcaucuga

SEQ ID NO: 123171 - RNA, 1701 nt, Artificial Sequence; identical to SEQ ID NO: 122578
  derived and/or modified sequence opt3 from hemagglutinin__InfluenzaA__ABG88619

SEQ ID NO: 123172 - RNA, 1701 nt, Artificial Sequence
  derived and/or modified sequence opt3 from hemagglutinin__InfluenzaA__ABG88630
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccaggugcucgauggcgagaauuguacccugauugacgcucuacugggggauccgcauugcgacggauuucagaacaaagaaugggauuuguucgucgagagguccaaggccuauucuaauuguuaccccuaugacgugccugauuacguuucgcuccggucacugguggcaagcaguggcacucuggaauuuaacaaugaguccuucaacuggacaggugucgcccaaaaugggaccucuagcgcuugcaaacgccgauccgacaagucauuuuucagucgucucaacugguuacaccagcugaaguauaaauacccagcacuuaaugugacgaugcccaacaaugagaaguuugauaaauuguauaucuggggaguacaucacccuggcacugacagcgaucagauaucucuguacgcccaggcuuccggcagaguuaccgugucaacaaagaggagccaacagacugucaucccaaacauugggagucggcccugggugcgcggagugucuuccagaaucagcauuuacuggaccaucgucaaaccuggugacauacuacucauuaacucgacaggcaaucugaucgccccaaggggguauuucaagauucggucuggaaaguccucaaucaugcgcagugacgcgccgaucggcaaauguaacagcgaaugcauuacccccaaugguuccauaccuaacgauaagccauuucagaauguuaaccgaaucacguacggggcaugucccagauaugugaaacagaagacucuuaaacuggccacaggaaugaggaauguaccugagaagcaaacccggggcauuuucggcgcuaucgccggguuuauagaaaacggaugggaggguaugauggacggcugguacggguuccgucaccaaaauucugagggaacuggccaggcagcugauuugaaaagcacacaggccgcgauuaaccagaucaaugguaagcucaaccgccugaucgaaaagaccaaugagaaauuucaucagauugaaaaggaguucucagaaguggaggggagaauccaggacuuagagaaauaugucgaagauacgaagauugaccuguggaguuacaacgccgagcuccuuguggcacuggaaaaucaacacaccauagauuugacagacuccgagaugaacaaacuauucgaaaggacuaagaagcagcugcgggagaacgcugaggauaugggcaauggaugcuuuaaaaucuaucauaagugugacaacgccugcauuggcagcauccgaaaugggaccuacgaucacgacguuuaccgcgacgaagcucucaacaauagauuccagaucaaaggaguggagcugaagucugguuauaaagauuggauucuuuggauaucauuugccaucaguugcuuccuguuguguauuguccuccugggcuuuaucaugugggcaugccagaaggggaacauuagguguaauaucugcauauga

SEQ ID NO: 123173 - RNA, 1701 nt, Artificial Sequence
  derived and/or modified sequence opt3 from hemagglutinin__InfluenzaA__ABG88641
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaguaaccguuagcacaaagaggagucaacagacugugauuccaaacaucggcucugggcccuggguccggggaguguccagccgcauuucgaucuacuggaccauagugaaaccuggugacauucuacucaucaacucuacaggcaaucugauugccccaagaggguauuucaagaucagguccggaaagucaaguaucaugcggagcgacgcgccgauuggcaaauguaacuccgaaugcauaacccccaaugguucuaucccuaacgggaagccauuucagaaugucaaccgcauuacguacggagcauguccccgauauguuaaacagaauacucuuaagcuggccacaggcaugagaaacgugccugagaaacaaaccaggggcaucuucggggcuauagccggauuuauugaaaaugguugggagggcaugauggaugggugguacggauuccggcaccagaacagcgagggcacuggucaggcagcugacuugaagucaacacaagccgcgaucaaucagaucaacgggaaacucaaucgucugauugaaaagaccaacgagaaguuucaucagaucgaaaaagaguucagugaaguagagggccgcauucaggauuuagagaaguauguggaagacacgaaaauagaucugugguccuacaaugccgagcuccuugucgcacuggaaaaccaacacaccaucgacuugacagauagcgagaugaacaagcuauucgaaagaacuaaaaagcagcugagggagaaugcugaggacaugggaaacggcugcuuuaagauuuaucauaaaugugauaaugccugcaucgggucuauccggaacggaaccuacgaccacgauguguaccgagacgaagcucucaauaaccgcuuccagauuaaggguguugagcugaaaucaggcuauaaggacuggauacuuuggaucaguuuugccacaagcugcuuccuguuguguauugugcuccugggguuuaucaugugggcaugccagaaaggaaauauuagauguaacaucugcauauga

SEQ ID NO: 123174 - RNA, 1701 nt, Artificial Sequence; identical to SEQ ID NO: 122532
  derived and/or modified sequence opt3 from hemagglutinin__InfluenzaA__ABG88652

SEQ ID NO: 123175 - RNA, 1701 nt, Artificial Sequence; identical to SEQ ID NO: 122532
  derived and/or modified sequence opt3 from hemagglutinin__InfluenzaA__ABG88663

SEQ ID NO: 123176 - RNA, 1701 nt, Artificial Sequence; identical to SEQ ID NO: 122532
  derived and/or modified sequence opt3 from hemagglutinin__InfluenzaA__ABG88674

SEQ ID NO: 123177 - RNA, 1701 nt, Artificial Sequence; identical to SEQ ID NO: 122532
  derived and/or modified sequence opt3 from hemagglutinin__InfluenzaA__ABG88685

SEQ ID NO: 123178 - RNA, 1701 nt, Artificial Sequence; identical to SEQ ID NO: 122532
  derived and/or modified sequence opt3 from hemagglutinin__InfluenzaA__ABG88696

SEQ ID NO: 123179 - RNA, 1701 nt, Artificial Sequence; identical to SEQ ID NO: 122298
  derived and/or modified sequence opt3 from hemagglutinin__InfluenzaA__ABG88707

SEQ ID NO: 123180 - RNA, 1701 nt, Artificial Sequence; identical to SEQ ID NO: 122298
  derived and/or modified sequence opt3 from hemagglutinin__InfluenzaA__ABG88718

SEQ ID NO: 123181 - RNA, 1701 nt, Artificial Sequence
  derived and/or modified sequence opt3 from hemagglutinin__InfluenzaA__ABG88729
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggggauccuaugcaugcaagcgaggcucugugaacagcuuuuucucccgucucaauugguuacacaagcuggaguacaaauauccagcccuuaacgucaccaugcccaauucaggcaaguuugacaaauuguacaucuggggagugcaucacccuaguacggauagcgaccaaacuucucuguacguaagagcuuccgggaggguuaccgugucaacaaagcggagccagcagacugucaccccaaacauugguagucgccccugggugagaggccuaucuuccaggaucagcauuuauuggacaaucgugaaaccuggggacauacuccugauuaauucgaccggaaaccuuaucgccccacggggcuacuucaagauucgcaacgguaagucuuccaucaugcgaucagaugcgccgaucgggaauuguaguagcgagugcauuacgcccaacggauccauaccuaaugacaaaccauuucagaacgucaauagaaucacuuauggcgcaugucccagguacguuaagcaaaacacacugaaauuggccaccggcaugcggaaugugccugaaaagcagacucgugggauuuucggagcuaucgccgguuuuauagagaacggcugggaagggaugguagauggaugguauggcuuccgccaccaaaauucugaggguacagggcaggcagcugaccucaaaagcacccaggccgcgauugaucagaucaacggcaagcugaauagauuaaucgagaaaacgaacgaaaaguuucaucagauugagaaggaguucucagaaguggaaggaaggauccaagaccuggagaaauacgucgaggauaccaagauugaccucuggaguuauaaugccgaacuucugguggcauuggagaaccagcacacaauagaucuaacugacuccgaaaugaauaaacuguucgagaagacccggaaacagcuccgagaaaacgcugaggauaugggcaacgggugcuuuaagaucuaccauaagugugacaaugccugcauuggaagcauccgcaacgguacauacgaccacgauguuuauagagacgaggcucugaauaacagguuccagaucaaaggcguggaacuuaagucuggguacaaagauuggauucuguggauaucauuugccaucaguugcuucuugcucugugucgugcuguuaggauuuauuaugugggcaugccaaaagggcaauauccgguguaacauuugcaucuga

SEQ ID NO: 123182 - RNA, 1701 nt, Artificial Sequence
  derived and/or modified sequence opt3 from hemagglutinin__InfluenzaA__ABG88740
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggaagccgccccugggugagaggucuaaguucuaggauuuccaucuauuggaccauagugaagccuggcgacauucuccugaucaacagcacagggaaccuuauugccccacggggauacuucaagauccgcaauggcaaaucgucuaucaugcgauccgaugcgccgauugguaacuguucaagugagugcauaacccccaaugggagcaucccuaacgacaagccauuucagaaugucaacagaauuacguauggagcaugucccagguacaucaaacaaaauacucugaaguuggccacaggcaugcggaacguuccugaaaaacagacccguggcauauucggggcuauugccggauuuaucgagaaugguugggaaggcaugguggaugggugguauggauuccgccaccagaacuccgagggcacuggucaggcagcugaccucaagucuacacaagccgcgaucgaucagauuaaugggaaacugaacagauuaaucgagaagaccaaugaaaaguuucaucagauugagaaagaguucagcgaaguagaaggcaggauacaagaccuggagaaguacguggaggauacgaaaaucgaccucuggucauauaacgccgaacuucuggucgcauuggagaaucagcacaccauugaucuaacagacagugaaaugaacaagcuguucgagcggacucgaaaacagcuccgcgaaaacgcugaggauaugggaaauggcugcuuuaagaucuaccauaagugugacaacgccugcaucggguccauuagaaauggaaccuacgaccacgauguguauagggacgaggcucugaacaaucgguuccagauaaaagguguugaacuuaagagcggcuacaaagauuggauccuguggauuucuuuugccaucucaugcuucuugcucugugugguccuguuaggguuuauuaugugggcaugccaaaagggaaacauccgcuguaauauaugcaucuga

SEQ ID NO: 123183 - RNA, 1701 nt, Artificial Sequence; identical to SEQ ID NO: 123069
  derived and/or modified sequence opt3 from hemagglutinin__InfluenzaA__ABG88751

SEQ ID NO: 123184 - RNA, 1701 nt, Artificial Sequence
  derived and/or modified sequence opt3 from hemagglutinin__InfluenzaA__ABG88762
augaagaccaucauugcccugagcuacauacucugccuuguguucacacagaaacugcccggcaacgacaauuccacugcuacguuguguuuagggcaccaugcagucccuaacggaacccugguuaagacaaucacuaaugaucaaauugaggugaccaacgccacagagcuaguacagucuucaaguaccgguagaaucugcgacagcccacacaggauucucgauggcaaaaauuguacucugaucgacgcgcuucugggggauccgcauugcgacggauuucagaacaaggaaugggauuuguucguggaacgguccaaggcuuauucuaauuguuaccccuaugacgucccugauuacgccucgcuccgcucacugguggcaagcaguggcacacuggaguuuauaaacgaagacuucaauuggaccgguguugcccaggaugggggauccuaugcuugcaaacgaggcucugugaacagcuuuuucucccgucucaauugguuacacaagcuggaguacaaauauccagcacuuaacgucacgaugcccaauaacggcaaguuugacaaauuguacaucuggggagugcaucacccuucaacugauagugaccaaaccagccuguacguaagagccucugggaggguuacaguguccacuaagcggucacagcagaccgucauuccaaauaucgguagccgccccugggugagaggccuaaguucuaggauuuccaucuauuggacaauagugaaaccuggggacauucuccugaucaacagcaccggaaaccuuauugcuccacggggcuacuucaagauccgcaaugguaagucgucuaucaugcgauccgaugccucaauugggaacuguaguagcgagugcauaacgccgaauggauccauccccaacgacaaaccuuuucagaaugucaacagaauuacuuauggcgcguguccaagguacguuaagcaaaauacacugaaauuggcaaccggcaugcggaacgugcccgaaaagcagacucgugggaucuucggagccauagcugguuuuauugagaauggcugggaagggaugguagauggaugguauggcuuccgccaccagaacucugaggguacagggcaggccgcagaccucaaaagcacccaagcugccaucgaucagaucaauggcaagcugaacagauuaauugagaaaacgaaugaaaaguuucaucagaucgagaaggaagugucagaggucgaaggaaggauucaagaccuggagaaauacguggaggauaccaagauagaccucuggaguuauaacgcggaacuucugguugccuuggagaaucagcacacaaucgaucuaacugacuccgaaaugaacaaacuguucgagcggacccgaaagcagcuccgcgaaaacgcagaggauaugggcaaugggugcuucaaaauuuaccauaagugugacaacgcuugcaucggaagcaucagaaaugguacauacgaccacgauguguauagggacgaggcccugaacaaucgguuucagauuaagucugucgaacuuaaaucaggcuacaaggauuggauacuguggaucaguuucgcuauuagcugcuuuuugcucugugugguacuguuaggguucaucaugugggccugccaaaaaggaaacauucgcuguaauaucugcauauga

SEQ ID NO: 123185 - RNA, 1701 nt, Artificial Sequence
  derived and/or modified sequence opt3 from hemagglutinin__InfluenzaA__ABG88773
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaagugcugguagaaucugcgacagcccacacaggauucucgauggcaaaaauuguacacugaucgacgcccuucugggggauccgcauugcgacggauuucagaacaaggaaugggauuuguucguggaacgguccaaagcauauucuaauuguuaccccuaugacgucccugauuacgccucgcuccgcucacugguggcuagcaguggcacccuggaguuuauaaacgaagacuucaauuggacugguguugcacaggaugggaaguccuaugccugcaagcgaggaucugugaacagcuuuuucucccgucucaauugguuacacaaacuggaguacaaguauccagcucuuaacgucacaaugcccaauaacggcaaauuugacaaguuguacaucuggggcgugcaucacccuucaaccgauagugaccaaacgagccuguacguaagagccucugggaggguuacuguguccaccaaacggucacagcagacagucauuccaaauaucggaagccgccccugggugagaggucuaaguucuaggauuuccaucuauuggacuauagugaagccuggcgacauucuccugaucaacagcaccgggaaccuuauugcgccacggggauacuucaagauccgcaauggcaaaucgucuaucaugcgauccgaugcaccgauugguaacuguucaagugagugcauaacacccaaugggagcaucccuaacgacaagccauuucagaaugucaacagaauuaccuauggagccugucccagguacguuaaacaaaauacgcugaaguuggcuacuggcaugcggaacgugccugaaaaacagacacguggcaucuucggggccauagcaggauuuauugagaaugguugggaaggcaugguagaugggugguauggauuccgccaccagaacuccgagggcaccggucaggcugccgaccucaagucuacucaagcggccacagaucagaucaaugggaaacugaacagauuaaucgagaagaccaaugaaaaguuucaucagauugagaaagaguucagcgaaguggaaggcaggauccaagaccuggagaaguacgucgaggauacgaaaauugaccucuggucauauaacgcagaacuucugguggcuuuggagaaucagcacaccauagaucuaacagacagugaaaugaacaagcuguucgagcggacucgaaaacagcuccgcgaaaacgccgaggauaugggaaauggcugcuuuaagaucuaccauaagugugacaacgcuugcauuggguccaucagaaauggaaccuacgaccacgauguuuauagggacgaggcccugaacaaucgguuccagaucaaagguguggaacuuaagagcggcuacaaagauuggauucuguggauaucuuuugcaaucucaugcuucuugcucugugucgugcuguuaggguuuauuaugugggccugccaaaagggaaacauccgcuguaauauuugcaucuga

SEQ ID NO: 123186 - RNA, 1701 nt, Artificial Sequence
  derived and/or modified sequence opt3 from hemagglutinin__InfluenzaA__ABG88784
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggaagccgccccugggugagaggucuaaguucuaggauuuccaucuauuggaccauagugaagccuggcgacauucuccugaucaacagcacagggaaccuuauugccccacggggauacuucaagauccgcaauggcaaaucgucuaucaugcgauccgaugcgccgauugguaacuguucaagugagugcauaacccccaaugggagcaucccuaacgacaagccauuucagaaugucaacagaauuacguauggagcaugucccagguacguuaaacaaaauacucugaaguuggccacaggcaugcggaacgugccugaaaaacagacccguggcaucuucggggcuauagccggauuuauugagaaugguugggaaggcaugguagaugggugguauggauuccgccaccagaacuccgagggcacuggucaggcagcugaccucaagucuacacaagccgcgaucgaucagaucaaugggaaacugaacagauuaauuaagaagaccaaugagaaauuucaucagaucgaaaaggaguucagcgaaguggagggcaggauucaagaccuggaaaaauacgucgaggauacgaagauagaccucuggucauauaacgccgagcuucugguggcauuggaaaaucagcacaccaucgaucuaacagacagugagaugaacaaacuguucgaacggacucgaaagcagcuccgcgagaacgcugaagauaugggaaauggcugcuuuaagauuuaccauaaaugugacaacgccugcaucggguccaucagaaauggaaccuacgaccacgauguuuauagggacgaggcucugaacaaucgguuccagauuaaggguguggagcuuaaaagcggcuacaaggauuggauacuguggaucucuuuugccauuucaugcuucuugcucugugucgugcuguuaggguuuaucaugugggcaugccaaaaaggaaacauucgcuguaauaucugcauauga

SEQ ID NO: 123187 - RNA, 1701 nt, Artificial Sequence
  derived and/or modified sequence opt3 from hemagglutinin__InfluenzaA__ABG88806
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacggugcccaacaaugagaaguuugauaaauuguauauauggggaguacaucacccuggcacugacagcgaucagaucucucuguacgcccaggcuuccggcagaguuaccgugucaacaaagaggagccaacagacugucauuccaaacaucgggagucggcccugggugcgcggagugucuuccagaauuagcaucuacuggaccauagucaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaauguuaaccgaauuacguacggggcaugucccagauaugugaaacagaauacucuuaagcuggccacaggaaugaggaacguaccugagaaacaaacccggggcaucuucggcgcuauagccggguuuauugaaaauggaugggaggguaugauggacggcugguacggguuccgucaccagaacucugagggaacuggccaggcagcugaucuaaagagcacacaagccgcgaucaaucagaucaacgguaaacucaaucgccugauugaaaagaccaacgagaaguuucaucagaucgaaaaagaguucucagaaguggaggggaggauucaggacuuagagaaguaugucgaagauacgaaaauagaccuguggaguuacaaugccgagcuccuuguggcacuggaaaaccaacacaccaucgauuugacagacuccgagaugaacaagcuauucgaaagaacuaaaaagcagcugcgggagaaugcugaggauaugggcaacggaugcuuuaagauuuaucauaaaugugacaaugccugcaucggcagcauccgaaacgggaccuacgaucacgacguuuaccgcgacgaagcucucaauaacagauuccagauuaagggaguggagcugaaaucugguuauaaggauuggauacuuuggaucucauuugccauuaguugcuuccuguuguguaucguccuccugggcuuuauuaugugggcaugccagaaagggaauaucagguguaacauaugcaucuga

SEQ ID NO: 123188 - RNA, 1704 nt, Artificial Sequence
  derived and/or modified sequence opt3 from hemagglutinin__InfluenzaA__ABI16504
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuuccaagucuucguggucagaucaugaagccagcaguggagucuccucugcauguccuuaccagggcacacccagcuuuuuccggaaugugguauggcugaucaaaaagaacaauacuuauccaaccauaaaacgcuccuacaacaauacaaaccaagaggaccucuuaauucugugggguauccaccacucaaacaaugccgcugagcagaccaagcuauaucagaacccuacuacauacauuaguguugggaccagcacguugaaucugcgacuugugccaaagaucgcaacucguucuaaagucaacggacaguccggcagaauggauuucuucuggaccauccucaagcccaaugacgccauuaacuuugaaucaaauggcaacuucauagcuccugaguacgccuauaaaaucgugaagaaaggggauagcgcgauuaugaagagugaaguggaguacggaaauugcaacacaaaaugucaaacuccaaucggugcaauaaauucuuccaugccguuucauaacauucacccccugaccaucggcgaaugcccuaaguaugucaagagcaauaaacuuguucuggccacaggguugaggaacucgccacuccgggagcgcagaaggaagcggggacuguucggcgcuaucgccgguuuuauugaagggggauggcagggcaugguggacggcugguacggguaucaucacucuaaugaacagggauccgguuacgcagcugacaaagagucaacccagaaggccaucgauggcguaacgaacaaagugaacaguauuauagacaagaugaauacucaauucgaagcggucgggcgcgaguuuaacaauuuagaacgaagaaucgagaaccugaauaagaaaauggaggauggauuccucgacguguggacauauaacgccgaacuucugguuuugauggagaaugaaaggacccuagauuuccacgacagcaacgugaagaaucuguacgauaaaguccggcuccagcugcgugacaacgcaaaggagcuuggcaaugguuguuuugaauuuuaccauaaaugcgauaacgaguguauggaguccgugcgcaaugggacuuaugacuacccccaguauucugaagaggcuagacugaagagggaagagauuagcggcguaaaguuggagucaaucggaacauaccaaauccucaguauuuauuccaccguugccagcucucuggcuuuagccauaaugguggcaggccugucacuauggaugugcaguaacgggagccuccagugccggaucuguauuuga

SEQ ID NO: 123189 - RNA, 1701 nt, Artificial Sequence; identical to SEQ ID NO: 122649
  derived and/or modified sequence opt3 from hemagglutinin__InfluenzaA__ABI20793

SEQ ID NO: 123190 - RNA, 1701 nt, Artificial Sequence
  derived and/or modified sequence opt3 from hemagglutinin__InfluenzaA__ABI20837
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugaaaagaacggacuguaucccaaucuuagcaagucuuacgucaacaauaaagagaaggaaguguugguacuguggggcguucaucacccuuccaacaucggcgaucagcgcgcaauuuaccacaccgagaacgccuaugugucagucgugagcagucauuacucucgacguuuuacaccagaaaucgcuaagagacccaaagugagggaccaggaggggcggauaaauuauuacuggacucuacucgagccuggagauaccaucauuuucgaagccaacgguaaucugaucgcgccaugguaugcauuugcccuuucccgcggcuucgggagcggaauuaucacaucgaacgcuucuaugggcgagugugacgccaagugccagaccccgcaaggugcaauaaauuccucacugcccuuucagaacguccacccuguuacgauuggggaauguccaaaauacgugagaaguacuaaguugaggaugguaacaggacuccggaauauccccagcauucagucccgcggccuguucggcgcuaucgccggguuuaucgagggagguuggaccggcaugauugaugggugguauggauaccaucaccagaacgaacaaggcucugguuacgcggccgaccagaaaagcacucagaaugcaauaaacgggaucacaaauaaggugaacucagucauugagaaaaugaauacccaguucacggcugugggcaaggaguucaacaaguuagaacgaagaauggagaaucugaacaaaaagguugaugacggauuucucgauaucuggaccuauaacgccgaacuucugguguugcuagagaaugaaaggacacuggacuuccacgacaguaacgucaaaaaucucuacgagaaggugaaaacucaacugaagaacaaugcuaaggagauaggcaacgggugcuuugaguucuaucauaaauguaauaacgaaugcauggaauccguaaagaauggaaccuacgauuauccuaaauacagcgaggagucuaaacuuaaccgggagaaaauugacgguguuaagcuggaaucaaugggcguguaucagaucuuggccaucuacaguacagucgcaagcucccucgugcuguuagucucucugggggccauuucguuuuggaugugcagcaauggaucccuacagugucguaucugcauuuga

SEQ ID NO: 123191 - RNA, 1701 nt, Artificial Sequence
  derived and/or modified sequence opt3 from hemagglutinin__InfluenzaA__ABI20848
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucaaggagcaacugucgucagugagcaguuuugaaagguucgagauuuuuccuaaggaguccucuuggccaaaucauacaguuaccaaaggugugacggcuagcugcucccacaacgggaagucaaguuucuacaaaaaucugcucugguuaacugaaaagaacggacuguaucccaaucuuagcaaaucuuacgucaacaauaaggagaaggaaguguugguacuguggggcguucaucacccuuccaacaucggcgaucagcgggcaauuuaccacaccgagaacgcccaugugucagucgugagcagucacuauucucgccgauuuacaccagaaaucgcuaaacgucccaaggugagagaccaggaggggaggauaaauuacuauuggacucuacucgagccuggagauaccaucauuuucgaagccaacgguaaucugaucgcgccaugguacgcauuugcccuuucccggggcuucgggagcggaauuaucacaucgaacgcuucuaugggcgagugugacgccaaaugccagaccccgcaaggugcaauaaauuccucacugcccuuucagaacguccauccuguuacgauuggggaauguccaaaguaugugcgcaguacuaaauugagaaugguaacaggacucaggaauauccccagcauucagucccggggccuguucggcgcuaucgccggguuuaucgagggagguuggaccggcaugauugaugggugguacggauaucaccaccagaacgaacaaggcucugguuacgcggccgacaagaaaagcacucagaaugcaauagaugggaucacaaacaaggucaauucagugauugagaagaugaacacccaguucacggcugugggcaaagaguucaauaaguuagaacgccgaauggagaaccugaauaaaaagguugacgauggauuucucgacaucuggaccuacaacgccgaacuucugguguugcuagagaacgaaagaacacuggacuuccaugauaguaaugucaaaaaccucuaugagaaggugaagaaucagcugaaaaacaaugcuaaggagauaggcaacgggugcuuugaguucuaccacaaauguaauaacgaaugcauggaauccguaaagaauggaacuuaugacuacccuaaauauagcgaggagucuaaacuuaagagggaaaagauugaugguguuaagcuggagucaaugggcguguaccaaaucuuggccaucuauaguaccgucgcaagcucccucgugcuguuagucucucugggggccauuucguuuuggaugugcagcaacggaucccuacagugucggaucugcauuuga

SEQ ID NO: 123192 - RNA, 1701 nt, Artificial Sequence; identical to SEQ ID NO: 122937
  derived and/or modified sequence opt3 from hemagglutinin__InfluenzaA__ABI20859

SEQ ID NO: 123193 - RNA, 1701 nt, Artificial Sequence
  derived and/or modified sequence opt3 from hemagglutinin__InfluenzaA__ABI20870
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaauagcuccccugcagcuugguaauuguucagucgccggcuggauccuggggaacccugagugcgaaaguuuguuuagcaaagaguccuggucuuacauugcagaaacaccaaauccggagaacggaaccuguuaucccggcaauuucgccgacuacgaggaacucagggagcaacugucgucagugagcaguuuugaacgguucgagaucuuuccuaaggaguccucuuggccaaaccauacuguuacaaagggugugaccgucagcugcucccacaaugggaaaucaaguuucuaucgcaaccugcucugguuaacggaaaagaauggacuguaccccaaccuuagcaaaucuuaugugaauaacaaggagaaagaaguauugguucuguggggcgugcaucacccuuccaacaugcgagaucagcgugcuauuuaccacacugagaaugcauacgucucaguggugagcagucauuauucuagaagguuuaccccagaaaucgccaagcggcccaagguccgcgaccaggagggcagaauaaacuacuauuggacacuacucgagccuggggauacuaucauuuucgaagcuaauggaaaccugaucgccccaagguacgcguuugcacuuucccgggguuucggcagcgggauuaucaccucgaaugccucuauggacgagugugaugcuaaaugccagacaccgcaaggagccauaaacuccucacugcccuuucagaauguucacccugugaccauuggcgaauguccaaaguauguacgcaguacgaaauugcgaauggugacuggucucagaaacauccccagcauucaguccagggggcuguucggagcaaucgcuggcuuuaucgagggcggguggacaggaaugauugacgguugguacggcuaucaucaccagaaugaacaagggucuggauacgccgcggaucaaaagagcacccagaacgccauaaauggcaucacuaacaaagucaauucagugauugagaagaugaacacacaguucaccgcaguugguaaagaguucaauaaguuagaacggcguauggagaaccugaacaagaaaguggacgauggguuucucgacaucuggacguacaaugcugaacuucuggucuugcuagagaacgaacgcacccuggacuuccacgauaguaaugugaagaaccucuaugagaaaguaaagucccagcugaaaaauaacgccaaggagauaggcaauggaugcuuugaguucuaccauaaguguaacaaugaaugcauggaaagcguuaaaaacggcacauaugacuacccuaaguauucugaggagucaaaacuuaauagagaaaagauugauggggugaaacuggagaguaugggagucuaccagaucuuggcuaucuauagcacuguggccuccucucucguccuguuagugucgcugggugcaauuagcuuuuggaugugcuccaacggcucacuacaguguaggaucugcauuuga

SEQ ID NO: 123194 - RNA, 1701 nt, Artificial Sequence; identical to SEQ ID NO: 123005
  derived and/or modified sequence opt3 from hemagglutinin__InfluenzaA__ABI20881

SEQ ID NO: 123195 - RNA, 1701 nt, Artificial Sequence
  derived and/or modified sequence opt3 from hemagglutinin__InfluenzaA__ABI20892
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaaggaagguuucaacuggaccgggguugcucaggacggaaaguccuaugcaugcaaacgaggcucugugaauagcuuuuucucccgucucaacugguuacacaagcuggaguacaaauauccagcccuuaaugucacgaugcccaacaaugauaaguuugacaaauuguacauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccauccacuggacaauagugaagccuggcgacauucuacucaucaccagcacggggaaucugauugccccaaggggauauuucaaaauccggaacggcaagucgucuaucaugcgcuccgaugcgccgauugguaacuguaauucagagugcauaacucccaacgggaguaucccuaaugacaaaccauuucaaaacgucaaucgaauuacauacggagcaugucccagauauguuaagcagaacacccuuaaacuggccacuggcaugaggaaugugccugaaaagcagacacggggcaucuucggggcuauagccggauuuauugagaacgguugggaaggcaugguagaugggugguacggauuccgucaucagaauagcgagggcaccggucaagcagcugacuugaaauccacgcaggccgcgaucgaucagaucaacgggaagcucaaucgccugauugagaagaccaacgaaaaauuucaccaaaucgagaaggaguucucugaaguggaaggcaggauucaggacuuagagaaauaugucgaggauacaaagauagaccuguggagcuacaaugccgaacuccuuguggcacuggagaaccagcauacuaucgauuugaccgacucagaaaugaauaaacuauucgagagaacacggaagcagcugcgagaaaacgcugaggauaugggaaacggcugcuuuaagauuuaucacaaaugugacaaugccugcaucgggaguauccgcaacggaacuuacgaccacgauguuuacagagacgaggcucucaauaacagguuccaaauuaaggguguggaacugaaauccggcuauaaggauuggauacuuuggaucagcuuugccauuucuugcuuccuguugugugucgugcuccugggguuuaucaugugggcaugccagaaaggaaauauucgguguaacaucugcauauga

SEQ ID NO: 123196 - RNA, 1701 nt, Artificial Sequence
  derived and/or modified sequence opt3 from hemagglutinin__InfluenzaA__ABI20903
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagaauagcccaacagguagaaucugcgacucaccgcacaggauucucgauggcaaaaacuguacccugaucgacgcucuacugggggauccccauugcgacggauuucagaauaaggagugggauuuguucguggaacggaguaaagccuauagcaacuguuacccuuaugacgucccagauuacgcaucccuccgcucucugguggccucgucaggcacucuggaguuuacaaaugaaaacuucaauuggaccgguguugcucaggacgggaagucuuaugcaugcaagcgaggaagugugaacuccuuuuucucucgucucaauugguuacacaaacuggaguacaaguaucccgcccuuaacgucacgaugccuaauaacggcaaauuugauaaguuguacauauggggcgugcaucacccaagcacugacuccgaucaaaccucacuguacguaagagcuagugggaaaguuacagugagcacuaagaggucucagcagaccgucauccccgacauuggauaucggccuugggugcgcggucuauccucaagaaucagcauuuacuggacaaucgugaagccaggcgacauacuccugauucacaguaccgggaaccuuaucgccccgaggggauauuucaaaauucggaauggcaagucuuccaucaugcgcagcgaugcgcccaucgguaacuguucgucugagugcauuacgccuaauggguccauaccaaacgacaaacccuuucagaaugucaaccgaaucacuuacggagcauguccuagauauguuaagcaaaauacacugaaauuggccaccggcaugaggaacgugccagaaaagcagacucggggcauuuucggggcuaucgccggauuuauagagaaugguugggaaggcaugguagaugggugguacggauuccgucaucagaacucagagggcacaggucaggcagcugaccucaaaaguacccaagccgcgauugaucagaucaaugggaagcugaaccgcuuaguggagaagacgaaugaaaaauuucaccagaucgagaaggaguucagcgaagucgaaggcaggauucaagaccuggagaaauauguggaggauaccaagaucgaccucugguccuacaacgccgaacuucugguugcauuggagaaucagcauacaauugaucuaacugacucugaaaugaacaaacuguucgagagaacccggaagcagcuccgagaaaacgcugaggauaugggaaauggcugcuuuaagauauaccacaaaugugacaacgccugcaucgggagcauucgcaauggaacauaugaccacgauguguacagagacgaggcucugaacaauagguuccagaucaagggugucgaacuuaaaucaggcuauaaggauuggauccuguggauuaguuuugccauauccugcuucuugcucugugugguacuguuaggguuuaucaugugggcaugccaaaaaggaaacauucgguguaauaucugcauuuga

SEQ ID NO: 123197 - RNA, 1701 nt, Artificial Sequence
  derived and/or modified sequence opt3 from hemagglutinin__InfluenzaA__ABI20914
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaagauccgcaauggcaaaagcucgaucaugcgaucugaugcgccgauugguaacuguuccucagagugcauaacccccaaugggaguaucccuaacgacaagccauuccagaaugucaacagaauuacguauggagcaugucccagguacguuaaacaaaauacucugaaguuggccacaggcaugcggaacgugccugaaaaacagacccguggcaucuuuggggcuauagccggauucauugagaaugguugggaaggcaugguagaugggugguauggauuucgccaccagaacagcgagggcacuggucaggcagcugaccucaaguccacacaagccgcgaucgaucagaucaaugggaaacugaacagauuaauugagaagaccaaugaaaaguuccaucagaucgagaaagaguucucugaaguggaaggcaggauucaagaccuggagaaguacgucgaggauacgaaaauagaccucuggagcuauaacgccggacuucugguggcauuggaaaaucagcacaccaucgaucuaacagacucagagaugaacaagcuguuugaacggacucgaaaacagcuccgcgagaacgcugaagauaugggcaaugggugcuucaagauuuaccauaagugugacaacgccugcaucggaaguaucagaaaugguaccuacgaccacgauguuuauagggacgaggcucugaacaaucgguuucagauuaaaggcguggagcuuaaguccggguacaaagauuggauacuguggaucagcuucgccauuucuugcuuuuugcucugugucgugucacugggauucaucaugugggcaugccaaaagggcaacauucgcuguaauaucugcauauga

SEQ ID NO: 123198 - RNA, 1701 nt, Artificial Sequence; identical to SEQ ID NO: 123082
  derived and/or modified sequence opt3 from hemagglutinin__InfluenzaA__ABI20925

SEQ ID NO: 123199 - RNA, 1701 nt, Artificial Sequence; identical to SEQ ID NO: 123082
  derived and/or modified sequence opt3 from hemagglutinin__InfluenzaA__ABI20936

SEQ ID NO: 123200 - RNA, 1701 nt, Artificial Sequence
  derived and/or modified sequence opt3 from hemagglutinin__InfluenzaA__ABI20947
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaagauccgcaauggcaaaagcucgaucaugcgaucugaugcgccgauugguaacuguuccucagagugcauaacccccaaugggaguaucccuaacgacaagccauuccagaaugucaacagaauuacguauggagcaugucccagguacguuaaacaaaauacucugaaguuggccacaggcaugcggaacgugccugaaaaacagacccguggcaucuuuggggcuauagccggauucauugagaaugguugggaaggcaugguagaugggugguauggauuucgccaccagaacagcgagggcacuggucaggcagcugaccucaaguccacacaagccgcgaucgaucagaucaaugggaaacugaacagauuaauugagaagaccaaugaaaaguuccaucagaucgagcaagaguucucugaaguggaaggcaggauucaggaccuggagaaauacgucgaggauacgaagauagaccucuggagcuauaacgccggacuucugguggcauuggaaaaucagcacaccaucgaucuaacagacucagagaugaacaaacuguuugaacggacucgaaagcagcuccgcgagaacgcugaagauaugggcaaugggugcuucaaaauuuaccauaagugugacaacgccugcaucggaaguaucagaaaugguaccuacgaccacgauguuuauagggacgaggcucugaacaaucgguuucaaauuaagggcguggagcuuaaauccggguacaaggauuggauacuguggaucagcuucgccauuucuugcuuuuugcucugugucgugcuguuaggauucaucaugugggcaugccagaaaggcaacauucgcuguaauaucugcauauga

SEQ ID NO: 123201 - RNA, 1701 nt, Artificial Sequence
  derived and/or modified sequence opt3 from hemagglutinin__InfluenzaA__ABI20958
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuauacaaacuggaguauaaguacccagcccuuaacgucaccaugcccaauaacggcaaauuugacaaguuguacaucuggggcgugcaccauccuucaacggauagugaccaaacuagccuguauguaagagcuucugggaggguuaccguguccacaaaacggucacagcagacugucauuccaaauaucggauuccgccccugggugagaggucuaagcaguaggauuucuaucuacuggaccauagugaagccuggcgacauucuccugaucaacuccacagggaaccuuauugccccacggggauauuuuaagauccgcaauggcaaaagcucgaucaugcgaucugaugcgccgauugguaacuguuccucagagugcauaacccccaaugggaguaucccuaacgacaagccauuccagaaugucaacagaauuacguacggagcaugucccagguauguuaaacaaaauacucugaaguuggccacaggcaugcggaacgugccugaaaaacagacccguggcaucuuuggggcuauagccggauucauugagaaugguugggaaggcaugguagaugggugguacggauuucgccaccagaacagcgagggcacuggucaggcagcugaccucaaguccacacaagccgcgaucgaucagaucaaugggaaacugaacagauuaauugagaagaccaaugaaaaguuccaccagaucgagaaagaguucucugaaguggaaggcaggauucaagaccuggagaaguaugucgaggauacgaaaauagaccucuggagcuacaacgccggacuucugguggcauuggaaaaucagcauaccaucgaucuaacagacucagagaugaacaagcuguuugaacggacucgaaaacagcuccgcgagaacgcugaagauaugggcaaugggugcuucaagauuuaccacaagugugacaacgccugcaucggaaguaucagaaaugguaccuaugaccaugauguuuacagggacgaggcucugaacaaucgguuucagauuaaaggcguggagcuuaaguccggguauaaagauuggauacuguggaucagcuucgccauuucuugcuuuuugcucugugucgugcuguuaggauucaucaugugggcaugccaaaagggcaacauucgcuguaauaucugcauauga

SEQ ID NO: 123202 - RNA, 1701 nt, Artificial Sequence
  derived and/or modified sequence opt3 from hemagglutinin__InfluenzaA__ABI20969
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaauggaauuuguucgucgagagguccacugccuauucuaacuguuaccccuaugaugugccugacuacgcaucgcuccggucacugguugccagcaguggaacacuggaauuuaauaacgaguccuucaauuggaccggcguggcucagaacgguacgucuagcgcaugcaagcgccgauccauaaaaucauuuuucagucgucucaauugguuacaucaacugaaguauaaguacccagcccuuaacgucacuaugcccaauaacgagaaauuugauaaguuguauaucuggggagugcaccacccuagcaccgacucugaucagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggacauccuacucauuaauucuaccggaaaccugaucgcgccaagggguuauuucaaaauccgguccggcaagucaaguauuaugcgcagcaaugcaccgauagggaaguguaacuccgaaugcaucacgcccaauggaucuauuccuaacgauaaaccauuucagaaugucaaccgaaucacuuacggcgccugucccagauauguuaagcagaauacacuuaaacuggcuaccgguaugaggaacgugccugagaagcagacucgggggauauucggagccauugcaggcuuuaucgaaaauggcugggaggggaugguagacggaugguacgguuuccgucaucaaaacagcgagggcacagggcaggcugccgacuugaaaucaacccaggcggccaucaaucaaauuaacggaaagcucaaucgccugaucgagaaaacgaacgaaaaguuucaccagauugaaaaggaguucagugaaguggagggcagaauacaggauuuagagaaauaugucgaagacaccaagaucgaucugugguccuacaacgcagagcuccuuguggcucuggaaaaucagcauacaauugacuugacugauagcgagaugaacaaacuauucgaaaggacccggaagcaacugcgagagaaugccgaggacauggguaacgggugcuuuaaaaucuaucacaagugugauaaugcuugcaucggcucuauucgcaacggaacauacgaccacgauguuuacagagacgaagcccucaauaacagguuccagauaaagggcguggagcugaaaucaggguauaaggauuggauccuuuggauuaguuuugcaaucagcugcuuccuguugugugucgugcuccugggauuuauuaugugggccugccagaaagguaauauccgguguaacauaugcaucuga

SEQ ID NO: 123203 - RNA, 1701 nt, Artificial Sequence
  derived and/or modified sequence opt3 from hemagglutinin__InfluenzaA__ABI20980
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggaccagaaugguacgucuagcgcuugcaagcgccgauccacuaaaucauuuuucagucgucucaacugguuacaucaacugaaguauaaguacccagcacuuaaugucaccaugcccaacaaugagaaauuugauaaguuguauauauggggagugcaccacccuagcacagacucugaucagaucucccuguacgcccaggcuucagggagaguaacuguuagcaccaaaaggagucagcaaacagugaccccaaacauuggcucucggcccuggguccgcggcguguccagcagaaucucgauuuacuggacgaucgugaagccuggggacauacuacucauuaacucuacuggaaaucugaucgccccaagggguuauuucaaaauucgguccggcaagucaaguaucaugcgcagcaacgcgcuuaucgggaaguguaauuccgaaugcauuacaccgaacggaucuauacccaaugacaaaccuuuucagaacgucaaucgaaucaccuacggcgcauguccaagauauguuaagcagaacacucugaaauuggccacagguaugaggaaugugcccgagaagcagacccgggggauuuucggagcuaucgccggcuuuauagaaaacggcugggaggggaugguagauggaugguacgguuuccgucaucaaaauagcgagggcacggggcaggcagcugaccucaaaucaacccaggccgcgauuaaccaaaucaauggaaagcugaaccgcuuaaucgagaaaacaaaugaaaaguuucaccagauugaaaaggaguucagugaaguggagggcagaauccaggaucuggagaaauaugucgaagacacuaagauugaucucugguccuacaacgccgagauacuuguggcacuggaaaaccagcauaccaucgacuugacagauagcgagaugaauaaacuauucgaaaggacucggaagcaacugcgagagaacgcugaggacauggguaaugggugcuuuaaaauuuaucacaagugugauaacgccugcaucggcucuauccgcaauggaaccuacgaccacgauguuuacagagacgaagcucucaacaauagguuccagauuaagggcguggagcugaaaucaggguauaaggacuggauacuuuggaucaguuuugccauuagcugcuuccuguugugugucgugcuccugggauuuaucaugugggcaugccagaaagguaacauucgguguaauaucugcauauga

SEQ ID NO: 123204 - RNA, 1701 nt, Artificial Sequence
  derived and/or modified sequence opt3 from hemagglutinin__InfluenzaA__ABI20991
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucuacacaagcggccaucaaccagaucaaugguaaacucaaccgucugauugaaaagaccaaugagaaguuucaucagaucgaaaaagaguucucagaaguagaggggcgcauucaggauuuagagaaguauguggaagacacgaaaauagaucuguggaguuacaacgcagagcuccuugucgcucuggaaaaccaacacaccaucgacuugacagauuccgagauuaauaagcuauucgaaagaacuaaaaagcagcugagggagaacgccgaggacaugggcaauggauguuuuaagaucuaucauaaaugcgauaacgcuugcaucggcagcauucggaaugggaccuacgaccacgauguguaccgagacgaagcccucaacaaucgcuuccagauaaagggaguugagcugaaaucugguuauaaggacuggauccuuuggauuucauuugcaaucaguuguuuccuguugugcgugguccuccugggcuuuauuaugugggccugucagaaagggaacaucagaugcaauauauguaucuga

SEQ ID NO: 123205 - RNA, 1701 nt, Artificial Sequence; identical to SEQ ID NO: 122726
  derived and/or modified sequence opt3 from hemagglutinin__InfluenzaA__ABI21002

SEQ ID NO: 123206 - RNA, 1701 nt, Artificial Sequence; identical to SEQ ID NO: 123170
  derived and/or modified sequence opt3 from hemagglutinin__InfluenzaA__ABI21013

SEQ ID NO: 123207 - RNA, 1701 nt, Artificial Sequence; identical to SEQ ID NO: 122656
  derived and/or modified sequence opt3 from hemagglutinin__InfluenzaA__ABI21024

SEQ ID NO: 123208 - RNA, 1701 nt, Artificial Sequence; identical to SEQ ID NO: 122532
  derived and/or modified sequence opt3 from hemagglutinin__InfluenzaA__ABI21035

SEQ ID NO: 123209 - RNA, 1701 nt, Artificial Sequence
  derived and/or modified sequence opt3 from hemagglutinin__InfluenzaA__ABI21046
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacaacgaucagauuagcuuguaugcccaggcuucugggcguaucacuguguccaccaagagaucacaacagacaguaauuccaaacaucggaagcaggccccggguucgcgacgugaguucuagaauauccauuuacuggaccaucgucaagccuggugacauucugcuaaucaauagcacgggcaaccucaucgccccaaggggguacuucaagauucggucgggaaaaucuuccauaaugcgcucagaugcgccgaucggcaaguguaauagugagugcauuacucccaacgguagcaucccuaaugacaaaccauuucagaacgugaaucgaauaacauauggggcaugucccagauacgugaagcagaacacccugaaacuugccacuggaaugaggaaugucccugaaaagcaaacacggggcauuuucggcgcuaucgccggguuuaucgagaacggaugggaagguaugguugauggcugguauggguuccgucaccaaaauuccgagggaaccggccaggcagcugaccugaaaucuacgcaggccgcgauuaaccagaucaaugguaaguugaaccgccucauugggaagaccaaugagaaauuucaucagauagaaaaggaguucagcgaaguggagggcagaauccaggaucuggaaaaauacguagaggacacaaagauugauuuauggucauauaacgccgagcugcucguggcacuugaaaaccaacacacuaucgaccugaccgauagugagaugaauaaauuguucgaaaggacaaagaagcagcuacgggagaacgcugaagacaugggaaauggcugcuuuaaaaucuaccauaagugugauaacgccugcauuggguccauacgaaauggaacuuaugaccacgacgucuaccgcgaugaggcucugaacaauagauuccagaucaaagguguggagcucaagagcggcuacaaagacuggauucuguggaucucuuuugccauuucaugcuuccuucuguguguugcauugcucggguuuaucaugugggccugccagaagggaaacauaagguguaauaucugcauuuga

SEQ ID NO: 123210 - RNA, 1701 nt, Artificial Sequence
  derived and/or modified sequence opt3 from hemagglutinin__InfluenzaA__ABI21057
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacagguggcauuugcgacaguccacaccagauccuagauggggagaacuguacccucauagacgcucugcuuggagauccgcagugcgacggcuuucagaauaaaaagugggaucuguucguggaaagaagcaaagccuauuccaacuguuaccccuaugacgucccugaucaugcaucuuugaggucgcucguggccucaagcgguacucuggaguuuaauaacgaaaguuucgacuggacagggguuacccagaauggaacguccucugcuugcaagcggcgcagcaacaaguccuuuuucucacgacugaauuggcucacucacuuaaaauacaaguauccagcacugaacgugaccaugcccaauaacgagaaauuugauaaacuuuacaucuggggcguccaucacccuggcacagacagugaucagauuagcuuguaugcccaggcuucugggcguaucacuguguccaccaagagaucacaacagacaguaauuccaaacaucggaagcaggccccggguucgcgacgugaguucuagaauauccauuuacuggaccaucgucaagccuggugacauucugcuaaucaauagcacgggcaaccucaucgccccaaggggguacuucaagauucggucgggaaaaucuuccauaaugcgcucagaugcgccgaucggcaaguguaauagugagugcauuacucccaacgguagcaucccuaaugacaaaccauuucagaacgugaaucgaauaacauauggggcaugucccagauacgugaagcagaacacccugaaacuugccacuggaaugaggaaugucccugaaaagcaaacacggggcauuuucggcgcuaucgccggguuuaucgagaacggaugggaagguaugguugauggcugguauggguuccgucaccaaaauuccgagggaaccggccaggcagcugaccugaaaucuacgcaggccgcgauuaaccagaucaaugguaaguugaaccgccucauugggaagaccaaugagaaauuucaucagauagaaaaggaguucagcgaaguggagggcagaauccaggaucuggaaaaauacguagaggacacaaagauugauuuauggucauauaacgccgagcugcucguggcacuugaaaaccaacacacuaucgaccugaccgauagugagaugaauaaauuguucgaaaggacaaagaagcagcuacgggagaacgcugaagacaugggaaauggcugcuuuaaaaucuaccauaagugugauaacgccugcauuggguccauacgaaauggaacuuaugaccacgacgucuaccgcgaugaggcucugaacaauagauuccagaucaaagguguggagcucaagagcggcuacaaagacuggauucuguggaucucuuuugccauuucaugcuuccuucuguguguugcauugcucggguuuaucaugugggccugccagaagggaaacauaagguguaauaucugcauuuga

SEQ ID NO: 123211 - RNA, 1701 nt, Artificial Sequence; identical to SEQ ID NO: 122259
  derived and/or modified sequence opt3 from hemagglutinin__InfluenzaA__ABI21068

SEQ ID NO: 123212 - RNA, 1701 nt, Artificial Sequence; identical to SEQ ID NO: 122298
  derived and/or modified sequence opt3 from hemagglutinin__InfluenzaA__ABI21079

SEQ ID NO: 123213 - RNA, 1701 nt, Artificial Sequence; identical to SEQ ID NO: 123129
  derived and/or modified sequence opt3 from hemagglutinin__InfluenzaA__ABI21090

SEQ ID NO: 123214 - RNA, 1701 nt, Artificial Sequence; identical to SEQ ID NO: 123129
  derived and/or modified sequence opt3 from hemagglutinin__InfluenzaA__ABI21101

SEQ ID NO: 123215 - RNA, 1701 nt, Artificial Sequence
  derived and/or modified sequence opt3 from hemagglutinin__InfluenzaA__ABI21123
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacaaauaacgaucagauuagcuuguaugcccaggcuucugggcguaucacuguguccaccaagagaucacaacagacaguaauuccaaauaucggaagcaggccccggguucgcgacauaccuaguagaauuucuaucuacuggaccauugugaaaccaggugauauccugcuaaucaacuccacgggcaaucucauugccccgaggggguacuuuaagauacggagcggaaagucgucuaucaugcgcuccgacgcgcccauuggcaaauguaacucagagugcaucacuccuaaugguaguauaccaaacgacaagcccuuccagaaugucaaccgaauuacauauggggcauguccuagauacgugaaacagaauacccugaaacuugccacuggaaugaggaacgugccagaaaagcaaacacggggcaucuuuggcgcuaucgccggguucauugagaauggaugggaagguauggucgauggcugguauggguuucgucaccagaacagcgagggaaucggccaggcagcugaccugaaguccacccaagccgcgauuaaucagauaaacgguaaauugaaccgccucaucgggaagacgaaugagaaguuccaccagauugaaaaagaguucucugaaguugagggcagaauccaggaucuggaaaagcauguggaggacaccaaaaucgauuuauggagcuacaacgccgagcugcucguagcacuugaaaaucaacacacaauugaccugacugauucagagaugaacaaguuguuugaaaggaccaaaaagcagcuacgggagaaugcugaagacaugggaaacggcugcuucaagauauaucauaaaugugauaaugccugcaucgggaguauucgaaacggaacauacgaccacgauguguaucgcgacgaggcucugaauaacagauuucagaucaagggugucgagcucaaauccggcuacaaggacuggauucuguggaucagcuucgccauaucuugcuuucuucuguguguggcauugcucggguucaucaugugggccugccagaaaggaaauauuagguguaacaucugcauuuga

SEQ ID NO: 123216 - RNA, 1701 nt, Artificial Sequence
  derived and/or modified sequence opt3 from hemagglutinin__InfluenzaA__ABI21134
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcagucuucaaguacagguggcaucugcgacagcccacaccagauucuagauggggagaauuguacccucauggacgcucugcuuggagauccgcagugcgacggcuuucaaaacaaaaagugggaucuguucgucgaaagauccaaagccuauucuaauuguuaccccuaugacgugccugauuacgcaucguugaggucacucguugccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaaugucaccaugcccaacaacgagaaguucgacaaacuuuacaucuggggcgugcaccauccuggcacagauaaugaccagauauccuuguaugcccaggcuucugggcguaucacuguauccaccaagagaucacaacagacaguuauuccaaacaucggaagcaggagucgggugcgcgauauucccucuagaaucuccauauacuggaccauugucaaaccuggugacauccugcuaauuaauagcacgggcaaccucaucgccccaaggggguacuuuaagauccggucgggaaagucuuccauuaugcgcucagacgcgccgauaggcaaauguaauagugagugcaucacucccaacgguagcauuccuaaugauaagccauuccagaacgugaaucgaaucacauauggggcaugucccagauacgugaaacagaacacccugaaacuugccacuggaaugaggaaugucccugaaaaacaaacacggggcauauuuggcgcuauugccggguucaucgagaacggaugggaagguaugguugacggcugguauggguuucgucaccagaauagcgagggaaccggccaggcagcugaucugaagucuacgcaagccgcgaucaaccagauuaaugguaaauugaaccgccucaucgggaagaccaacgagaaguuccaccagauugaaaaagaguucagcgaaguggagggcagaauacaggaccuggaaaaguacguagaggauacaaaaaucgacuuauggucauauaaugccgagcugcucguggcacuugaaaaccaacauacuauugaucugaccgacagugagaugaauaaguuguuugaaaggacaaagaagcagcuacgggagaacgcugaagauaugggaaauggcugcuucaagaucuaccacaaaugugacaacgccugcaucggguccauucgaaauggaacuuaugaucaugacgucuaccgcgacgaggcucugaacaauagauuucagauaaaggguguggagcucaaaagcggcuacaaggauuggauccuguggauuucuuucgccaucucaugcuuucuucuguguguugcauugcucggguucauuaugugggccugccagaaaggaaacaucagguguaauauaugcaucuga

SEQ ID NO: 123217 - RNA, 1701 nt, Artificial Sequence; identical to SEQ ID NO: 122298
  derived and/or modified sequence opt3 from hemagglutinin__InfluenzaA__ABI21156

SEQ ID NO: 123218 - RNA, 1701 nt, Artificial Sequence
  derived and/or modified sequence opt3 from hemagglutinin__InfluenzaA__ABI21167
augaagaccaucauugcccugggcuacauacucugccuuguguucgcucagaaacugcccgggaacgacaauagcacagcaacuuuguguuuaggacaccaugccgucccuaacgguacgaucguuaagaccauuacaaaugaucaaaucgaggugacuaacgcgaccgaacugguacaguccucuucaacaggcgggauuugcgacaguccacaccagauccuagauggagagaauuguacccucauagacgcucugcuuggcgauccgcagugcgacgguuuucaaaacaaaaagugggaucuguucguggaaagaagcaaagccuauuccaauuguuaccccuaugacgucccugauuacgcaucuuugaggucgcucguggccucaagcgggacucuggaguuuaacaaugaaaguuucaacuggacaggaguuacccagaauggcacguccucugcuugcaagcggcgcagcaacaauuccuuuuucucacgacugaacuggcucacucauuuaaaguuuaaauauccagcacugaaugugaccaugcccaacaacgagaaguucgacaaacuuuacaucuggggcguccaccauccugggacaaauaacgaucagauuaguuuguaugcccaggcuagcggacguaucacugugucuaccaagagaucccaacagacaguaauuccaaauaucgguucaaggccccggguucgcgacauaccuagcagaauuaguaucuacuggaccauugugaaaccaggcgauauccugcuaaucaacucuacggggaaucucauugccccgaggggauacuuuaagauacgguccggcaagagcucgaucaugcgcucugacgcgcccauugguaaauguaacuccgagugcaucacuccuaaugggucaauaccaaacgacaagcccuuccagaaugucaaccgaauuacauauggagcauguccuagauacgugaaacagaauacccugaagcuggccacuggcaugaggaacgugccagaaaaacaaacacggggcaucuuuggggcuaucgccggauucauugagaaugguugggaaggcauggucgaugggugguauggauuucgucaccagaacagugagggcaucggucaggcagcugaccuuaagagcacccaagccgcgauuaaucagauaaacgggaaauugaaccgccucaucggcaagacgaaugagaaguuccaccagauugaaaaagaguucuccgaaguugagggaagaauccaggaucuggaaaaguacguggaggacaccaaaaucgauuuauggucuuauaacgccgagcugcucguagcacuugaaaaucaacauacaauugaccugacugauagcgagaugaacaaguuguuugaaaggaccaaaaagcagcuacgggagaaugcugaagacaugggcaacgggugcuucaagauauaccacaaaugugauaaugccugcaucggaucaauucgaaacgguacauaugaccaugagguguaccgcgaugaggcucugaauaacagauuucagaucaagggcgucgaacucaaaaguggguacaaggacuggauucuguggaucuccuucgccauaagcugcuuucuucuguguguggcauugcucggauucaucaugugggccugccagaaaggcaauauuagguguaacaucugcauuuga

SEQ ID NO: 123219 - RNA, 1701 nt, Artificial Sequence
  derived and/or modified sequence opt3 from hemagglutinin__InfluenzaA__ABI21178
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuucguguuaccccuaugacgucccugauuacgcaucauugaggagccucguggccaguuccgguacucuggaguuuaauaacgaaucuuucaauuggacagggguuacccagaacggaacgagcuccgcuugcaagcggcgcucaaauaacuccuuuuucagccgacugaauuggcucacucauuuaaaguuuaaauauccagcacugaacgugaccaugcccaauaacgagaaguucgacaaacuuuacaucuggggcguccaccauccuggcacaaacaaugaucagauuucuuuguaugcccaggcuuccgggcguaucacugugucaaccaagagaagccaacagacaguaauuccaaacaucggaaguaggccccggguucgcgacauaccuucuagaauuuccaucuacuggaccauugugaaaccaggugauauccugcuaaucaauagcacgggcaaccucauugccccgaggggguacuuuaagauacggucgggaaagucuuccaucaugcgcucagacgcgcccauuggcaaauguaauagugagugcaucacuccuaacgguagcauaccaaaugacaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucgauggcugguauggguuucgucaccagaauagugagggaaucggccaggcagcugaccugaagucuacccaagccgcgauuaaccagauaaaugguaaauugaaccgccucaucgggaagacgaacgagaaguuccaccagauugaaaaagaguucagcgaaguugagggcagaauccaggaucuggaaaaguacguggaggacaccaaaaucgauuuauggucauauaaugccgagcugcucguagcacuugaaaaccaacauacaauugaccugacugauagugagaugaauaaguuguuugaaaggaccaaaaagcagcuacgggagaacgcugaagacaugggaaauggcugcuucaagauauaccacaaaugugauaacgccugcaucggguccauucgaaauggaacauaugaccaugauguguaccgcgacgaggcucugaacaauagauuucagaucaagggugucgagcucaaaagcggcuacaaggacuggauucuguggaucucuuucgccauaucaugcuuucuucuguguguggcauugcucggguucaucaugugggccugccagaaaggaaacauuagguguaauaucugcauuuga

SEQ ID NO: 123220 - RNA, 1698 nt, Artificial Sequence
  derived and/or modified sequence opt3 from hemagglutinin__InfluenzaA__ABI21200
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccgccaaguuacggauggugacgggacugcgcaauauuccaucaauccagagucgaggccucuucggcgcaaucgcuggguuuauugaaggagguuggacuggcauggucgacgggugguacggauaucaucaccagaacgagcaaggcagcgguuacgccgcggaucagaaauccacacagaaugccauaaacgggaucaccaauaaggugaacucuguuauugaaaagaugaauacucaguucacagcagugggcaaagaguucaacaaacuugagagaaggauggaaaaucugaacaagaaggucgacgauggauuuuuggacaucuggaccuacaacgcugagcuacuggugcuccuggaaaaugagcggacgcuugacuuccacgauagcaacguuaaaaaucuguaugaaaagguaaaaucacaauugaagaacaaugccaaagagauaggcaacgggugcuuugaguucuaccauaaguguaaugacgaaugcauggagagugugaagaacggaaccuaugauuaccccaaauauuccgaagagagcaagcucaaucgugagcgcauugacggugucaaacuggaaucuaugggcguguaccagaucuuagcuaucuauucaacagucgccaguagccuggugcuacucguuucccugggggcaauuucuuuuuggaugugcucgaacggaagccuucaguguagaaucugcauuuga

SEQ ID NO: 123221 - RNA, 1698 nt, Artificial Sequence; identical to SEQ ID NO: 123220
  derived and/or modified sequence opt3 from hemagglutinin__InfluenzaA__ABI21211

SEQ ID NO: 123222 - RNA, 1698 nt, Artificial Sequence
  derived and/or modified sequence opt3 from hemagglutinin__InfluenzaA__ABI21233
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucaauucugugucgucauucgaaagguuugagauuuucccuaaggagagcaguuggccaaaccauacagucaccgguguguccgccucuugcagccacaaugggaaguccucauuuuaccggaacuuacuguggcuuacgggcaaaaauggauuguaucccaaccugaguaagagcuacgcaaauaacaaagaaaaggaggugcuaguucucuggggcgugcaucacccuccaaacaucggggaucagcgcgcccuguaccacacugaaaaugcuuaugucucugugguguccucacauuacagccgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucaguagaggguucggaucuggcaucauaaccuccaaugcacccauggacgaaugugaugccaagugccagacaccucaaggugcuauuaacagcucgcugccauuucagaauguucaccccgugaccaucggggaguguccuaaauauguaaggucugccaaguuacggauggugacgggacugcgcaacauuccauccauccagucacgaggccucuucggcgcaaucgcuggguuuauugaaggagguuggacuggcauggucgacgggugguacggauaucaucaccagaaugagcaaggcagugguuacgccgcggaucagaaaagcacacagaacgccauaaaugggaucaccaacaagguaaauuccguuauugaaaagaugaacacucaguucacagcagugggcaaagaguucaauaaacuugagagaaggauggaaaaccugaacaagaaggucgacgauggauuuuuggacaucuggaccuacaaugcugagcuacuggugcuccuggaaaacgagcggacgcuugacuuccacgauucuaauguuaaaaaccuguaugaaaagguaaaaagccaauugaagaauaacgccaaagagauaggcaaugggugcuuugaguucuaccauaaguguaacgacgaaugcauggagucagugaagaauggaaccuaugauuaccccaaauauagugaagaguccaagcucaaccgugagcgcauugacggugucaaacuggaaagcaugggcguguaccagaucuuagcuaucuauucuacagucgccucaagucuggugcuacucguuagccugggggcaauuuccuuuuggaugugcucuaauggaucgcuucaguguagaaucugcauuuga

SEQ ID NO: 123223 - RNA, 1701 nt, Artificial Sequence
  derived and/or modified sequence opt3 from hemagglutinin__InfluenzaA__ABI21244
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucugaaguuuauaaacgaggacuucaauuggacagguguugcucaggaugggaaguccuaugcaugcaaacgaggaucugugaacagcuuuuucucccgucucaauugguuacacaagcuggaauacaaauauccagcccuuaacgucaccaugcccaauaacggcaaguuugacaaauuguacaucuggggcgugcaucacccuucaacggauagugaccaaacuagccuguacguaagagcuucugggaggguuaccguguccacaaagcggucacagcagacugucauuccaaauaucggaagccgccccugggugagaggucuaaguucuaggauuuccaucuauuggaccauagugaagccuggcgacauucuccugaucaacagcacagggaaccuuauugccccacggggauacuucaaaauccgcucgggcaagucuuccaucaugcgaucagaugcgccgauugguaauuguaguagcgagugcauaacccccaacggguccaucccuaaugacaaaccauuucagaacgucaauagaauuacguauggagcaugucccagguacguuaagcaaaacacucugaaauuggccacaggcaugcggaaugugccugagaagcagacccguggcaucuucggggcuauagccggauuuauugaaaacgguugggagggcaugguagaugggugguauggauuccgccaccaaaauucugaaggcacuggucaggcagcugaccucaaaagcacacaggccgcgaucgaucagaucaacgggaagcugaauagauuaauugagaagaccaacgagaaauuucaucagaucgaaaaggaguucucagaaguggagggcaggauucaagaccuggaaaaauacgucgaggauacgaagauagaccucuggaguuauaaugccgagcuucugguggcauuggaaaaccagcacaccaucgaucuaacagacuccgagaugaauaaacuguucgaacggacucgaaagcagcuccgcgagaacgcugaagauaugggaaacggcugcuuuaagauuuaccauaaaugugacaaugccugcaucgggagcaucagaaacggaaccuacgaccacgauguuuauagggacgaggcucugaauaaccgguuccagauuaaggguguggagcuuaaaucuggcuacaaggauuggauacuguggaucucauuugccauuaguugcuucuugcucugugucgugcuguuaggguuuaucaugugggcaugccaaaaaggaaauauucgcuguaacaucugcauauga

SEQ ID NO: 123224 - RNA, 1701 nt, Artificial Sequence; identical to SEQ ID NO: 123069
  derived and/or modified sequence opt3 from hemagglutinin__InfluenzaA__ABI21255

SEQ ID NO: 123225 - RNA, 1701 nt, Artificial Sequence; identical to SEQ ID NO: 123069
  derived and/or modified sequence opt3 from hemagglutinin__InfluenzaA__ABI21266

SEQ ID NO: 123226 - RNA, 1701 nt, Artificial Sequence; identical to SEQ ID NO: 123069
  derived and/or modified sequence opt3 from hemagglutinin__InfluenzaA__ABI21277

SEQ ID NO: 123227 - RNA, 1701 nt, Artificial Sequence
  derived and/or modified sequence opt3 from hemagglutinin__InfluenzaA__ABI21299
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacgacaaauuugauaaguuguacaucuggggcgugcaucacccuucaacggacagugaccaaacuagccuguacguaagagcuucuggcaggguuaccguguccacaaaacggucacagcagacugucauuccaaauaucgggagccgccccugggugagaggacuaaguucuaggauuuccaucuauuggaccauagugaagccuggugauauucuccugaucaacagcacaggcaaccuuauugccccacggggguacuucaagauccgcaauggaaaaucgucuaucaugcgauccgacgcgccgauuggcaacuguucaagugagugcauaacccccaaugguagcaucccuaacgauaagccauuucagaaugucaacagaauuacguauggggcaugucccagguacguuaaacaaaauacucugaaguuggccacaggaaugcggaacgugccugaaaaacagacccguggcaucuucggcgcuauagccggguuuauugagaauggaugggaagguaugguagacggcugguauggguuccgccaccagaacuccgagggaacuggccaggcagcugaucucaagucuacacaagccgcgaucgaccagaucaaugguaaacugaacagauuaauugagaagaccaaugaaaaguuucaucagaucgagaaagaguucagcgaaguggaagggaggauucaagaucuggagaaguacgucgaggacacgaaaauagaucucuggucauauaacgccgaacuucugguggcauuggagaaucagcacaccaucgaccuaacagauagugaaaugaacaagcuguucgagcggacucgaaaacagcuccgcgaaaacgcugaggacaugggcaauggaugcuuuaagauuuaccauaagugugacaacgccugcaucggcuccaucagaaaugggaccuacgaucacgacguuuauagggaugaggcucugaacaaucgguuccagauuaaaggaguggaacuuaagagcgguuacaaagacuggauacuguggaucucuuuugccauuucaugcuucuugcucugugucgugcuguuaggcuuuaucaugugggcaugccaaaaggggaacauucgcuguaauaucugcauauga

SEQ ID NO: 123228 - RNA, 1701 nt, Artificial Sequence; identical to SEQ ID NO: 123069
  derived and/or modified sequence opt3 from hemagglutinin__InfluenzaA__ABI21310

SEQ ID NO: 123229 - RNA, 1701 nt, Artificial Sequence
  derived and/or modified sequence opt3 from hemagglutinin__InfluenzaA__ABI21321
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggaagccgccccugggugagaggucuaaguucuaggauuuccaucuauuggaccauagugaagccuggcgacauucuccugaucaacagcacagggaaccuuauugccccacggggauacuucaagauccgcaauggcaaaucgucuaucaugcgauccgaugcgccgauugguaacuguucaagugagugcauaacccccaaugggagcaucccuaacgacaagccauuucagaaugucaacagaauuacguauggagcaugucccagguacguuaaacaaaauacucugaaguuggccacaggcaugcggaacgugccugaaaaacagacccguggcaucuucggggcuauagccggauuuauugagaaugguugggaaggcaugguagaugggugguauggauuccgccaccagaacuccgagggcacuggucaggcagcugaccucaagucuacacaagccgcgaucgaucagaucaaugggaaacugaacagauuaauugagaagaccaaugaaaaguuucaucagaucgagaaagaguucagcgaaguggaaggcaggauucaagaccuggagaaguacgucgaggauacgaaaauagaccucuggucauauaacgccgaacuucugguggcauuggagaaucagcacaccaucgaucuaacagacagugaaaugaacaagcuguucgagaaaacucggaagcagcuccgagaaaacgcugaggauaugggaaauggcugcuuuaagauuuaccauaaaugugacaacgccugcaucggguccauccgcaauggaaccuacgaccacgauguuuauagagacgaggcucugaacaauagguuccagauuaaggguguggaacuuaaaagcggcuacaaggauuggauacuguggaucucuuuugccauuucaugcuucuugcucugugucgugcuguuaggguuuaucaugugggcaugccaaaaaggaaacauucgguguaauaucugcauauga

SEQ ID NO: 123230 - RNA, 1701 nt, Artificial Sequence
  derived and/or modified sequence opt3 from hemagglutinin__InfluenzaA__ABI21332
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguacaggcuucugggagaguuaccguguccacaaaaaggucacagcagacugucauuccaaauaucggaagccggcccugggugcgcggucuaaguucuagaauuuccaucuauuggaccauagugaagccuggcgacauucuccugaucaacagcacagggaaccuuauugccccaaggggauacuucaagauccggaauggcaaaucgucuaucaugcgcuccgaugcgccgauugguaacuguucaagugagugcauaacccccaaugggagcaucccuaacgacaagccauuucaaaaugucaaccgaauuacguauggagcaugucccagauacguuaaacagaauacucugaaguuggccacaggcaugaggaacgugccugaaaaacagacccggggcaucuucggggcuauagccggauuuauugagaaugguugggaaggcaugguagaugggugguauggauuccgucaccagaacuccgagggcacuggucaagcagcugaccucaagucuacacaggccgcgaucgaucagaucaaugggaaacugaaccgcuuaauugagaagaccaaugaaaaguuucaucaaaucgagaaagaguucagcgaaguggaaggcaggauucaggaccuggagaaguacgucgaggauacgaaaauagaccucuggucauauaacgccgaacuucugguggcauuggagaaucagcacaccaucgaucuaacagacagugaaaugaacaagcuguucgagagaacucggaaacagcuccgagaaaacgcugaggauaugggaaauggcugcuuuaagauuuaccauaagugugacaacgccugcaucggguccauccgcaauggaaccuacgaccacgauguuuauagagacgaggcucugaacaauagguuccaaauuaaagguguggaacuuaagagcggcuacaaagauuggauacuguggaucucuuuugccauuucaugcuucuugcucugugucgugcuguuaggguuuaucaugugggcaugccagaagggaaacauucgguguaauaucugcauauga

SEQ ID NO: 123231 - RNA, 1701 nt, Artificial Sequence; identical to SEQ ID NO: 123069
  derived and/or modified sequence opt3 from hemagglutinin__InfluenzaA__ABI21343

SEQ ID NO: 123232 - RNA, 1701 nt, Artificial Sequence
  derived and/or modified sequence opt3 from hemagglutinin__InfluenzaA__ABI21354
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcaaaaauuguacccucaucgacgcucugcuuggggauccgcauugcgacggauuucagaacaaggagugggaucuguucguggaacggucuaaagccuauucgaauuguuaccccuaugacgucccugauuacgcaucauugcgcagccucguggccaguuccggcacucuggaguuuauaaacgaagacuucaauuggacagguguugcucaggaugggaagucuuaugcaugcaagcgaggaagcgugaacuccuuuuucucacgucugaauuggcuccacaaauuagaguacaaguauccagcccugaacgucaccaugcccaauaacggcaaauuugacaaguuguacaucuggggcgugcaucacccuaguacggauagcgaccaaacuucuuuguacguaagagcuuccgggaggguuaccgugucaacaaaacggagccagcagacugucauuccaaauaucggaagucgccccugggugagaggucugucuuccaggauuagcaucuauuggaccauagugaagccuggcgacauucuacucaucaacucgacagggaaccugauugccccacggggauacuucaagauccgcaauggcaaaucuuccaucaugcgaucagaugcgccgauugguaacuguaguagcgagugcauaacccccaauggguccaucccuaacgacaagccauuucagaaugucaacagaauuacguauggagcaugucccagguacguuaaacaaaauacucuuaagcuggccacaggcaugcggaacgugccugaaaaacagacccguggcaucuucggggcuauagccggauuuauugagaaugguugggaaggcaugguagaugggugguauggauuccgccaccagaacucugagggcacuggucaggcagcugaccuuaagagcacacaagccgcgaucgaucagaucaaugggaaacucaacagacugauugagaagaccaaugaaaaguuucaucagaucgagaaagaguucucagaaguggaaggcaggauucaagacuuagagaaguacgucgaggauacgaaaauagaccuguggaguuauaacgccgaacuccuuguggcacuggagaaucagcacaccaucgauuugacagacuccgaaaugaacaagcuauucgagcggacucgaaaacagcugcgcgaaaacgcugaggauaugggaaauggcugcuuuaagauuuaccauaagugugacaacgccugcaucgggagcaucagaaauggaaccuacgaccacgauguuuauagggacgaggcucucaacaaucgguuccagauuaaagguguggaacugaagucuggcuacaaagauuggauacuuuggaucucauuugccauuaguugcuuccuguugugugucgugcuccugggguuuaucaugugggcaugccaaaagggaaacauucgcuguaauaucugcauauga

SEQ ID NO: 123233 - RNA, 1701 nt, Artificial Sequence
  derived and/or modified sequence opt3 from hemagglutinin__InfluenzaA__ABI21365
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggaagccgccccugggugagaggucuaaguucuaggauuuccaucuauuggaccauagugaagccuggcgacauucuccugaucaacagcacagggaaccuuauugccccacggggauacuucaagauccgcaauggcaaaucgucuaucaugcgauccgaugcgccgauugguaacuguucaagugagugcauaacccccaaugggagcaucccuaacgacaagccauuucagaaugucaacagaauuacguauggagcaugucccagguacguuaaacaaaauacucugaaguuggccacaggcaugcggaacgugccugaaaaacagacccguggcaucuucggggcuauagccggauuuauugagaaugguugggaaggcaugguagaugggugguauggauuccgccaccagaacuccgagggcacuggucaggcagcugaccucaagucuacacaagccgcgaucgaucagaucaaugggaaacugaacagauuaauugagaagaccaaugaaaaguuucaucagaucgagaaagaguucagcgaaguggaaggcaggauucaagaccuggagaaguacgucgaggauacgaaaauagaccucuggucauauaacgccgaacuucugguggcauuggagaaucagcacaccaucgaucuaacagacagugaaauggauaagcuguucgagcggacucgaaaacagcuccgcgaaaacgcugaggacaugggaaacggcugcuuuaagauuuaccauaagugugacaaugccugcaucggguccaucagaaacggaaccuacgaucacgacguuuauagggaugaggcucugaauaaccgguuccagauuaaagguguggaacuuaagagcggcuacaaagacuggauacuguggaucucuuuugccauuucaugcuucuugcucugugucgugcuguuaggguuuaucaugugggcaugccaaaagggaaauauucgcuguaacaucugcauauga

SEQ ID NO: 123234 - RNA, 1701 nt, Artificial Sequence
  derived and/or modified sequence opt3 from hemagglutinin__InfluenzaA__ABI21376
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuauucuugcaagcgaggaagcgugaacuccuuuuucucacgucucaauugguuacacaaacuggaguacaaguauccagcacuuaacgucaccaugcccaauaacgacaaauuugauaaguuguacaucuggggcgugcaucacccuaguacggacagcgaccaaacuucucuguacguaagagccuccggcaggguuaccgugucaacaaaacggagccagcagacugucauuccaaauaucgggagucgccccugggugagaggacuaucuuccaggauuagcaucuauuggaccauagugaagccuggugauauucuccugaucaacucgacaggcaaccuuauugcuccacggggguacuucaagauccgcaauggaaaaucuuccaucaugcgaucagacgccccgauuggcaacuguaguagcgagugcauaacccccaaugguuccaucccuaacgauaagccauuucagaaugucaacagaauuacguauggggcgugucccagguacguuaaacaaaauacucugaaguuggcaacaggaaugcggaacgugccugaaaaacagacccguggcaucuucggcgccauagcuggguuuauugagaauggaugggaagguaugguagacggcugguauggguuccgccaccagaacucugagggaacuggccaggccgcagaucucaagagcacacaagcugccaucgaccagaucaaugguaaacugaacagauuaauugagaagaccaaugaaaaguuucaucagaucgagaaagaguucucagaaguggaagggaggauucaagaucuggagaaguacgucgaggacacgaaaauagaucucuggaguuauaacgcggaacuucugguggccuuggagaaucagcacaccaucgaccuaacagauuccgaaaugaacaagcuguucgagcggacucgaaaacagcuccgcgaaaacgcagaggacaugggcaauggaugcuuuaagauuuaccauaagugugacaacgcuugcaucggcagcaucagaaaugggaccuacgaucacgacguuuauagggaugaggcccugaacaaucgguuccagauuaaaggaguggaacuuaagucugguuacaaagacuggauacuguggaucucauuugcuauuaguugcuucuugcucugugucgugcuguuaggcuuuaucaugugggccugccaaaaggggaacauucgcuguaauaucugcauauga

SEQ ID NO: 123235 - RNA, 1701 nt, Artificial Sequence; identical to SEQ ID NO: 123069
  derived and/or modified sequence opt3 from hemagglutinin__InfluenzaA__ABI21387

SEQ ID NO: 123236 - RNA, 1701 nt, Artificial Sequence
  derived and/or modified sequence opt3 from hemagglutinin__InfluenzaA__ABI21398
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuguuaacgaagacuucaauuggacagguguggcucaggaugggaaguccuaugcaugcaagcgaggaucugucaacagcuuuuucucccgucucaauugguuacacaaacuggaguacaaguauccagcccuuaacgugaccaugcccaauaacggcaaauuugacaaguuguacauauggggcguacaucacccuucaacggauagugaccaaacuagccuguacguuagagcuucugggagggugaccgucuccacaaaacggucacagcagacugugaucccaaauauuggaagccgccccugggugagaggucuaaguucuaggaucuccauuuauuggaccaucgucaagccuggcgacauacuccugauuaacagcacagggaaccuuaucgccccacggggauacuucaagauucgcaauggcaaaucgucuaucaugcgauccgaugcgccgaucgguaacuguucaagugagugcauuacccccaaugggagcauaccuaacgacaagccauuucagaauguuaacagaaucacguauggagcaugucccagguacgugaaacaaaauacucugaaguuggccacaggcaugcggaacguaccugaaaaacagacccguggcauuuucggggcuaucgccggauuuauagagaaugguugggaaggcaugguggaugggugguauggauuccgccaccagaacuccgagggcacuggucaggcagcugaccucaagucuacacaagccgcgauugaucagaucaaugggaaacugaacagauuaaucgagaagaccaaugaaaaguuucaucagauugagaaagaguucagcgaagucgaaggcaggauccaagaccuggagaaguacguggaggauacgaaaauugaccucuggucauauaacgccgaacuucugguugcauuggagaaucagcacaccauagaucuaacagacagugaaaugaacaagcuguucgagcggacucgaaaacagcuccgcgaaaacgcugaggauaugggaaauggcugcuuuaagaucuaccauaagugugacaacgccugcauuggguccaucagaaauggaaccuacgaccacgauguguauagggacgaggcucugaacaaucgguuccagaucaaaggugucgaacuuaagagcggcuacaaagauuggauucuguggauaucuuuugccaucucaugcuucuugcucugugugguacuguuaggguuuauuaugugggcaugccaaaagggaaacauccgcuguaauauuugcaucuga

SEQ ID NO: 123237 - RNA, 1701 nt, Artificial Sequence; identical to SEQ ID NO: 123069
  derived and/or modified sequence opt3 from hemagglutinin__InfluenzaA__ABI21409

SEQ ID NO: 123238 - RNA, 1701 nt, Artificial Sequence
  derived and/or modified sequence opt3 from hemagglutinin__InfluenzaA__ABI21420
augaagaccaucauugcccugagcuacauacucugccuuguguucacacagaaacugcccggcaacgacaauuccacugcuacguuguguuuagggcaccaugcagucccuaacggaacccugguuaagacaaucacuaaugaucaaauugaggugaccaacgccacagagcuaguacagucuucaaguaccgguagaaucugcgacagcccacacaggauucucgauggcaaaaauuguacucugaucgacgcgcuucugggggauccgcauugcgacggauuucagaacaaggaaugggauuuguucguggaacgguccaaggcuuauucuaauuguuaccccuaugacgucccugauuacgccucgcuccgcucacugguggcaagcaguggcacacuggaguuuauaaacgaagacuucaauuggaccgguguugcccaggaugggggauccuauucuugcaaacgaggcagcgugaacuccuuuuucucacgucucaauugguuacacaagcuggaguacaaauauccagcucuuaacgucacgaugcccaauaacggcaaguuugacaaauuguacaucuggggagugcaucacccuaguacugauagcgaccaaaccucucuguacguaagagcauccgggaggguuacagugucaacuaagcggagccagcagaccgucauuccaaauaucgguagucgccccugggugagaggccuaucuuccaggauuagcaucuauuggacaauagugaaaccuggggacauucuccugaucaacucgaccggaaaccuuauugccccacggggcuacuucaagauccgcaaugguaagucuuccaucaugcgaucagaugcuccgauugggaacuguaguagcgagugcauaacgcccaauggauccaucccuaacgacaaaccauuucagaaugucaacagaauuacuuauggcgccugucccagguacguuaagcaaaauacacugaaauuggcgaccggcaugcggaacgugccugaaaagcagacucgugggaucuucggagcaauagccgguuuuauugagaauggcugggaagggaugguagauggaugguauggcuuccgccaccagaacucugaggguacagggcaggcugccgaccucaaaagcacccaagcagcuaucgaucagaucaauggcaagcugaacagauuaauugagaaaacgaaugaaaaguuucaucagaucgagaaggaguucucagaaguggaaggaaggauucaagaccuggagaaauacgucgaggauaccaagauagaccucuggaguuauaacgccgaacuucugguggcguuggagaaucagcacacaaucgaucuaacugacuccgaaaugaacaaacuguucgagcggacccgaaagcagcuccgcgaaaacgccgaggauaugggcaaugggugcuuuaaaauuuaccauaagugugacaacgcaugcaucggaagcaucagaaaugguacauacgaccacgauguuuauagggacgaggcucugaacaaucgguuccagauuaagucuguggaacuuaaaucaggcuacaaggauuggauacuguggaucaguuuugccauuagcugcuucuugcucugugucgugcuguuaggguuuaucaugugggcuugccaaaaaggaaacauucgcuguaauaucugcauauga

SEQ ID NO: 123239 - RNA, 1701 nt, Artificial Sequence; identical to SEQ ID NO: 123069
  derived and/or modified sequence opt3 from hemagglutinin__InfluenzaA__ABI21431

SEQ ID NO: 123240 - RNA, 1701 nt, Artificial Sequence; identical to SEQ ID NO: 123069
  derived and/or modified sequence opt3 from hemagglutinin__InfluenzaA__ABI21442

SEQ ID NO: 123241 - RNA, 1701 nt, Artificial Sequence; identical to SEQ ID NO: 123069
  derived and/or modified sequence opt3 from hemagglutinin__InfluenzaA__ABI21453

SEQ ID NO: 123242 - RNA, 1701 nt, Artificial Sequence; identical to SEQ ID NO: 123069
  derived and/or modified sequence opt3 from hemagglutinin__InfluenzaA__ABI21464

SEQ ID NO: 123243 - RNA, 1701 nt, Artificial Sequence; identical to SEQ ID NO: 123069
  derived and/or modified sequence opt3 from hemagglutinin__InfluenzaA__ABI21475

SEQ ID NO: 123244 - RNA, 1701 nt, Artificial Sequence
  derived and/or modified sequence opt3 from hemagglutinin__InfluenzaA__ABI21486
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggaagccgccccugggugagaggucuaaguucuaggauuuccaucuauuggaccauagugaagccuggcgacauucuccugaucaacagcacagggaaccuuauugccccacggggauacuucaagauccgcaauggcaaaucgucuaucaugcgauccgaugcgccgauugguaacuguucaagugagugcauaacccccaaugggagcaucccuaacgacaagccauuucagaaugucaacagaauuacguauggagcaugucccagguacguuaaacaaaauacucugaaguuggccacaggcaugcggaacgugccugaaaaacagacccguggcaucuucggggcuauagccggauuuauugagaaugguugggaaggcaugguagaugggugguauggauuccgccaccagaacuccgagggcacuggucaggcagcugaccucaagucuacacaagaggccaucgaucagaucaaugggaaacugaacagauuaauugaaaagaccaaugagaaguuucaucagaucgaaaaagaguucagcgaaguggagggcaggauucaagaccuggagaaguacgucgaagauacgaaaauagaccucuggucauauaacgcggagcuucugguggccuuggaaaaucagcacaccaucgaucuaacagacagugagaugaacaagcuguucgaacggacucgaaaacagcuccgcgagaacgcagaggauaugggaaauggcugcuuuaagauuuaccauaagugugacaacgcuugcaucggguccaucagaaauggaaccuacgaccacgauguuuauagggacgaagcccugaacaaucgguuccagauuaaagguguggagcuuaagagcggcuacaaagauuggauacuguggaucucuuuugcuauuucaugcuucuugcucugugucgugcuguuaggguuuaucaugugggccugccaaaagggaaacauucgcuguaauaucugcauauga

SEQ ID NO: 123245 - RNA, 1701 nt, Artificial Sequence; identical to SEQ ID NO: 123069
  derived and/or modified sequence opt3 from hemagglutinin__InfluenzaA__ABI21497

SEQ ID NO: 123246 - RNA, 1698 nt, Artificial Sequence
  derived and/or modified sequence opt3 from hemagglutinin__InfluenzaA__ABI21530
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucagcgcauccugcucacacaacgggaagaguagcuuuuaccggaaucucuuauggcugacggagaaaaacggacuuuaucccaauuugucuaaguccuacgugaacaauaaagaaaaggaaguacugguucuauggggcgugcaucacccuucaaacaucggcguccagcgcgccauauaccgaacugagaacgcuuaugugagcguggucaguucucacuacucccguagauucaccccagaaaucgcaaaaaggcccaagguucgggaucaggaggggcgcauuaauuauuacuggacacuccuggagccuggagacacuaucauuuuugaagccaacgguaaucuuaucgcuccaugguaugccuucgcgcugagcagaggcuuugagucggggauaauuaccucuaacgcaccgaugaaugaaugugaugccaagugccagacaccccaaggagcuaucaacuccucauugccuuuccagaaugugcauccaguaaccauuggcgagugucccaaauacgugaggagugccaagcuccggauggucacgggucugcgcaacaucccuagcauccagucccgaggguuauuuggagcaauugcuggcuucauagaaggcggguggacuggaaugaucgacgguugguauggcuaccaccaucagaaugagcaagggucuggauacgccgcggaucagaaaagcacacagaacgccauuaauggcaucaccaacaagguaaauucaguuauagagaaaaugaacacucaguuuacagcaguggguaaggaguucaauaaacuggaaagaaggauggaaaaccucaacaagaaggucgacgauggguuccuugacauuuggaccuauaaugcugagcuguuggugcuacuggaaaacgagcggacgcucgauuuucacgacaguaaugugaaaaaccuguacgagaagguuaaaucccaacuuaagaauaacgccaaagaaaucggcaauggaugcuucgaguuuuaucacaaguguaacaaugaaugcauggagagcgugaagaacggcaccuacgacuauccaaaauacucugaggaaucaaagcugaaucgugagaaaaucgauggggucaaguuggaaaguaugggaguguaucagauucucgcuaucuacagcacagucgccuccucucugguguuacugguuucgcuaggugcaauuagcuucuggaugugcuccaacggcucacuccagugucgcauaugcaucuga

SEQ ID NO: 123247 - RNA, 1698 nt, Artificial Sequence
  derived and/or modified sequence opt3 from hemagglutinin__InfluenzaA__ABI21552
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucagcgcauccugcucacacaacgggaagaguagcuuuuaccggaaucucuuauggcugacggagaaaaacggacuuuaucccaauuugucuaaguccuacgugaacaauaaagaaaaggaaguacugguucuauggggcgugcaucacccuucaaacaucggcguccagcgcgccauauaccacacugagaacgcuuaugugagcguggucaguucucauuacucccgacguuucaccccagaaaucgcaaaaagacccaagguuagggaucaggaggggcggauuaauuauuacuggacacuccuggagccuggagacacuaucauuuuugaagccaacgguaaucuuaucgcuccaugguaugccuucgcgcugagccgcggcuuugagucggggauaauuaccucuaacgcaccgauggaugaaugugacgccaagugccagacaccccaaggagcuaucaauuccucauugccuuuccagaacgugcacccaguaaccauuggcgagugucccaaauacgugagaagugccaagcucaggauggucacgggucugcggaauaucccuagcauccagucccgcggguuauuuggagcaauugcuggcuucauagaaggcggguggacuggaaugaucgaugguugguauggcuaccaucaccagaacgagcaagggucuggauacgccgcggaccagaaaagcacacagaaugccauuaacggcaucaccaauaaggugaacucaguuauagagaaaaugaauacucaguuuacagcaguggguaaggaguucaacaaacuggaacgaagaauggaaaaucucaacaagaaggucgaugacggguuccuugauauuuggaccuauaacgcugagcuguuggugcuacuggaaaaugagaggacgcucgacuuucacgacaguaacguuaaaaaucuguacgagaagguaaaaucccaacuuaagaacaaugccaaagaaaucggcaacggaugcuucgaguuuuaucauaaguguaauaacgaaugcauggagagcgugaagaauggcaccuacgauuauccaaaauacucugaggaaucaaagcugaaccgggagaaaaucgacggggucaaguuggaaaguaugggaguguaucagauucucgcuaucuacagcacagucgccuccucucugguguuacugguuucgcuaggugcaauuagcuucuggaugugcuccaauggcucacuccagugucguauaugcaucuga

SEQ ID NO: 123248 - RNA, 1698 nt, Artificial Sequence
  derived and/or modified sequence opt3 from hemagglutinin__InfluenzaA__ABI21563
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucagcgcauccugcucacacaacgggaagaguagcuuuuaccggaaucucuuauggcugacggagaaaaacggacuuuaucccaauuugucuaaguccuacgugaacaauaaagaaaaggaaguacugguucuauggggcgugcaucacccuucaaacaucggcguccagcgcgccauauaccacacugagaacgcuuaugugagcguggucaguucucauuacucccgacguuucaccccagaaaucgcaaaaagacccaagguuagggggcaggagggacggauuaauuauuacuggacacuccuggagccuggugauacuaucauuuuugaagccaacggcaaucuuaucgcuccaugguaugccuucgcgcugagccgcggguuugagucgggaauaauuaccucuaacgcaccgaugaaugaaugugacgccaagugccagacaccccaaggcgcuaucaacuccucauugccuuuccagaaugugcacccaguaaccauuggugagugucccaaauacgugagaagugccaagcucaggauggucacggggcugcggaacaucccuagcauccagucccgcggauuauuuggcgcaauugcuggcuucauagaagggggauggacugguaugaucgauggcugguauggguaccaucaccagaaugagcaaggaucuggcuacgccgcggaccagaaaagcacacagaacgccauuaaugguaucaccaacaagguaaauucaguuauagagaaaaugaacacucaguuuacagcaguggggaaggaguucaauaaacuggaacgaagaauggaaaaccucaacaagaaggucgaugacggcuuccuugauauuuggaccuauaaugcugagcuguuggugcuacuggaaaacgagaggacgcucgacuuucacgauaguaaugugaaaaaccuguacgagaagguuaaaucccaacuuaagaauaacgccaaagaaaucggaaauggcugcuucgaguuuuaucauaaguguaacaaugaaugcauggagagcgugaagaacgggaccuacgacuauccaaaauacucugaggaaucaaagcugaaucgggagaaaaucgacggagucaaguuggaaaguauggguguguaucagauucucgcuaucuacagcacagucgccuccucucugguguuacugguuucgcuaggcgcaauuagcuucuggaugugcuccaacgggucacuccagugucguauaugcaucuga

SEQ ID NO: 123249 - RNA, 1698 nt, Artificial Sequence; identical to SEQ ID NO: 123248
  derived and/or modified sequence opt3 from hemagglutinin__InfluenzaA__ABI21574

SEQ ID NO: 123250 - RNA, 1701 nt, Artificial Sequence
  derived and/or modified sequence opt3 from hemagglutinin__InfluenzaA__ABI21736
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucuacacaagcggccaucaaccagaucaaugguaaacucaaccgucugauugaaaagaccaaugagaaguuucaucagaucgaaaaagaguucucagaaguagaggggcgcauucaggauuuagagaaguauguggaagacacgaaaauagaucuguggaguuacaacgcagagcuccuugucgcucuggaaaaccaacacaccaucgacuugacagauuccgagaugaauaagcuauucgaaagaacuaaaaagcagcugagggagaacgccgaggacgugggcaauggauguuuuaagauuuaucauaaaugcgauaacgcuugcaucggcagcauccggaaugggaccuacgaccacgauguuuaccgagacgaagcccucaacaaucgcuuccagauuaagggaguggagcugaaaucugguuauaaggacuggauacuuuggaucucauuugcaauuaguuguuuccuguugugcgucgugcuccugggcuuuaucaugugggccugucagaaagggaacauuagaugcaauaucuguauauga

SEQ ID NO: 123251 - RNA, 1701 nt, Artificial Sequence
  derived and/or modified sequence opt3 from hemagglutinin__InfluenzaA__ABI22159
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaugccuauucuaacuguuaccccuaugacgucccugauuacgcaucguugaggucacucguggccagcaguggcacucuggaauuuaauaacgaguccuucaauuggacagguguuacccagaacgggacgucuagcgcuugcaaacggcgcuccaauaacucauuuuucagucgacugaauuggcucacucauuuaaaguuuaaguauccagcacugaacgugaccaugcccaacaaugagaaauucgacaaguuguacaucuggggaguccaccauccuggcacagauaacgaccagauuuuucuuuaugcccaggcuagcggccguaucacugugucuaccaaaagaucccaacagacaguaauuccaaauaucgggucaaggccccggguucgcaacauaccuagcagaauuaguaucuacuggaccauugugaagccaggagauauccugcuaaucaauucuacggguaaccucauugccccgaggggcuacuucaaaauacgguccggaaagagcucgaucaugcgcucugacgcgcccauugggaaguguaauuccgaaugcaucacuccuaacggcucaauaccaaaugacaaacccuuucagaacgucaaucgaauuacauauggugcauguccuagauacgugaagcagaacacccugaaacuugccacugggaugaggaaugugccagagaagcaaacacggggaaucuucggcgcuaucgccggcuuuauugaaaacgggugggagggaauggucgaugguugguauggcuuccgucaccagaauagugaggggaucggacaggcagcugaccugaaaagcacccaagccgcgauuaaccagauaaacggcaaguugaaucgccucaucgguaaaacgaacgaaaaguuccaccagauugagaaggaauuuuccgagguugaagggagaauccaggaucuggagaaauacguggaggacaccaagaucgauuuauggucuuauaaugccgaacugcucguagcacuugagaaccaacauacaauugaccugacugauagcgaaaugaauaaauuguucgagaggaccaagaaacagcuacgggaaaacgcugaggacaugggcaauggaugcuuuaagauauaccacaagugugauaacgccugcaucggcucaauucgaaaugggacauaugaccaugauguguaccgcgacgaggcucugaacaauagauuccagaucaaaggagucgaacucaagagugguuacaaagacuggauucuguggaucuccuuugccauaagcugcuuccuucuguguguggcauugcucggcuuuaucaugugggccugccagaaggggaacauuagguguaauaucugcauuuga

SEQ ID NO: 123252 - RNA, 1707 nt, Artificial Sequence
  derived and/or modified sequence opt3 from hemagglutinin__InfluenzaA__ABI23979
auggagaagaucgugcugcuccuugccauuauaagccuggucaaauccgaccagaucugcauuggcuaccacgcuaacaauucuaccgaacaaguugauacaaucauggagaagaacgugacuguaacgcaugcacaggacauuuuggaaaagacccacaaugggaaauuaugugaucuggacggagugaaaccccuaauccucagagauugcucagucgccgguuggcugcuuggcaacccuaugugugacgaguuccugaaugugccagaauggaguuauauaguugagaagaucaacccggcgaaugauuugugcuaccccgggaacuuuaaugacuaugaggaacucaagcaucugcugagcaggauuaaccacuucgagaaaauccagauuaucccuaaguccucuuggucggaucaugaagcuaguagcggagugaguuccgccuguccauaccagggccggucuagcuuuuuccgcaaugucguguggcucauuaaaaaggacaacgcauaucccacaauaaaacgauccuacaauaacacuaaucaagaggauuuacugguacuuugggguauccaccacccuaacgacgccgcugagcagacccguuuguaucagaacccaacaaccuacauuucaguugggacuucaacacugaaucagaggcuagugcccaagaucgcaaccagaagcaaggucaacggacaaucuggccggauggaauuuuucuggacgauccucaaaccuaaugaugccauuaacuuugaguccaauggcaacuucauagcuccagaaaaugccuacaagaucgugaaaaagggggacucaacuauuaugaaaagcgagcuggaauauggaaacugcaauaccaagugucagacaccgaucggugcgauaaacaguucuaugcccuuucauaauauucacccucuuacuaucggcgagugcccaaaauacgugaaguccaaccgccuggucuuggcaaccgggcucagaaauagcccccagggagagaggcggcgcaagaaacgaggccuguucggugccaucgcuggguuuauugaaggaggcuggcagggcaugguugacgggugguauggauaccaucacucgaacgagcaagguucuggcuaugccgcagauaaggaauccacacagaaagcuaucgacggggugaccaauaagguaaacucaauuauagauaaaaugaacacgcaguucgaggccgugggaagagaauuuaauaacuuagagaggcggaucgagaaucugaacaagaagauggaagacggcuuccucgaugucuggacuuacaaugcggagcuucugguguugauggaaaacgagcguacacuagacuuccacgauaguaauguuaaaaaccuguaugacaaggugcgccuccaacugagagauaaugccaaagaacuugguaacggguguuuugaguucuaccauaggugcgacaaugaguguauggaaagcguccggaacggcaccuacgauuauccucaguacuccgaggaaucucgacugaagcgcgaggagauuagcggagugaaauuggaaucaaucggcacuuaucagauccucaguauuuacuccacaguagcaagcucucuggcuuuagccauaaugguugcugggcugucacuauggaugugcaguaauggaagccuccagugcagaaucuguauuuga

SEQ ID NO: 123253 - RNA, 1701 nt, Artificial Sequence; identical to SEQ ID NO: 122298
  derived and/or modified sequence opt3 from hemagglutinin__InfluenzaA__ABI26646

SEQ ID NO: 123254 - RNA, 1701 nt, Artificial Sequence; identical to SEQ ID NO: 122927
  derived and/or modified sequence opt3 from hemagglutinin__InfluenzaA__ABI30367

SEQ ID NO: 123255 - RNA, 1701 nt, Artificial Sequence; identical to SEQ ID NO: 122937
  derived and/or modified sequence opt3 from hemagglutinin__InfluenzaA__ABI30378

SEQ ID NO: 123256 - RNA, 1701 nt, Artificial Sequence; identical to SEQ ID NO: 122666
  derived and/or modified sequence opt3 from hemagglutinin__InfluenzaA__ABI30400

SEQ ID NO: 123257 - RNA, 1701 nt, Artificial Sequence
  derived and/or modified sequence opt3 from hemagglutinin__InfluenzaA__ABI30411
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucuacacaagcggccaucaaccagaucaaugguaaacucaaccgucugauugaaaagaccaaugagaaguuucaucagaucgaaaaagaguucucagaaguagaggggcgcauucaggauuuagagaaguauguggaagacacgaaaauagaucuguggaguuacaacgcagagcuccuugucgcucuggaaaaccaacacaccaucgacuugacagauuccgagauggacaagcuauucgaaagaacuaaaaagcagcugagggagaaugccgaggauaugggcaacggauguuuuaagauuuaucauaaaugcgacaaugcuugcaucggcagcauccggaacgggaccuacgaucacgacguguaccgagacgaagcccucaauaaccgcuuccagauuaagggaguugagcugaaaucugguuauaaggauuggauacuuuggaucucauuugcaauuaguuguuuccuguugugcgugguccuccugggcuuuaucaugugggccugucagaaagggaauauuagaugcaacaucuguauauga

SEQ ID NO: 123258 - RNA, 1701 nt, Artificial Sequence; identical to SEQ ID NO: 122607
  derived and/or modified sequence opt3 from hemagglutinin__InfluenzaA__ABI30422

SEQ ID NO: 123259 - RNA, 1701 nt, Artificial Sequence; identical to SEQ ID NO: 122298
  derived and/or modified sequence opt3 from hemagglutinin__InfluenzaA__ABI30433

SEQ ID NO: 123260 - RNA, 1701 nt, Artificial Sequence; identical to SEQ ID NO: 122607
  derived and/or modified sequence opt3 from hemagglutinin__InfluenzaA__ABI30444

SEQ ID NO: 123261 - RNA, 1701 nt, Artificial Sequence; identical to SEQ ID NO: 122298
  derived and/or modified sequence opt3 from hemagglutinin__InfluenzaA__ABI30455

SEQ ID NO: 123262 - RNA, 1701 nt, Artificial Sequence; identical to SEQ ID NO: 122298
  derived and/or modified sequence opt3 from hemagglutinin__InfluenzaA__ABI30466

SEQ ID NO: 123263 - RNA, 1701 nt, Artificial Sequence; identical to SEQ ID NO: 122298
  derived and/or modified sequence opt3 from hemagglutinin__InfluenzaA__ABI30477

SEQ ID NO: 123264 - RNA, 1701 nt, Artificial Sequence; identical to SEQ ID NO: 122298
  derived and/or modified sequence opt3 from hemagglutinin__InfluenzaA__ABI30488

SEQ ID NO: 123265 - RNA, 1701 nt, Artificial Sequence; identical to SEQ ID NO: 122298
  derived and/or modified sequence opt3 from hemagglutinin__InfluenzaA__ABI30499

SEQ ID NO: 123266 - RNA, 1701 nt, Artificial Sequence; identical to SEQ ID NO: 122259
  derived and/or modified sequence opt3 from hemagglutinin__InfluenzaA__ABI30510

SEQ ID NO: 123267 - RNA, 1701 nt, Artificial Sequence
  derived and/or modified sequence opt3 from hemagglutinin__InfluenzaA__ABI30521
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacaaauaacgaucagauuagcuuguaugcccaggcuucugggcguaucacuguguccaccaagagaucacaacagacaguaauuccaaauaucggaagcaggccccggguucgcgacauaccuaguagaauuucuaucuacuggaccauugugaaaccaggugauauccugcuaaucaacuccacgggcaaucucauugccccgaggggguacuuuaagauacggagcggaaagucgucuaucaugcgcuccgacgcgucaauuggcaaauguaacagugagugcaucacucccaaugguagcauaccuaacgacaagccauuccagaaugucaaccgaauuacauauggggcaugucccagauacgugaaacagaauacccugaaacuugccacuggaaugaggaacgugccugaaaagcaaacacggggcaucuuuggcgcuaucgccggguucauugagaauggaugggaagguauggucgauggcugguauggguuucgucaccagaacuccgagggaaucggccaggcagcugaccugaagucuacccaagccgcgauuaaucagauaaacgguaaauugaaccgccucaucgggaagacgaaugagaaguuccaccagauugaaaaagaguucagcgaaguugagggcagaauccaggaucuggaaaaguacguggaggacaccaaaaucgauuuauggucauauaacgccgagcugcucguagcacuugaaaaucaacauacaauugaccugacugauagugagaugaacaaguuguuugaaaggaccaaaaagcagcuacgggagaaugcugaagacaugggaaacggcugcuucaagauauaccacaaaugugauaaugccugcaucggguccauucgaaacggaacauaugaccaugauguguaccgcgacgaggcucugaauaacagauuucagaucaagggugucgagcucaaaagcggcuacaaggacuggauucuguggaucucuuucgccauaucaugcuuucuucuguguguggcauugcucggguucaucaugugggccugccagaaaggaaauauuagguguaacaucugcauuuga

SEQ ID NO: 123268 - RNA, 1701 nt, Artificial Sequence; identical to SEQ ID NO: 122298
  derived and/or modified sequence opt3 from hemagglutinin__InfluenzaA__ABI30532

SEQ ID NO: 123269 - RNA, 1701 nt, Artificial Sequence; identical to SEQ ID NO: 123129
  derived and/or modified sequence opt3 from hemagglutinin__InfluenzaA__ABI30543

SEQ ID NO: 123270 - RNA, 1701 nt, Artificial Sequence; identical to SEQ ID NO: 122298
  derived and/or modified sequence opt3 from hemagglutinin__InfluenzaA__ABI30554

SEQ ID NO: 123271 - RNA, 1698 nt, Artificial Sequence; identical to SEQ ID NO: 123220
  derived and/or modified sequence opt3 from hemagglutinin__InfluenzaA__ABI30565

SEQ ID NO: 123272 - RNA, 1701 nt, Artificial Sequence; identical to SEQ ID NO: 122649
  derived and/or modified sequence opt3 from hemagglutinin__InfluenzaA__ABI30587

SEQ ID NO: 123273 - RNA, 1701 nt, Artificial Sequence
  derived and/or modified sequence opt3 from hemagglutinin__InfluenzaA__ABI30609
augaagaccaucauugcccugagcuacauacucugccuuguguucgcucagaaacugcccggcaacgacaauuccacagcaacuuuguguuuagggcaccaugccgucccuaacggaacgaucguuaagaccauuaugaaugaucaaaucgaggugacaaacgcgacugaacugguacagucuucaaguaccgguggcauuugcgacagcccacaccagauccuagauggggagaauuguacacucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacccuggaguuuaacaaugaauccuucaacuggacugggguuacacagaauggaaccucuagcgcuugcaagcggcgcuccaacaauucauuuuucagucgacugaacuggcucacgcauuuaaaguuuaaauauccagcacugaaugugacuaugcccaacaacgagaaguucgacaaacuuuacaucuggggcguccaccauccuggcaccgauaaugaccagaucuuuuuguaugcccaggcuagcgggcguauuacagugucuacuaagagaucccaacagaccguaauuccaaacaucggaucaaggccccggguucgcaauauaccuagcagaauuaguaucuacuggacaauugugaaaccaggugauauccugcuaaucaacucuaccggcaaucucauugccccgaggggguacuucaagauacgguccggaaagagcucgaucaugcgcucugacgcgcccauuggcaaauguaacuccgagugcaucacgccuaaugguucaauaccaaacgacaagcccuuucagaaugucaaccgaauuacuuauggggcauguccuagauacgugaaacagaauacacugaagcuggccaccggaaugaggaacgugccagaaaaacaaacucggggcaucuucggcgcuaucgccggguuuauugagaauggaugggaagguauggucgauggcugguauggguuccgucaccagaacagugagggaacaggccaggcagcugaccuuaagagcacccaagccgcgaucaaucagauuaacgguaaauugaaccgccucauagggaagacgaaugagaaguuccaccagaucgaaaaagaguuuuccgaaguugagggcaggauucaggaucuggaaaaguacguggaggacaccaaaaucgauuuauggucuuauaacgccgagcugcucguagcacuugaaaaucaacauacaaucgaccugacugauagcgagaugaacaaguuguucgaaagaaccaaaaagcagcuacgggagaaugcugaagacaugggaaacggcugcuuuaagauuuaccacaaaugugauaaugccugcauagggucaauccgaaacggaacauaugaccaugauguguaccgcgacgaggcucugaauaacagauuccagauuaagggugucgagcucaaaaguggcuacaaggacuggauccuguggauuuccuuugccaucagcugcuuccuucuguguguggcauugcucggguuuauaaugugggccugccagaaaggaaauaucagguguaacauuugcaucuga

SEQ ID NO: 123274 - RNA, 1701 nt, Artificial Sequence
  derived and/or modified sequence opt3 from hemagglutinin__InfluenzaA__ABI30620
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucaucgaaagauccaaagccuauucuaauuguuaccccuaugacgugccugauuacgcaucguugaggucacucgucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagauaaugaccagaucagcuuguaugcccaggcuucugggcguauuacugucuccaccaagagaucacaacagacagugaucccaaacauaggaagcaggccccggguacgcgauauuccuaguagaaucucuauuuacuggaccaucguuaaaccaggugacauccugcuaauuaauuccacgggcaaccucauagccccgaggggguacuuuaagauccggagcggaaagucgucuauuaugcgcuccgacgcgcccaucggcaaauguaauucagagugcauaacuccuaacgguaguauuccaaaugauaagcccuuccagaacgugaaucgaaucacauauggggcauguccuagauacgucaaacagaacacccugaaacuugccacuggaaugaggaaugugccagaaaagcaaacacggggcaucuuuggcgcuauugccggguucaucgagaacggaugggaagguaugguggacggcugguauggguuucgucaccagaauagcgagggaauuggccaggcagcugaucugaaguccacccaagccgcgauaaaccagaucaaugguaaauugaaccgccucauugggaagacgaacgagaaguuccaccagaucgaaaaagaguucucugaagucgagggcagaauccaggaccuggaaaaguacguugaggauaccaaaguggacuuauggagcuauaaugccgagcugcucguagcacuugaaaaccaacauacaauugaucugacugacucagagaugaauaaguuguuugaaaggaccaaaaagcagcuacgggagaacgcugaagauaugggaaauggcugcuucaagauauaccacaaaugugacaacgccugcaucgggaguauucgaaauggaacauaugaucaugacguguaccgcgacgaggcucugaacaauagauuucagaucaagggugucgagcucaaauccggcuacaaggauuggauucuguggaucagcuucgccauaucuugcuuucuucuguguguggcauugcucggguucaucaugugggccugccagaaaggaaacauuagguguaauaucugcauuuga

SEQ ID NO: 123275 - RNA, 1701 nt, Artificial Sequence; identical to SEQ ID NO: 122649
  derived and/or modified sequence opt3 from hemagglutinin__InfluenzaA__ABI30733

SEQ ID NO: 123276 - RNA, 1701 nt, Artificial Sequence; identical to SEQ ID NO: 122649
  derived and/or modified sequence opt3 from hemagglutinin__InfluenzaA__ABI30744

SEQ ID NO: 123277 - RNA, 1701 nt, Artificial Sequence; identical to SEQ ID NO: 122649
  derived and/or modified sequence opt3 from hemagglutinin__InfluenzaA__ABI30755

SEQ ID NO: 123278 - RNA, 1701 nt, Artificial Sequence; identical to SEQ ID NO: 122649
  derived and/or modified sequence opt3 from hemagglutinin__InfluenzaA__ABI30766

SEQ ID NO: 123279 - RNA, 1701 nt, Artificial Sequence; identical to SEQ ID NO: 122649
  derived and/or modified sequence opt3 from hemagglutinin__InfluenzaA__ABI30777

SEQ ID NO: 123280 - RNA, 1701 nt, Artificial Sequence
  derived and/or modified sequence opt3 from hemagglutinin__InfluenzaA__ABI30788
augaagaccaucauugcccugagcuacauacucugccuuguguucgcucagaaacuguccggcaacgacaauucuacagcaacuuuguguuuagggcaccaugccguccccaacggaacgaucguuaagaccauuacaaaugaucaaaucgaggugacuaacgcgaccgaacugguacagucaaguagcacagguggcauuugcgacuccccucaccagauccuagauggggagaauuguacccucauagacgcucugcuuggagauccacagugcgacggcuuucaaaacaaaaagugggaucuguucguggaaagaucuaaagccuauucgaauuguuacccguaugacguccccgauuacgcaucauugaggagccucaucgccaguuccgguacucuggaguuuaacaaugaaucuuucaacuggacaggggugacccagaauggaacgagcuccgcuugcaagcggcgcucaaacaguagcuuuuucucucgacugaauuggcucacucauuuaaaguuuaaauauccugcacugaacguuaccaugccaaauaacgaggaguucgacaaacuuuacauuuggggcgugcaccaucccggcacauauaacgaucagaucuccuuguacgcccaggcuucagggcguauuacugucagcaccaagagaagucaacagacagugaucccuaauauaggaucuaggccacggguacgcgacauucccuccagaaucagcauuuacuggaccaucguuaagccuggugauauccugcuaauuaacucgacgggcaaucucauagccccaaggggguauuuuaaaauccggucuggaaaguccucaauuaugcgcagugacgcgccgaucggcaaguguaacagcgaaugcauaacucccaaugguuccauuccuaacgacaaaccauuccagaaugugaaccgaaucacauacggggcaugucccagauaugucaagcagaauacccugaaacuugccacuggaaugaggaacgugccugagaagcaaacacggggcaucuuuggcgcuauugccggguucaucgaaaauggaugggaggguaugguggauggcugguacggguuucgucaccagaacucugagggaauuggccaggcagcugaccugaaaagcacccaagccgcgauagaucagaucaaugguaaguugaaccgccucauugggaaaacgaaugaaaaguuccaccagaucgagaaggaguucucagaagucgaaggcagaauccaggaccuggagaaauauguugaggauaccaagauugacuuauggaguuacaacgccgaacugcucguggcacuugagaaccaacauacaauagaucugacugacuccgaaaugaauaaauuguuugagaggaccaagaaacagcuacgggaaaacgcugaggauaugggaaauggcugcuucaagaucuaucacaagugugacaacgccugcauugggagcauccgaaauggaacauacgaucaugacguauaccgcgacgaggcucugaacaauagauuucagauuaaagguguggaacucaagucuggcuauaaagauuggauccuguggauaucauucgccaucaguugcuuucuucugugugucgcauugcucggguucauuaugugggccugccagaagggaaacaucagguguaauauuugcaucuga

SEQ ID NO: 123281 - RNA, 1701 nt, Artificial Sequence; identical to SEQ ID NO: 122649
  derived and/or modified sequence opt3 from hemagglutinin__InfluenzaA__ABI30799

SEQ ID NO: 123282 - RNA, 1701 nt, Artificial Sequence
  derived and/or modified sequence opt3 from hemagglutinin__InfluenzaA__ABI30810
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggguacgcgacauuccuucuagaaucuccauuuacuggaccaucguuaagccaggugauauccugcuaauuaacagcacgggcaaucucauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccugaaacuugccacuggaaugaggaacgugccagagaagcaaacacggggcaucuuuggcgcuauugccggguucaucgaaaauggaugggaggguaugguggauggcugguacggguuucgucaccagaacuccgagggaauuggccaggcagcugaccugaaaucuacccaagccgcgauagaucagaucaaugguaaguugaaccgccucauugggaaaacgaaugaaaaguuccaccagaucgagaaggaauuuagcgaggucgaaggcagaauccaggaccuggagaaauauguugaggauaccaagauugacuuauggucauacaacgccgaacugcucguggcacuugagaaccaacauacaauagaucugacugacagugaaaugaauaaauuguuugagaggaccaagaaacagcuacgggaaaacgcugaggauaugggaaauggcugcuucaagaucuaucacaagugugacaacgccugcauuggguccaucaaaaauggaacauacgaucaugacguauaccgagacgaggcucugaacaaucgcuuucagauuaaggguguggaacucaaaagcggcuauaaggauuggauccuguggauaucuuucgccaucucaugcuuucuucugugugucgcauugcucggguucauuaugugggccugccagaaaggaaacaucagauguaauauuugcaucuga

SEQ ID NO: 123283 - RNA, 1701 nt, Artificial Sequence
  derived and/or modified sequence opt3 from hemagglutinin__InfluenzaA__ABI30821
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguugccaugcccaauaacgaggaguucgacaaacuuuacauuuggggcgugcaccauccuggcaccuauaacgaucagaucucuuuguacgcucaggccuccgggcguauuacagucucaacuaagagaagccaacagaccgugaucccaaauauaggaaguaggccccggguacgcgacauuccuucuagaaucuccauuuacuggacaaucguuaagccaggugauauccugcuaauuaacagcaccggcaaucucauagcgccgaggggguauuuuaaaauccggucgggaaagucuuccauuaugcgcucagacgcacccaucggcaaguguaacagugaaugcauaacgccuaaugguagcauuccaaacgacaaacccuuccagaaugugaaccgaaucacuuacggggccuguccuagauaugucaagcagaauacacugaaacuugcuaccggaaugaggaacgugccagagaagcaaacucggggcaucuuuggcgccauugcaggguucaucgaaaauggaugggaggguaugguggauggcugguacggguuucgucaccagaacuccgagggaauuggccaggcugccgaccugaaaucuacacaagcggccauagaucagaucaaugguaaguugaaccgccucauugggaaaaccaaugaaaaguuccaccagaucgagaaggaauuuagcgaggucgaaggcagaauccaggaccuggagaaauauguugaggauacgaagauugacuuauggucauacaacgcagaacugcucguggcucuugagaaccaacauaccauagaucugacagacagugaaaugaauaaauuguuugagaggacuaagaaacagcuacgggaaaacgccgaggauaugggaaauggcugcuucaagaucuaucacaagugugacaacgcuugcauuggguccauccgaaauggaaccuacgaucaugacguauaccgcgacgaggcccugaacaauagauuucagauuaaagguguggaacucaagagcggcuauaaagauuggauccuguggauaucuuucgcaaucucaugcuuucuucugugugucgccuugcucggguucauuaugugggcuugccagaagggaaacaucagguguaauauuugcaucuga

SEQ ID NO: 123284 - RNA, 1701 nt, Artificial Sequence; identical to SEQ ID NO: 122649
  derived and/or modified sequence opt3 from hemagglutinin__InfluenzaA__ABI30832

SEQ ID NO: 123285 - RNA, 1701 nt, Artificial Sequence
  derived and/or modified sequence opt3 from hemagglutinin__InfluenzaA__ABI30843
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggguacgcgacauuccuucuagaaucuccauuuacuggaccaucguuaagccaggugauauccugcuaauuaacagcacgggcaaucucauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccugaaacuugccacuggaaugaggaacgugccagagaagcaaacacggggcaucuuuggcgcuauugccggguucaucgaaaauggaugggaggguaugguggauggcugguacggguuucgucaccagaacuccgagggaauuggccaggcagcugaccugaaaucuacccaagccgcgauagaucagaucaaugguaaguugaaccgccucauugggaaaacgaaugaaaaguuccaccagaucgagaaggaauuuagcgaggucgaaggcagaauccaggaccuggagaaauauguugaggauaccaagauugacuuauggucauacaacgccgaacugcucguggcacuugagaaccaacauacaauagaucugacugacagugaaaugaauaaauuguuugagaggacccggaagcagcuacgagaaaacgcugaggauaugggaaauggcugcuucaaaaucuaucacaagugugacaacgccugcauuggguccauccgcaauggaacauacgaucaugacguauacagagacgaggcucugaacaauagguuucagauuaaggguguggaacucaaaagcggcuauaaggauuggauccuguggauaucuuucgccaucucaugcuuucuucugugugucgcauugcucggguucauuaugugggccugccagaaaggaaacauccgguguaauauuugcaucuga

SEQ ID NO: 123286 - RNA, 1701 nt, Artificial Sequence; identical to SEQ ID NO: 123229
  derived and/or modified sequence opt3 from hemagglutinin__InfluenzaA__ABI30865

SEQ ID NO: 123287 - RNA, 1707 nt, Artificial Sequence
  derived and/or modified sequence opt3 from hemagglutinin__InfluenzaA__ABI36155
auggagaagaucgugcugcuccuugccaccgucagccugguuaaauccgaccagauuugcauaggcuaccacgcuaacaauucuacagaacaaguggauacuaucauggagaagaacguaacggugacccaugcacaggacauuuuggaaaagacacacaaugggaaauuaugugaucuggacggagucaaaccccuaauccucagagauugcucaguggccgguuggcugcuuggcaacccuaugugugacgaguucauuaauguuccagaauggaguuauaucguggagaaggcgaacccggcuaaugggcugugcuaccccggaaacuuuaaugauuaugaggaauugaagcaucuccugagcaggauaaaccacuucgagaaacugcagaucauuccuaaguccucuuggucggaccaugaagccucacucggcgucagcagugcauguccauacuuaggucgguccuccuuuuuccgcaaugugguauggcugaucaaaaagaacaauacuuaucccaccauuaaacgaagcuacaacaauacaaaccaggaggaucuuuugguucugugggggauccaccacccuaacgacgccgcugagcaaacccgucuauaucagaauccaacuacauacauauccgugggaaccucaacgcucaaccagagacugguccccaagauugcaacuaggaguaaggugaauggccagagcggccggauggaauuuuucuggaccauccuuaaaccuaacgaugccauuaauuuugagucuaacgggaauuucaucgcuccagaauacgccuauaagaucgugaaaaagggagacuccgcgauuaugaaaucagagcuggaauacggugauugcaacacaaagugucaaacuccgaugggcgcaauaaauagcaguaugcccuugcauaacauccacccucucaccauuggggagugcccaaaauaugucaagucuaaucgccugguuuuagccacaggacugagaaacucuccccagagggagcggcgccgaaagaaaagaggccucuuuggugcuaucgccggguucauagaaggaggcuggcagggcaugguggacgggugguacggauaucaucacagcaaugagcaggguucgggcuacgcagcugacaaggaaucuacccaaaaagccauugaugggguaacgaacaaggucaauuccaucaucgacaaaaugaacacucaguuugaggcggugggaagggaguucaacaaucuugaacggcguauugagaaccugaauaagaagauggaagauggcuuuuuggacguguggacauauaacgccgagcuacugguucucauggaaaaugagcgcacccuggauuuccacgacucaaacgugaaaaaucuuuacgauaaggucagacugcaguugagggacaacgcaaaagaacucgguaauggguguuucgaguuuuaccauaagugcgauaacgaguguauggaaaguauccggaauggcacuuauaacuacccucaauauagcgaggaagcucgacugaaacgcgaggagauuuccggagugaaguuagaaucuauaggcaucuaccagauucugagcaucuauucaacaguagccaguucccuagcucucgccaucaugauggcagggcugagccuuuggaugugcucuaauggaucauugcagugcagaguuuguauuuga

SEQ ID NO: 123288 - RNA, 1707 nt, Artificial Sequence
  derived and/or modified sequence opt3 from hemagglutinin__InfluenzaA__ABI36166
auggagaagaucgugcugcuccuugccaccgucagccugguuaaauccgaccagauuugcauaggcuaccacgcuaacaauucuacagaacaaguggauacuaucauggagaagaacguaacggugacccaugcacaggacauuuuggaaaagacacacaaugggaaauuaugugaucuggacggagucaaaccccuaauccucagagauugcucaguggccgguuggcugcuuggcaacccuaugugugacgaguucauuaauguuccagaauggaguuauaucguggagaaggcgaacccggcuaaugggcugugcuaccccggaaacuuuaaugauuaugaggaauugaagcaucuccugagcaggauaaaccacuucgagaaacugcagaucauuccuaaguccucuuggucggaccaugaagccucacucggcgucagcagugcauguccauacuuaggucgguccuccuuuuuccgcaaugugguauggcugaucaaaaagaacaauacuuaucccaccauuaaacgaagcuacaacaauacaaaccaggaggaucuuuugguucugugggggauccaccacccuaacgacgccgcugagcaaacccgucuauaucagaauccaacuacauacauauccgugggaaccucaacgcucaaccagagacugguccccaagauugcaacuaggaguaaggugaauggccagagcggccggauggaauuuuucuggaccauccuuaaaccuaacgaugccauuaauuuugagucuaacgggaauuucaucgcuccagaauacgccuauaagaucgugaaaaagggagacuccgcgauuaugaaaucagagcuggaauacggugauugcaacacaaagugucaaacuccgaugggcgcaauaaauagcaguaugcccuuucauaacauccacccuuugaccauuggggagugcccaaaauaugucaagucuaaucgccucguucuggccacaggauuaagaaacucuccccagagggagcggcgccgaaagaaaagaggccuguucggugcuaucgccggguuuauagaaggaggcuggcagggcaugguggacgggugguacggauaucaucacagcaaugagcaggguucgggcuacgcagcugacaaggaaucuacccaaaaagccauugaugggguaacgaacaaggucaauuccaucaucgacaaaaugaacacucaguucgaggcggugggaagggaauuuaacaaucucgagcggcguauugagaaccuuaauaagaagauggaagauggcuuccuggacguguggacauauaacgccgaguugcuaguucugauggaaaaugagcgcacccucgauuuccacgacucaaacgugaaaaaucuguacgauaaggucagacuucagcugagggacaacgcaaaagaauuggguaauggguguuuugaguucuaccauaagugcgauaacgaguguauggaaaguauccggaauggcacuuauaacuacccucaauauagcgaggaagcucgacucaaacgcgaggagauuuccggagugaagcuggaaucuauaggcaucuaccagauuuuaagcaucuauucaacaguagccaguucccuggcucuagccaucaugauggcagggcucagccuguggaugugcucuaauggaucacuucagugcagaguuuguauuuga

SEQ ID NO: 123289 - RNA, 1707 nt, Artificial Sequence; identical to SEQ ID NO: 123288
  derived and/or modified sequence opt3 from hemagglutinin__InfluenzaA__ABI36177

SEQ ID NO: 123290 - RNA, 1707 nt, Artificial Sequence
  derived and/or modified sequence opt3 from hemagglutinin__InfluenzaA__ABI36406
auggagaagaucgugcugcuccuugccaccgucagccugguuaaauccgaccagauuugcauaggcuaccacgcuaacaauucuacagaacaaguggauacuaucauggagaagaacguaacggugacccaugcacaggacauuuuggaaaagacacacaaugggaaauuaugugaucuggacggagucaaaccccuaauccucagagauugcucaguggccgguuggcugcuuggcaacccuaugugugacgaguucauuaauguuccagaauggaguuauaucguggagaaggcgaacccggcuaaugggcugugcuaccccggaaacuuuaaugauuaugaggaauugaagcaucuccugagcaggauaaaccacuucgagaaacugcagaucauuccuaaguccucuuggucggaccaugaagccucacucggcgucagcagugcauguccauacuuaggucgguccuccuuuuuccgcaaugugguauggcugaucaaaaagaacaauacuuaucccaccauuaaacgaagcuacaacaauacaaaccaggaggaucuuuugguucugugggggcuacaccacccuaacgacgccgcugagcaaacccgucucuaucagaauccaacuacauacaucuccgugggaaccucaacgcugaaccagagacuuguccccaagauagcaacuaggaguaaggugaauggccagagcggccggauggaauuuuucuggaccauucugaaaccuaacgaugccaucaauuuugagucuaacgggaauuucauugcuccagaauacgccuauaagaucgugaaaaagggagacuccgcgaucaugaaaucagaguuggaauacggugauugcaacacaaagugucaaacuccgaugggcgcaauuaauagcaguaugcccuuucauaacauacacccucucaccaucggggagugcccaaaauaugucaagucuaaucgccugguuuuagccacaggacugagaaacucuccccagagggagcggcgccgaaagaaaagaggccucuucggugcuauugccggguuuaucgaaggaggcuggcagggcaugguggacgggugguacggauaucaucacagcaaugagcaggguucgggcuacgcagcugacaaggaaucuacccaaaaagccauagaugggguaacgaacaaggucaauuccauuaucgacaaaaugaacacucaguucgaggcggugggaagggaauuuaacaaucuugagcggcguaucgagaaccugaauaagaagauggaagauggcuucuuggacguguggacauauaacgccgagcuacugguucucauggaaaaugagcgcacccuggauuuccacgacucaaacgugaaaaaucuuuacgauaaggucagacugcaguugagggacaacgcaaaagaacucgguaauggguguuuugaguucuaccauaagugcgauaacgaguguauggaaaguauucggaauggcacuuauaacuacccucaauauagcgaggaagcucgacugaaacgcgaggagaucuccggagugaaguuagaaucuauuggcauauaccagauccugagcauuuauucaacaguagccaguucccuagcucucgccaucaugauggcagggcugagccuuuggaugugcucuaauggaucauugcagugcagaguuuguaucuga

SEQ ID NO: 123291 - RNA, 1707 nt, Artificial Sequence
  derived and/or modified sequence opt3 from hemagglutinin__InfluenzaA__ABI36450
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggggaaaacccacaauggaaaguuaugugaucuggacggugucaaaccccuaauucucagagauugcucaguggccggcuggcugcuugggaacccuaugugugacgaguucaucaauguuccagaauggaguuauauaguggaaaaggcgaacccgacaaaugaucugugcuaccccggauccuuuaacgacuaugaggaguugaagcaucuccuguccaggaucaaucacuucgagaaaauucagaucauuccuaagucuucguggucagaucaugaagcuagcaguggcgucuccucugccuguccauaccuggguagccccuccuuuuuccggaacgugguauggcucaucaaaaagaacucaacuuauccuaccauaaaaacaaguuacaauaauaccaaccaggaagacuuacugguucuuugggggauucaccacagcaaugaugcagccgagcaaacucgcuuguaucagaacccaacaaccuacaucucuauuggaacguccacucugaaccagcgucuagugcccaagaucgcuacccgaucaaaggucaauggccagagcggcagaauggaguuuuucuggacaauccucaaaccuaacgacgcaauuaauuuugaaaguaacgggaauuucauagccccagaguacgcuuauaagaucgugaaaaagggagauucugccauuaugaaauccgaacuggaguacgguaacugcaauacuaagugucaaaccccgaugggcgcgaucaacagcucgaugcccuuucauaauauacacccucuuacaauuggggaaugcccaaaauaugugaagucuaacaggcuggucuuggcaaccggacuccggaauagcccccagcgcgagucaagaaggaagaaacggggccuguucggugccaucgcuggguuuaucgagggaggcuggcagggcaugguugacgggugguacggauaucaucacaguaacgaacaggguagcggcuacgccgcagacaaggaguccacgcaaaaagcuauugauggggugacuaauaagguaaacucuaucauugacaaaaugaauacacaguucgaagccgugggacgcgaguuuaacaacuuagaacgaagaauagagaaucugaacaagaagauggaggauggcuuccucgacgucuggaccuauaaugcggaacuucugguguugauggagaacgaaaggacucuagauuuccacgacagcaauguuaaaaaccuguacgauaaggugcggcuccagcugcgugacaaugccaaagagcuugguaacggguguuuugaguucuaccauaagugcgauaaugaauguauggagucaauccgcaacggcacauauaauuacccucaauauagugaagaggcaagacugaaaagggaagagauuuccggagucaaguuggagagcaucggcaccuaccagauccucucuauuuauucaacgguggcuaguagccuggccuuagcuauaaugaucgccgggcugucccuauggaugugcucuaacggaucgcuccagugccggauuuguaucuga

SEQ ID NO: 123292 - RNA, 1707 nt, Artificial Sequence
  derived and/or modified sequence opt3 from hemagglutinin__InfluenzaA__ABI49396
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggggaaaacccacaauggaaaguuaugugaucuggacggugucaaaccccuaauucucagagauugcucaguggccggcuggcugcuugggaacccuaugugugacgaguucaucaauguuccagaauggaguuauauaguggaaaaggcgaacccgacaaaugaucugugcuaccccggaucauuuaacgacuaugaggaguugaagcaucuccuguccaggaucaaucacuucgagaaaauucagaucauuccuaagucuucguggucagaucaugaagcuagcaguggcgucuccucugccuguccauaccuggguagccccuccuuuuuccggaacgugguauggcucaucaaaaagaauagcacuuauccuaccauuaaaaagaguuacaacaauacaaaccaggaagacuuacugguucuuugggggauacaccacccaaaugaugcagccgagcaaacccgcuuguaucagaaccccacuacauacaucagcauuggaaccucuacgcugaaccagcggcuagugccuaagaucgcuacucguuccaaagucaauggccagucaggcagaauggaguuuuucugggcaauccucaagccaaacgacgccauuaauuuugaaagcaacgggaauuucauagcuccggaguacgccuauaaaaucgugaagaaaggagauagugcgauuaugaagucugaacuggaguacgguaacugcaauaccaaaugucaaacacccaugggcgcaaucaacuccagcaugccuuuucauaauauacacccacuuacuauuggggaaugccccaaguaugugaagucgaacaggcuggucuuggccaccggacuccgaaauucuccucagcgcgaguccagaaggaaaaagcggggccuguucggugcuaucgccggguuuaucgagggaggcuggcagggcaugguugacgggugguacggauaucaucacucaaacgaacaggguaguggcuacgcagcugacaaagagagcacacaaaaggccauugauggggugaccaauaaaguaaacuccaucauugacaagaugaauacgcaguucgaagcggugggacgcgaguuuaacaacuuagaacgaagaauagagaaucugaacaagaaaauggaggauggcuuccucgacgucuggacuuauaaugccgaacuucugguguugauggagaacgaaaggacacuagauuuccacgacucuaauguuaagaaccuguacgauaaagugcggcuccagcugcgugacaaugcaaaggagcuugguaacggguguuuugaguucuaccauaaaugcgauaaugaauguauggagagcauccgcaacggcaccuauaauuacccacaauauucagaagaggcuagacugaagagggaagagauuaguggagucaaguuggaguccaucggcacuuaccagauccucagcauuuauucuacaguggccucaagucuggcuuuagccauaaugaucgcagggcugagccuauggaugugcuccaacggaucucuccagugccggauuuguaucuga

SEQ ID NO: 123293 - RNA, 1704 nt, Artificial Sequence
  derived and/or modified sequence opt3 from hemagglutinin__InfluenzaA__ABI85000
augaacacccagauccuggccuucauugcuugcaugcucauaggcacaaagggggacaaaaucugucuuggacaccaugcaguggccaaugguacuaaggucaacacgcugaccgagagaggcauugaaguugugaaugcgacagagacuguagaaaccgugaacaucaaaaagauuugcacacaagggaaaaggcccaccgauuugggacaguguggcuuacuggguacucuaaucgggccuccacagugcgaccaguuucucgaguucgaugcuaaucugauaaucgaacggcgcgagggaacagacgucuguuacccgggcaaguuuaccaacgaggaaagccuucgacaaauucugcguggcuccgggggaaucgauaaggagucuauggguuucacguauucaggcauuagaacuaauggggccaccagugcaugcaggcggagcggauccucuuuuuacgccgaaaugaaaugguugcucucgaacucagacaaugcugcauucccccagaugacaaagagcuaucgcaacccuagaaauaaaccagcccugaucauauggggcgugcaccauagugguuccgcuacugagcagaccaagcuguacgggucuggaaacaaacucauuacaguuggcagcuccaaguaucagcaaucauuuacccccaguccuggcgccaggccacaggugaaugggcagagcggacggaucgauuuccacugguuacugcuugaccccaacgauacggucacuuuuacauucaauggugcguuuauugcaccugaccgcgccucuuucuuucgaggcgaguccuugggggugcagucagauguaccacuggacagcggaugugaaggcgauugcuuccauaguggugggaccaucguuucuucccuaccguuccaaaacaucaaccccagaacugugggcaaguguccuagguacgucaaacagacaagccuccugcuugcuaccggaaugcggaaugugccagagaaccccaagcaggccuaucaaaaacguaugacgcgcggccuguuuggggcaauugcuggauucauagaaaaugguugggagggcuugaucgacgggugguacggauuuagacaccagaacgcccagggcgaagguaccgcggccgacuacaagucgacacagucugcaauugaucaaaucacugggaaacucaauaggcugauagacaagaccaaccagcaguucgaguuaauugauaaugaguuuuccgaaaucgagcagcaaaucggcaacgugauuaauuggacacgggacucaaugacugaagucuggaguuauaacgcugagcugcucguugccauggaaaaucagcacaccaucgaucuugcugacagcgagaugaacaaacuguacgagcgagugcgcaagcaguugagagaaaaugccgaggaagauggaacaggcugcuucgagauuuuucauaagugugacgaucagugcauggaauccauaaggaacaauaccuaugaccacacucaauaccggacggagucucuacagaaccgcauccagauugauccuguaaaacugagcucaggguauaaggacaucauccucugguucaguuuuggagcauccugcuuccugcuucuggccauugcuauggguuugguguuuauauguaucaaaaacggcaauaugagaugcacaauuuguaucuga

SEQ ID NO: 123294 - RNA, 1701 nt, Artificial Sequence; identical to SEQ ID NO: 122846
  derived and/or modified sequence opt3 from hemagglutinin__InfluenzaA__ABI92291

SEQ ID NO: 123295 - RNA, 1701 nt, Artificial Sequence
  derived and/or modified sequence opt3 from hemagglutinin__InfluenzaA__ABI92302
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagagcuccuggccuaagcauaacgugacccgcgguguuacugcuucaugcagucacaaagggaaaagcucuuuuuaucgaaaucucuuauggcugacagagaaaaacggauccuacccaaaucuuucaaagagcuaugugaacaauaaggaaaaagaggucuuggugcuguggggcguacaucaccccaguaacaucgaagaccagaagaccauauaccguaaagagaaugcauacguuucuguggucuccagccacuauaacagaagguucacgccugaaaucgccaagcggccaaaagugcgcgaucaggagggcagaauuaacuacuauuggacucuacucgagcccggggacaccaucauuuuugaagcuaauggaaaccugaucgccccuugguacgcguucgcacuuucgagggguuuuggcucugggauaauuacauccaaugccucaauggaugagugugacgcuaagugccagacuccacaaggagccaucaacaguagccugccguuccagaaugugcaucccgucaccauuggcgaauguccuaaauauguucgguccacaaaguugcgcauggugaccggucuccgaaacaucccaucuauccagagcagagggcuguuuggagcaauugcuggcuucauagagggcggguggacgggaaugaucgaugguugguacggcuaucaccaucagaaugaacaagggucaggauacgccgcggaccagaagaguacucagaacgccauuaauggcaucacaaacaaaguaaauuccgugauagagaagaugaacauucaguuuaccgcagucgguaaagaguucaauaaguuagaaaagaggauggagaaccugaauaagaagguggaugacggguuccucgacaucuggacuuacaacgcugaacuucugguuuugcuagagaacgaacggacacuggauuuucacgacagcaaugugaaaaaccucuaugagaaggucaaaucucaacugaagaauaacgccaaagagaucggcaauggaugcuucgaauuuuaccacaaguguaacaaugagugcauggaaucagugaagaacggcaccuaugauuaccccaaauauagugaggagagcaaacuuaaucgugaaaagauugacgggguaaagcuggaguccaugggaguuuaccagaucuuggcuauuuauucuacgguggccucgagccucguccuguuagugucccugggugcaauaucauucuggaugugcaguaacggcucucuacagugucgcaucugcauuuga

SEQ ID NO: 123296 - RNA, 1701 nt, Artificial Sequence
  derived and/or modified sequence opt3 from hemagglutinin__InfluenzaA__ABI92313
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucaauuagcaguuuugaacgguucgagaucuuuccuaaggaguccucuuggccaaaucauacagugaccaaggguguuacggcuagcugcucccacaacgggaaaucaaguuucuacaagaaucugcucugguuaacugaaaagaacggacuguaucccaaucuuagcaagucuuacgugaacaauaaagagaaggaagucuuggugcuguggggcguacaucacccuuccaacauuggcgaucagcgcgcaaucuaccacaccgagaacgccuauguuucaguggucagcagucauuacucucgacguuuuacaccagaaauaacuaagagacccaaagugagggaccaggaggggcggaucaauuauuacuggacccuacucgagccuggagauacaauuaucuucgaagcuaacgguaaucugauugccccaugguaugcguuugcacuuucccgcggcuucgggagcggaaucauaaccucgaacgccucuaugggcgagugugacgcuaagugccagacgccgcaaggugccauuaauuccucacugcccuuucagaacgugcacccugucacuaucggggaauguccaaaauacguuagaaguacaaaguugaggauggugaccggacuccggaauauucccagcauccagucccgcggccuguucggcgcaaucgcuggguuuauugagggagguuggacuggcaugauagaugggugguauggauaccaucaccagaacgaacaaggcucugguuacgccgcggaccagaaaagcacacagaaugccaucgaugggauuaccaacaagguaaauucagugaucgagaaaaugaacacgcaguucaccgcagucggcaaggaguucaauaaguuagaacgaagaauggagaaccugaauaaaaagguggacgauggauuucucgacauauggacauauaacgcugaacuucugguuuugcuagagaacgaaaggacucuggacuuccacgauaguaaugugaaaaaccucuacgagaaggucaaaaaucaacugaagaacaaugccaaggagauuggcaacgggugcuuugaguucuaucauaaauguaauaacgaaugcauggaauccgugaagaauggaaccuacgacuauccuaaauacagcgaggagucuaaacuuaaccgggagaaaaucgaugguguaaagcuggaaucaaugggcguuuaucacaucuuggcuauuuacaguacaguggccagcucccucguccuguuagugucucugggggcaaucucguuuuggaugugcagcaauggaucccuacagugucguauuugcauauga

SEQ ID NO: 123297 - RNA, 1701 nt, Artificial Sequence
  derived and/or modified sequence opt3 from hemagglutinin__InfluenzaA__ABI92324
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaaaguuaccguguccacaaagaggucacagcagacugucauuccaaauaucggauuccggcccugggugcgcggucuaagcaguagaauuucuaucuauuggaccauagugaagccuggcgacauucuccugaucaacuccacagggaaccuuauugccccaaggggauacuuuaaaauccggaauggcaagagcucgaucaugcgcucugaugcgccgauugguaacuguuccucagagugcauaacccccaaugggaguaucccuaacgacaaaccauuccagaaugucaaccgaauuacguauggagcaugucccagauacguuaagcaaaauacucugaaauuggccacaggcaugaggaacgugccugaaaagcagacccggggcaucuuuggggcuauagccggauucauugagaaugguugggaaggcaugguagaugggugguauggauuucgucaccagaacagcgagggcacuggucaggcagcugaccucaaauccacacaagccgcgaucgaucagaucaaugggaagcugaaccgcuuaauugagaagaccaaugaaaaauuccaucagaucgagaaggaguucucugaaguggaaggcaggauucaagaccuggagaaauacgucgaggauacgaagauagaccucuggagcuauaacgccggacuucugguggcauuggaaaaucagcacaccaucgaucuaacagacucagagaugaacaaacuguuugaaagaacucggaagcagcuccgagagaacgcugaagauaugggcaaugggugcuucaagauuuaccauaaaugugacaacgccugcaucggaaguauccgcaaugguaccuacgaccacgauguuuauagagacgaggcucugaacaauagguuucagauuaagggcguggagcuuaaauccggguacaaggauuggauacuguggaucagcuucgccauuucuugcuuuuugcucugugucgugcuguuaggauucaucaugugggcaugccaaaaaggcaacauucgguguaauaucugcauauga

SEQ ID NO: 123298 - RNA, 1701 nt, Artificial Sequence
  derived and/or modified sequence opt3 from hemagglutinin__InfluenzaA__ABI92335
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucucccuguacgcccaggcuucaggcagaguaaccguuagcacaaagaggagucaacagacugugauuccaaacaucggcucucggcccuggguccgcgggguguccagcagaauuucgaucuacuggaccauagugaaaccuggagacauucuacucaucaacucuacagguaaucugauugccccaaggggcuauuucaagauccgguccgggaagucaaguaucaugcgcagcgacgcgccgauuggaaaauguaacuccgaaugcauaacccccaauggcucuaucccuaacgauaagccauuucagaaugucaaccgaauuacguacggugcaugucccagauauguuaaacagaauacucuuaagcuggccacagggaugaggaacgugccugagaaacaaacccggggaaucuucggcgcuauagccggcuuuauugaaaaugggugggagggaaugauggacgguugguacggcuuccgucaccagaacagcgaggggacuggacaggcagcugauuugaagucaacacaagccgcgaucaaucagaucaacggcaaacucaaucgccugauugaaaagaccaacgagaaguuucaucagaucgaaaaagaguucagugaaguagaggguaggauucaggacuuagagaaguauguggaagauacgaaaauagaccugugguccuacaaugccgagcuccuugucgcacuggaaaaccaacacaccaucgauuugacagacagcgagaugaacaagcuauucgaaagaacuaaaaagcagcugcgggagaaugcugaggauauggggaacggcugcuuuaagauuuaucauaaaugugacaaugccugcaugggaucuauccgaaacggcaccuacgaucacgacguguaccgcgacgaagcucucaauaacagauuccagaucaaggggguugagcugaaaucaggauauaaggauuggauucuuuggauaaguuuugccaucagcugcuuccuguuguguauugugcucauggguuuuaucaugugggcaugccagaaaggcaauauuagguguaacaucugcauauga

SEQ ID NO: 123299 - RNA, 1701 nt, Artificial Sequence
  derived and/or modified sequence opt3 from hemagglutinin__InfluenzaA__ABI92346
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacagaauacucuuaagcuggccacaggaaugaggaacgugccugagaaacaaacccggggcaucuucggcgcuauagccggguuuauugaaaauggaugggaggguaugauggacggcugguacggguuccgucaccagaacucugagggaacuggccaggcagcugaucuaaagagcacacaagccgcgaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugccgagcuccuugucgcacuggaaaaccaacacaccaucgauuugacagacuccgagaugaacaagcuauucgaaagaacuaaaaagcagcugcgggagaaugcugaggauaugggcaacggaugcuuuaagauuuaucauaaaugugacaaugccugcaucggcagcauccgaaacgggaccuacgaucacgacguguaccgcgacgaagcucucaauaacagauuccacauuaagggaguugagcugaaaucugguuauaaggauugggugcuuuggauaucauuugccaucaguugcuuccuguuguguauuguccuccugggcuuuaucaugugggcaugccagaaagggaauauuagguguaacaucugcauauga

SEQ ID NO: 123300 - RNA, 1701 nt, Artificial Sequence; identical to SEQ ID NO: 122298
  derived and/or modified sequence opt3 from hemagglutinin__InfluenzaA__ABI92357

SEQ ID NO: 123301 - RNA, 1701 nt, Artificial Sequence; identical to SEQ ID NO: 122298
  derived and/or modified sequence opt3 from hemagglutinin__InfluenzaA__ABI92368

SEQ ID NO: 123302 - RNA, 1698 nt, Artificial Sequence; identical to SEQ ID NO: 123220
  derived and/or modified sequence opt3 from hemagglutinin__InfluenzaA__ABI92379

SEQ ID NO: 123303 - RNA, 1701 nt, Artificial Sequence
  derived and/or modified sequence opt3 from hemagglutinin__InfluenzaA__ABI92390
augaagaccaucauugccuucagcuacauacugugccucguguuugcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacagguggcauuugcgacagcccacaccagauccuggauggggagaauuguacccuaauagacgcucuccugggagauccgcagugcgacggcuuccaaaacaaaaagugggaucuuuuuguggaaagauccaaagccuauucuaauuguuaccccuaugacgucccugauuacgcaucgcugaggucauugguggccagcagugguacucucgaguucaacaaugaauccuuuaacuggacagggguuacccagaauggaacgucuagcgcuugcaagcggcgcuccaacaauucauucuuuagucgacugaacuggcugacucaucucaaguucaaauauccagcauuaaaugugaccaugcccaacaacgagaaguuugacaaacuguacaucuggggcguccaccauccuggcacagauaaugaccagacuagccuuuaugcccaggcuucugggcguauuaccguguccacaaagagaucacaacagaccguaacgccaaacaucggaagcaggccccggguucgcgauauuccuaguagaaucucuauauacuggacuauugugaaaccaggugacaucuugcugauuaauuccacaggcaaccuaaucgccccgaggggguacuucaagauccggagcggaaagucgucuauuaugcgcuccgacgcgcccauaggcaaauguaauucagagugcaucaccccuaacgguaguauuccaaaugauaagcccuuucagaacgucaaucgaaucacuuauggggcauguccuagauacgugaaacagaacacacucaagcuggccaccggaaugaggaaugugccagaaaaacaaacgcggggcauauucggcgcuauugccggguuuaucgagaacggaugggaagguauggucgacggcugguauggguuccgucaccagaauagcgagggaaccggccaggcagcugaucuuaaguccacacaagccgcgaucaaccagauuaaugguaaacugaaccgcuugaucgggaagacuaacgagaaguuccaccagauugaaaaagaguuuucugaaguugagggcagaauacaggaccucgaaaaguacguggaggauaccaaaaucgaccuguggagcuauaaugccgaguuacugguagcacucgaaaaccaacauacaauugaucuuacugacucagagaugaauaagcuguucgaaaggaccaaaaagcaguugcgggagaacgcugaagauaugggaaauggcugcuuuaagaucuaccacaaaugugacaacgccugcaucgggaguauucgaaauggaacauaugaucaugacguguaccgcgacgaggcucuaaacaauagauuccagauaaagggugucgagcugaaauccggcuacaaggauuggauccucuggauuagcuuugccaucucuugcuuccugcuuuguguggcacuguugggguuuauuaugugggccugccagaaaggaaacaucagguguaauauaugcaucuga

SEQ ID NO: 123304 - RNA, 1701 nt, Artificial Sequence; identical to SEQ ID NO: 122298
  derived and/or modified sequence opt3 from hemagglutinin__InfluenzaA__ABI92401

SEQ ID NO: 123305 - RNA, 1701 nt, Artificial Sequence
  derived and/or modified sequence opt3 from hemagglutinin__InfluenzaA__ABI92412
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguggcaucugcgacagcccacaccagauucucgauggggaaaauuguacccugaucgacgcucugcugggagauccgcagugcgacggcuuucaaaacaaaaagugggauuuguucguggaaagauccaaagccuauucuaauuguuaccccuaugacgucccugauuacgcaucgcucaggucacugauagccagcagugguacucuggaguuuaacaaugaauccuucaacuggacaggggugacccagaauggaacgucuagcgcuugcaagcggcgcuccaacucaaguuucuucagccgacucaauugguuaacucaucugaaguuuaaauauccagcacuuaacguuaccaugcccaauaacgaggaguucgacaaguuguacaucuggggcgugcaccauccuggcacauauaacgaucagauuucucuguacgcccaggcuuccgggcguaucacugucucaaccaaaagaagccaacagacagugauuccaaauaucggaaguaggccccggguacgcgacauaccuucuagaauuuccaucuacuggaccauuguuaagccaggugauauccuacucaucaacagcacgggcaaucugauugccccgaggggguauuuuaaaauacggucgggaaagucuuccaucaugcgcucagacgcgcccauuggcaaguguaacagugaaugcaucacuccuaaugguagcauaccaaacgacaaacccuuccagaauauuaaccgaaucacauacggggcauguccuagauaugugaagcagaauacccuuaaacuggccacuggaaugaggaacgucccagagaagcaaacacggggcaucuuuggcgcuauugccggguucaucgaaaauggaugggaggguaugguggauggcugguacggguuucgucaccagaacuccgagggaauuggccaggcagcugacuugaaaucuacccaagccgcgauagaucagaucaaugguaagcucaaccgccugauugggaaaacgaaugaaaaguuccaccagaucgagaaggaauuuagcgagguggaaggcagaauccaggacuuagagaaauaugucgaggauaccaagauugaccuguggucauacaacgccgaacuccuuguugcacuggagaaccaacauacaauagauuugacugacagugaaaugaauaaacuauuugagaggaccaagaaacagcugcgggaaaacgcugaggauaugggaaauggcugcuucaagaucuaucacaagugugacaacgccugcauuggguccauccgaaauggaacauacgaucaugacguguaccgcgacgaggcucucaacaauagauuucagauuaaagguguagaacuuaagagcggcuauaaagauuggauccuuuggauaucuuucgccaucucaugcuuucuguuguguguggcacuccugggguucauuaugugggccugccagaagggaaacaucagguguaauauuugcaucuga

SEQ ID NO: 123306 - RNA, 1701 nt, Artificial Sequence
  derived and/or modified sequence opt3 from hemagglutinin__InfluenzaA__ABI92423
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuuuagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggguacgcgacauuccuucuagaaucuccauuuacuggaccaucguuaagccaggugauauccugcuaauuaacagcacgggcaaucucauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccugaaacuugccacuggaaugaggaacgugccagauaagcaaacacggggcaucuuuggcgcuauugccggguucaucgagaauggaugggaagguaugguggacggcugguacggguuucgucaccagaacuccgagggaauuggccaggcagcugaucugaaaucuacccaagccgcgauagaccagaucaaugguaaguugaaccgccucauugggaaaacgaaugagaaguuccaccagaucgaaaaggaguucagcgaagucgagggcagaauccaggaucuggaaaaauauguugaggacaccaagauugauuuauggucauacaacgccgagcugcucguggcacuugaaaaccaacauacaauagaccugacugauagugagaugaauaaauuguuugaaaggaccaagaaacagcuacgggagaacgcugaagacaugggaaauggcugcuucaagaucuaucacaagugugauaacgccugcauuggguccauccgaaauggaacauacgaccaugacguauaccgcgaugaggcucugaacaauagauuucagauuaaagguguggagcucaagagcggcuauaaagacuggauccuguggauaucuuucgccaucucaugcuuucuucugugugucgcauugcucggguucauuaugugggccugccagaagggaaacaucagguguaauauuugcaucuga

SEQ ID NO: 123307 - RNA, 1701 nt, Artificial Sequence; identical to SEQ ID NO: 122649
  derived and/or modified sequence opt3 from hemagglutinin__InfluenzaA__ABI92434

SEQ ID NO: 123308 - RNA, 1701 nt, Artificial Sequence
  derived and/or modified sequence opt3 from hemagglutinin__InfluenzaA__ABI92445
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccgguggcauuugcgacagcccacaccagauccuagauggggagaauuguacucucauagacgcgcugcuuggagauccgcagugcgacggcuuucaaaacaaaaagugggaucuguucguggaaagauccaaggcuuauucuaauuguuaccccuaugacgucccugauuacgccucguugaggucacucaucgcaagcagugguacacuggaguuuaacaaugaauccuucaacuggaccggggugaaucagaacggaacgucuagcgccugcaagcggcgcuccaauucauccuuuuucagccgacugaacuggcucacucauuuaaaguuuaaauauccagcucugaauguuaccaugcccaacaacgaggaguucgacaaacuuuacauuuggggcgugcaccauccuggcacauauaaugaucagaucucuuuguacgcacaggccuccgggcguauuacugucucaaccaaaagaagccaacagacagugaucccaaacauaggaaguaggccccggguacgcgacauuccuucuagaaucuccauuuacuggaccaucguuaagccaggugauauccugcuaauuaauagcacgggcaaccucauagcuccgaggggguauuuuaaaauccggucgggaaagucuuccauuaugcgcucagacgcccccaucggcaaguguaauagugaaugcauaacuccuaacgguagcauuccaaaugacaaacccuuccagaacgugaaucgaaucacauacggggcguguccuagauaugucaagcagaacacccugaaacuugcaacuggaaugaggaaugugccagagaagcaaacacggggcaucuuuggcgccauugcuggguucaucgaaaacggaugggaggguaugguggauggcugguacggguuucgucaccagaauagugagggaauuggccaggccgcagaccugaaaucuacccaagcugccauagaucagaucaacgguaaguugaaucgccucauugggaaaacgaacgaaaaguuccaccagaucgagaaggaguucagcgaagucgaaggcagaauccaggaccuggagaaauauguugaggauaccaagauugacuuauggucauacaacgcggaacugcucguggcccuugagaaucaacauacaauagaucugacugacagugaaaugaacaaauuguuugagaggaccaagaaacagcuacgggaaaaugcagaggauaugggaaacggcugcuucaagaucuaucacaagugugacaauacaugcauuggguccauccgaaacggaacuuacgaucaugacguauaccgcgacgaggcucugaauaacagauuucagauuaaagguguggaacucaagagcggcuauaaagauuggauccuguggauaucuuucgccaucucaugcuuucuucugugugucgcuuugcucggguucauuaugugggccugccagaagggaaauaucagguguaacauuugcaucuga

SEQ ID NO: 123309 - RNA, 1701 nt, Artificial Sequence; identical to SEQ ID NO: 122649
  derived and/or modified sequence opt3 from hemagglutinin__InfluenzaA__ABI92456

SEQ ID NO: 123310 - RNA, 1701 nt, Artificial Sequence; identical to SEQ ID NO: 123257
  derived and/or modified sequence opt3 from hemagglutinin__InfluenzaA__ABI92467

SEQ ID NO: 123311 - RNA, 1701 nt, Artificial Sequence; identical to SEQ ID NO: 122666
  derived and/or modified sequence opt3 from hemagglutinin__InfluenzaA__ABI92478

SEQ ID NO: 123312 - RNA, 1701 nt, Artificial Sequence; identical to SEQ ID NO: 123257
  derived and/or modified sequence opt3 from hemagglutinin__InfluenzaA__ABI92489

SEQ ID NO: 123313 - RNA, 1701 nt, Artificial Sequence
  derived and/or modified sequence opt3 from hemagglutinin__InfluenzaA__ABI92500
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucuacacaagcgguaaucaaccagaucaaugguaaacucaaccgucugauugaaaagaccaaugagaaguuucaucagaucgaaaaagaguucucagaaguggaggggcgcauucaggauuuagagaaguaugucgaagacacgaaaauagaucuguggaguuacaacgccgagcuccuuguggcacuggaaaaccaacacaccaucgacuugacagauuccgagaugaauaagcuauucgaaagaacuaaaaagcagcugagggagaacgcugaggacaugggcaauggauguuuuaagauuuaucauaaaugcgauaacgccugcaucggcagcauccggaaugggaccuacgaccacgauguuuaccgagacgaagcucucaacaaucgcuuccagauuaagggaguggagcugaaaucugguuauaaggacuggauacuuuggaucucauuugccauuaguuguuuccuguugugcgucgugcuccugggcuuuaucaugugggcaugucagaaagggaacauuagaugcaauaucuguauauga

SEQ ID NO: 123314 - RNA, 1701 nt, Artificial Sequence
  derived and/or modified sequence opt3 from hemagglutinin__InfluenzaA__ABI92511
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaaaauucuucaacagguaucauuugcgacaguccacaccagauccucgauggcgagaacuguacccugauagacgcucuacugggggauccgcauugcgacggauuucagaauaaagaaugggauuuguucguggagagaagcaaggccuauuccaacuguuaccccuaugacgucccugauuacgcaucucucaggucgcugguggccucaagcggcacucuggaauuuaauaacgagaguuucaauuggacagguguugcucagaacgggaccuccucugcaugcaaacggcgcagcgacaaguccuuuuucucacgacucaauugguuacaccagcugaaguauaaauacccagcccuuaacgugacgaugcccaauacugagaaguuugauaaauuguauaucuggggaguccaucacccuaguaccgacagcgaucagauuucucuguacgcucaggccuccggccgugugacaguaucaacuaagagaagccaacagaccguuaucccaaacauuggcaguaggcccugggugcgcggggucucuucccgggugagcaucuacuggacaauagugaaaccuggagacauucuacucaucaacucgaccgguaaucugauugcgccaagaggcuauuucaagaucaggucugggaaguccucaaucaugcggagugacgcaagcauuggaaaauguaacuccaagugcauaacgccgaauggcucuauccccaacgauaaaccuuuucagaaugucaaccgcauuacuuacggugccuguccacgauauguuaagcagaauacacuuaaacuggcuaccgggaugagaaacgugcccgaaaagcaaacuaggggaaucuucggcgccauagcaggcuuuauugagaaugggugggaaggaaugguagacgguugguacggcuuccggcaccagaacagcgaggggacaggacaggcugccgauuugaaaucaacccaagcggccaucaaucagaucaacggcaagcucaaucgucugauugagaagacgaacgaaaaauuucaucagaucgagaaggaguucagugaaguggaaggucgcauucaggacuuagagaaauaugucgaggauaccaagauagaccugugguccuacaaugcagaacuccuuguggcucuggagaaccaacacacaaucgauuugacugacagcgaaaugaacaaacuauucgagagaaccaagaagcagcugagggaaaaugccgaggauauggggaacggcugcuuuaaaauuuaucauaagugugacaauacaugcaucggaucuauccggaacggcacuuacgaucacgacguuuaccgagacgaggcucucaauaaccgcuuccagauuaaagggguggaacugaagucaggauauaaagauuggauacuuuggaucaguuuugccauuagcugcuuccuguugugugucgugcuccuggguuuuaucaugugggcaugccagaagggcaauauuagauguaacaucugcauauga

SEQ ID NO: 123315 - RNA, 1701 nt, Artificial Sequence
  derived and/or modified sequence opt3 from hemagglutinin__InfluenzaA__ABI92522
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccaacaagucauuuuucagucgucucaauugguuacaccagcugaaguauaaauacccagcacuuaacgucacgaugcccaauaacgagaaguuugacaaauuguauauauggggagugcaucacccuggcacugauagcgaccagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugauauucuacucaucaauucgacaggcaaccugauugccccaaggggguauuucaagauccggucuggaaaguccucaaucaugaaaagugacgcgccgauuggcaaguguaauagcgaaugcauaacccccaacgguuccaucccuaaugacaaaccauuucagaacgucaaucgcauuacguacggggcauguccccgauauguuaagcagaacacucuuaaacuggccacaggaaugagaaaugugccugagaagcaaaccaggggcaucuucggcgcuauagccggguuuauugaaaacggaugggaggguaugauggauggcugguacggguuccggcaccaaaauucugagggaacuggccaggcagcugacuugaaaagcacacaggccgcgaucaaccagaucaaugguaagcucaaccgucugauugaaaagaccaaugagaaauuucaucagaucgaaaaggaguucucagaaguagaggggcgcauucaggauuuagagaaauauguggaagacacgaagauagaucuguggaguuacaacgccgagcuccuugucgcacuggaaaaccaacacaccaucgacuugacagauuccgagaugaauaaacuauucgaaagaacuaagaagcagcugagggagaacgcugaggacaugggcaauggaugcuuuaaaauuuaucauaagugugauaacgccugcaucggcagcauccggaaugggaccuacgaccacgauguguaccgagacgaagcucucaacaaucgcuuccagauuaaaggaguugagcugaagucugguuauaaagacuggauacuuuggaucucauuugccauuaguugcuuccuguuguguaucgugcuccugggcuuuauuaugugggcaugccagaaggggaacaucagauguaauauaugcaucuga

SEQ ID NO: 123316 - RNA, 1701 nt, Artificial Sequence
  derived and/or modified sequence opt3 from hemagglutinin__InfluenzaA__ABI92533
augaagaccaucauugcccugagcuacauacucugccuuguguucgcucagaaacugcccggcaacgacaauuccagagcaacauuguguuuagggcaccaugccgucccuaacggaacucugguuaagacgaucaccaaugaucaaauugaggugacaaacgcgacugaacuuguacagucuucaaguaccgguaggaucugcgacagcccacaccagauucucgauggcgagaauuguacacugaucgacgcucuacugggggauccgcauugcgacggauuucagaacaaagaaugggauuuguucguggagcgguccaaggccuauucuaauuguuaccccuaugacgucccugauuacgugucgcuccgcucacugguugcaagcaguggcacccuggaauuuaacaaugaguccuucaacuggacugguguggcccaaaaugggacaucuagcgcuugcaaacgacguuccgacaagucauuuuucaguagacucaacugguuacaccagcugaaguauaaauacccagcacuuaaugucaccaugcccaacaaugagaaguuugauaaauuguauauauggggagugcaucacccuggcacggacagcgaucagaucucucuguacgcccaggcuuccggcaggguaacuguuucaaccaagcggagccaacagacagugauuccaaacaucgggagucgccccugggucagaggagugucuuccaggauuagcaucuacuggacuauagugaaaccuggugacauucuacucaucaacucgaccggcaaucugauugccccacggggguauuucaagauccgcucuggaaaguccucaaucaugcgaagugacgcgccgauuggcaaauguaacagcgaaugcauaacacccaaugguuccaucccuaacgauaagccauuucagaaugucaacagaauuaccuacgggcccuguccuagguauguuaaacagaauacgcuuaagcuggcaacuggaaugcggaacgugccagagaaacaaacacguggcaucuucggcgccauagcuggguuuauugaaaauggaugggaggguaugauggacggcugguacggguuccgccaccagaacucugagggaaccggccaggccgcagauuugaaaagcacucaagcugccaucaaucagaucaacgguaaacucaauagacugauugaaaagacaaacgagaaguuucaucagaucgaaaaagaguucucagaaguagaggggaggauucaggacuuagagaaguauguggaagauaccaaaauagaccuguggaguuacaaugcggagcuccuugucgcccuggaaaaccaacacacgaucgauuugaccgacuccgagaugaacaagcuauucgaacggacaaagaagcagcugcgagagaaugcagaggauaugggcaacggaugcuuuaagauuuaucauaaaugugacaaugcuugcaucggcagcauccgcaacgggacuuacgaucacgacguguacagagacgaagcccucaauaacagguuccagauuaagggaguugagcugaaaucugguuauaaggauuggauacuuuggaucucauuugcuauuaguugcuuccuguuguguaucgugcuccugggcuuuauuaugugggccugccagaaagggaauauccgguguaacauaugcaucuga

SEQ ID NO: 123317 - RNA, 1701 nt, Artificial Sequence; identical to SEQ ID NO: 123316
  derived and/or modified sequence opt3 from hemagglutinin__InfluenzaA__ABI92544

SEQ ID NO: 123318 - RNA, 1701 nt, Artificial Sequence
  derived and/or modified sequence opt3 from hemagglutinin__InfluenzaA__ABI92577
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagaggucccgggcuuauucuaauuguuaccccuaugacgucccugauuacgugucgcuccgcucacugguugcaagcaguggcacucuggaauuuaacaaugaguccuucaacuggacagguguggcccaaaaugggaccucuagcgcuugcaagcgacguuccgacaaaucauuuuucaguagacucaacugguuacaccagcugaaguauaaguacccagcacuuaaugucacgaugcccaacaaugagaaauuugauaaguuguauauauggggagugcaucacccuggcacugacagcgaucagaucucucuguacgcccaggcuuccggcaggguaaccguuucaacaaaacggagccaacagacugugauuccaaacaucgggagucgccccugggucagaggagugucuuccaagauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacgggcccuguccuagauauguuaaacagaauacucuuaagcuggcaacaggaaugaggaacgugccagagaaacaaacccggggcaucuucggcgccauagcuggguuuauugaaaauggaugggaggguaugauggacggcugguacggguuccgucaccagaacucugagggaacuggccaggccgcagaucuaaagagcacacaagcugccaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugcggagcuccuugucgcccuggaaaaccaacacaccaucgauuugacagacuccgagaugaacaagcuauucgaaagaacuaaaaagcagcugcgggagaaugcagaggauaugggcaacggaugcuuuaagauuuaucauaaaugugacaaugcuugcaucggcagcauccgaaacgggaccuacgaucacgacguguaccgcgacgaagcccucaauaacagauuccagauuaagggaguugagcugaaaucugguuauaaggauuggauacuuuggaucucauuugcuauuaguugcuuccuguuguguaucgugcuccugggcuuuauuaugugggccugccagaaagggaauaucagguguaacauaugcaucuga

SEQ ID NO: 123319 - RNA, 1701 nt, Artificial Sequence; identical to SEQ ID NO: 123055
  derived and/or modified sequence opt3 from hemagglutinin__InfluenzaA__ABI92588

SEQ ID NO: 123320 - RNA, 1701 nt, Artificial Sequence
  derived and/or modified sequence opt3 from hemagglutinin__InfluenzaA__ABI92599
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcaauagcccacaccagauucucgacggcgagaacuguacccugaucgaugcucuacugggggacccgcauugcgauggauuucagaauaaagaaugggacuuguucguggagagguccaaggccuauucuaacuguuaccccuaugaugucccugacuacgugucgcuccggucacugguugcaagcaguggcacucuggaauuuaauaacgaguccuucaauuggacagguguggcccaaaacgggaccucuagcgcuugcaaacgccgauccgauaagucauuuuucagucgucucaauugguuacaccagcugaaguauaaauacccagcacuuaacgucacgaugcccaauaacgagaaguuugacaaauuguauauauggggagugcaucacccuggcacugauagcgaccagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugauauucuacucaucaauucgacaggcaaccugauugccccaaggggguauuucaagauccggucuggaaaguccucaaucaugcgcagugacgcgccgauuggcaaauguaauagcgaaugcauaacccccaacgguuccaucccuaaugacaagccauuucagaacgucaaucgaauuacguacggggcaugucccagauauguuaaacagaagacucuuaaacuggccacaggaaugaggaacgugccugagaagcaaacccggggcaucuucggcgcuauagccggguuuauugaaaauggaugggaggguaugauggauggcugguacggguuccgucaccagaacucugagggaacuggccaggcagcugacuugaaaagcacacaagccgcgaucaaucagaucaacgguaagcucaaucgccugauugaaaagaccaacgagaaauuucaucagaucgaaaaggaguucucagaaguagaggggaggauucaggauuuagagaaauauguggaagacacgaagauagaucuguggaguuacaaugccgagcuccuugucgcacuggaaaaccaacacaccaucgacuugacagauuccgagaugaacaaacuauucgaaagaacuaagaagcagcugcgggagaaugcugaggacaugggcaacggaugcuuuaaaauuuaucauaagugugauaaugccugcaucggcagcauccgaaacgggaccuacgaccacgauguguaccgcgacgaagcucucaauaacagauuccagauuaaaggaguugagcugaagucugguuauaaagacuggauacuuuggaucucauuugccauuaguugcuuccuguuguguaucgugcuccugggcuuuauuaugugggcaugccagaaggggaauaucagguguaacauaugcaucuga

SEQ ID NO: 123321 - RNA, 1701 nt, Artificial Sequence
  derived and/or modified sequence opt3 from hemagglutinin__InfluenzaA__ABI92610
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacagaauacucuuaagcuggccacaggaaugaggaacgugccugagaaacaaacccggggcaucuucggcgcuauagccggguuuauugaaaauggaugggaggguaugauggacggcugguacggguuccgucaccagaacucugagggaacuggccaggcagcugaucuaaagagcacacaagccgcgaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugccgagcuccuugucgcacuggaaaaccaacacaccaucgauuugacagacuccgagaugaacaagcuauucgaaagaacuaaaaagcagcugcgggagaaugcugaggauaugggcaacggaugcuuuaagauuuaucauaaaugugacaaugccugcaucggcagcauccgaaacgggaccuacgaucacgacguguaccgcgacgaagcucucaauaacagauuccagauuaagggaguugagcugaaaucugguuauaaggauuggauacuuuggaucucauuugccauuaguugcuuccuguuguguaucgugcuccugggcuuuauuaugugggcaugccagaaagggaauaucagguguaacauaugcaucuga

SEQ ID NO: 123322 - RNA, 1701 nt, Artificial Sequence
  derived and/or modified sequence opt3 from hemagglutinin__InfluenzaA__ABI92621
augaagaccaucauugcccugagcuacauacucugccuuguguucgcucagaaacugcccggcaacgacaauuccauggcaacauuguguuuagggcaccaugccgucccuaacggaacucugguuaagacgaucaccaaugaucaaauugaggugacaaacgcgacugaacuuguacagucuucaaguaccgguagaaucugcaauagcccacaccagauucucgacggcgagaacuguacacugaucgaugcucuacugggggacccgcauugcgaaggauuucagaauaaagagugggauuuguucguggaaagguccaaggccuauucuaacuguuaccccuaugacgucccugauuacgugucgcuccggucacugguugcaagcaguggcacccuggaguuuaauaacgaguccuucaauuggacugguguggcccaaaacgggacaucuagcgcuugcaaacgccgauccgacaagucauuuuucagucgucucaauugguuacaccagcugaaguauaaauacccagcacuuaacgucaccaugcccaauaacgaaaaguuugauaaauuguauauauggggagugcaucacccuggcacggacagcgaucagaucucucuguacgcccaggcuuccggcagaguaacuguuucaaccaagaggagccaacagacagugauuccaaacaucgggagucggcccuggguccgcggagugucuuccaaaauuagcaucuacuggacuauagugaagccuggugacauucuacucaucaauucgaccggcaaccugauugccccaagaggguauuucaagaucaggucuggaaaauccucaaucaugcggagugaugcgccgauugacaaguguaauagcgagugcauaacacccaacggcuccaucccuaaugacaaaccauuucagaacgucaaucgcauuaccuacggucuuuguccccgauauguuaagcagaacacgcugaaauuggcaacugggaugagaaaugugccugaaaagcaaacaaggggaaucuucggcgccauagcuggcuuuauugagaacgggugggagggaaugauggaugguugguacggcuuccggcaccaaaauucugaagggaccggacaggccgcagaccucaaaagcacucaggcugccaucaaccagaucaauggcaagcugaaccguuuaauugagaagacaaaugaaaaauuucaucagaucgagaaggaguucucagaaguagagggucgcauucaggaucuggaaaaauauguggaggacaccaagauagaucucuggaguuacaacgcggaacuucuggucgccuuggagaaccaacacacgaucgaccuaaccgauuccgaaaugaauaaacuguucgagagaacaaagaagcagcucagggagaacgcagaagacauggggaauggcugcuuuaaaauuuaucauaagugugauaacgcuugcaucggaagcauccggaauggcacuuacgaccacgauguguaccgagacgaggcccugaacaaucgcuuccagauuaaagggguugaacuuaagucuggauauaaagacuggauacuguggaucucauuugcuauuaguugcuucuugcucuguaucgugcuguuagguuuuauuaugugggccugccagaagggcaacaucagauguaauauaugcaucuga

SEQ ID NO: 123323 - RNA, 1701 nt, Artificial Sequence; identical to SEQ ID NO: 122578
  derived and/or modified sequence opt3 from hemagglutinin__InfluenzaA__ABI92632

SEQ ID NO: 123324 - RNA, 1701 nt, Artificial Sequence
  derived and/or modified sequence opt3 from hemagglutinin__InfluenzaA__ABI92643
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccauccccaacaaugagaaauuugauaaacuuuauauuuggggcguccaccauccuggcacagacagcgaucagaucucuuuguacgcccaggcuuccgggcguauuacugugucaaccaagagaagccaacagacaguaaucccaaacauaggaaguaggccccggguucgcgacgugucuuccagaauuagcaucuacuggaccauugucaagccuggugacauccugcuaaucaacucgacgggcaaucucauugccccaaggggguauuucaagauacggucuggaaaauccucaaucaugcgcagugaugcgccgauuggcaaguguaacagcgagugcaucacucccaaugguuccauaccuaacgacaaaccauuucagaaugugaaccgaauuacauacggggcaugucccagauaugugaagcagaauacccugaaacuugccacuggaaugaggaacgucccugaaaagcaaacacggggcaucuucggcgcuaucgccggguuuauugagaauggaugggaagguaugguugauggcugguacggguuccgucaccagaacucugagggaaccggccaggcagcugaccugaaaagcacgcaagccgcgaucaaucagauuaacgguaaguugaaucgccucauagggaagaccaacgagaaauuucaccagaucgaaaaggaguucucagaaguggagggcaggauucaggaucuggaaaaauauguagaggacacaaagaucgauuuauggaguuacaaugccgagcugcucguggcacuugaaaaccaacauacuaucgaccugaccgauuccgagaugaacaaauuguucgaaagaacaaagcggcagcuacgagagaaugcugaagacaugggaaacggcugcuuuaagauuuaucacaaaugugauaaugccugcauagggagcauccgcaacggaacuuacgaccaugacgucuacagagaugaggcucugaauaacagguuccagauuaaggguguggagcucaaaucuggcuauaaggacuggauccuguggauuucauuugccaucaguugcuuccuucuguguguugcauugcucggguuuauaaugugggccugccagaaaggaaauauccgguguaacauuugcaucuga

SEQ ID NO: 123325 - RNA, 1701 nt, Artificial Sequence
  derived and/or modified sequence opt3 from hemagglutinin__InfluenzaA__ABI92665
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggggcuccaauaagucauuuuucagucgccugaacuggcucacucauuuaaaauauaaguacccagcacugaaugugaccaugcccaacaaugagaaauuugauaaacuuuauaucuggggcguccaccauccugggacagacagcgaucagauuucuuuguacgcccaggcuuccggacgaaucacugugucaaccaagcguagccaacagacaguaauuccaaacaucgguaguagacccaggguucgggacgugucuucccgcauaagcauuuacuggaccaucgucaagccuggcgacauucugcuaaucaacucgacggggaaucucaucgccccaagaggauauuucaagauuaggucuggcaaauccucaauaaugcggagugaugcgccgaucgguaaguguaacagcgagugcauuacucccaauggguccaucccuaacgacaaaccauuucagaaugugaaccgcauaacauacggagcauguccccgauaugugaagcagaauacccugaaacuugccacuggcaugagaaacgucccugaaaagcaaacaaggggcauuuucggggcuaucgccggauuuaucgagaaugguugggaaggcaugguugaugggugguacggauuccggcaccagaacucugagggcaccggucaggcagcugaccugaaaagcacgcaagccgcgauuaaucagaucaacgggaaguugaaucgucucauuggcaagaccaacgagaaauuucaccagauagaaaaggaguucucagaaguggagggacgcauccaggaucuggaaaaauauguagaggacacaaagauugauuuauggaguuacaaugccgagcugcucguggcacuugaaaaccaacauacuaucgaccugaccgauuccgagaugaacaaauuguucgaaagaacaaagaggcagcuacgggagaaugcugaagacaugggcaacgggugcuuuaagaucuaucacaaaugugauaaugccugcauuggaagcauacgaaacgguacuuacgaccaugacgucuaccgcaaugaggcucugaacaauagauuccagaucaagggcguggagcucaaaucuggguauaaggauuggauucuguggaucucauuugccauuaguugcuuccuucuguguguugcauugcucggauuuaucaugugggccugccagaaaggcaacauaagguguaauaucugcauuuga

SEQ ID NO: 123326 - RNA, 1701 nt, Artificial Sequence
  derived and/or modified sequence opt3 from hemagglutinin__InfluenzaA__ABI92676
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacagcgaucagauuucuuuguaugcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguacuucaagauucggaacggaaaaucuuccauaaugcgcucagaugcgccgaucggcaaguguaauagugagugcauuacucccaacgguagcaucccuaaugacaaaccauuucagaacgugaaucgaauaacauauggggcaugucccagauacgugaagcagaacacccugaaacuugccacuggaaugaggaaugucccugaaaagcaaacacggggcauuuucggcgcuaucgccggguuuaucgagaacggaugggaagguaugguugauggcugguauggguuccgucaccaaaauuccgagggaaccggccaggcagcugaccugaaaucuacgcaggccgcgauuaaccagaucaaugguaaguugaaccgccucauugggaagaccaaugagaaauuucaucagauagaaaaggaguucagcgaaguggagggcagaauccaggaucuggaaaaauacguagaggacacaaagauugauuuauggucauauaacgccgagcugcucguggcacuugaaaaccaacacacuaucgaccugaccgauagugagaugaauaaauuguucgaaaggacaaagaagcagcuacgggagaacgcugaagacaugggaaauggcugcuuuaaaaucuaccauaagugugauaacgccugcauuggguccauacgaaauggaacuuaugaccacgacgucuaccgcgaugaggcucugaacaauagauuccagaucaaagguguggagcucaagagcggcuacaaagacuggauucuguggaucucuuuugccauuucaugcuuccuucuguguguugcauugcucggguuuaucaugugggccugccagaagggaaacauaagguguaauaucugcauuuga

SEQ ID NO: 123327 - RNA, 1701 nt, Artificial Sequence
  derived and/or modified sequence opt3 from hemagglutinin__InfluenzaA__ABI92687
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggggcuccaauaagucauuuuucagucgccugaacuggcucacucauuuaaaauauaaguacccagcacugaaugugaccaugcccaacaaugagaaauuugauaaacuuuauaucuggggcguccaccauccugggacagacagcgaucagauuucuuuguacgcccaggcuuccggacgaaucacugugucaaccaagcguagccaacagacaguaauuccaaacaucgguaguagacccaggguucgggacgugucuucccgcauaagcauuuacuggaccaucgucaagccuggcgacauucugcuaaucaacucgacggggaaucucaucgccccaagaggauauuucaagauuaggucuggcaaauccucaauaaugcggagugaugcgccgaucgguaaguguaacagcgagugcauuacucccaauggguccaucccuaacgacaaaccauuucagaaugugaaccgcauaacauacggagcauguccccgauaugugaagcagaauacccugaaacuugccacuggcaugagaaacgucccugaaaagcaaacaaggggcauuuucggggcuaucgccggauuuaucgagaaugguugggaaggcaugguugaugggugguacggauuccggcaccagaacucugagggcaccggucaggcagcugaccugaaaagcacgcaagccgcgauuaaucagaucaacgggaaguugaaucgucucauuggcaagaccaacgagaaauuucaccagauagaaaaggaguucucagaaguggagggacgcauccaggaucuggaaaaauauguagaggacacaaagauugauuuauggaguuacaaugccgagcugcucguggcacuugaaaaccaacauacuaucgaccugaccgauuccgagaugaacaaauuguucgaaagaacaaagaggcagcuacgggagaaugcugaagacaugggcaacgggugcuuuaagaucuaucacaaaugugauaaugccugcauuggaagcauacgaaacgguacuuacgaccaugacgucuaccgcgaugaggcucugaauaacagauuccagaucaagggcguggagcucaaaucuggguauaaggacuggauucuguggaucucauuugccauuaguugcuuccuucuguguguugcauugcucggauuuaucaugugggccugccagaaaggcaauauaagguguaacaucugcauuuga

SEQ ID NO: 123328 - RNA, 1701 nt, Artificial Sequence; identical to SEQ ID NO: 123327
  derived and/or modified sequence opt3 from hemagglutinin__InfluenzaA__ABI92698

SEQ ID NO: 123329 - RNA, 1701 nt, Artificial Sequence; identical to SEQ ID NO: 122532
  derived and/or modified sequence opt3 from hemagglutinin__InfluenzaA__ABI92709

SEQ ID NO: 123330 - RNA, 1701 nt, Artificial Sequence
  derived and/or modified sequence opt3 from hemagglutinin__InfluenzaA__ABI92720
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagagagcgaccagauuucuuuguaugcccaggcuuccgggcguaucacugugucaaccaagagaagccaacagacaguaauuccaaacaucggaaguaggccccggguucgcgaugugucuuccagaauaagcauuuacuggaccaucgucaagccuggugacauucugcuaaucaacucgacgggcaaucucaucgccccaaggggguacuucaagauucggucuggaaaauccucaauaaugcgcagugacgcgccgaucggcaaguguaacagcgaaugcauuacucccaaugguuccaucccuaacgauaaaccauuucagaaugugaaccgaauaacauauggggcaugucccagauacgugaagcagaauacccugaaacuugccacuggaaugaggaacgucccugagaagcaaacacggggcauuuucggcgcuaucgccggguuuaucgaaaauggaugggaggguaugguugacggcugguauggguuccgucaccagaacucugagggaaccggccaggcagcugaucugaaaagcacgcaagccgcgauuaaucagaucaacgguaaguugaaucgccucauugggaagaccaacgaaaaauuucaucagauagagaaggaguucucagaaguggaaggcagaauccaggaccuggagaaauacguagaggauacaaagauugacuuauggaguuauaaugccgaacugcucguggcacuugagaaccaacacacuaucgaucugaccgacuccgaaaugaacaaauuguucgagaggacaaagaagcagcuacgggaaaaugcugaggauaugggaaacggcugcuuuaaaaucuaccauaagugugacaaugccugcauugggagcauacgaaacggaacuuaugaucacgacgucuaccgcgacgaggcucugaauaacagauuccagaucaaagguguggaacucaagucuggcuacaaagauuggauucuguggaucucauuugccauuaguugcuuccuucuguguguugcauugcucggguuuaucaugugggccugccagaagggaaauauaagguguaacaucugcauuuga

SEQ ID NO: 123331 - RNA, 1701 nt, Artificial Sequence
  derived and/or modified sequence opt3 from hemagglutinin__InfluenzaA__ABI92731
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugauggcugguacggguuccgucaccagaacucugagggaaccggccaggcagcugaccugaaaagcacgcaagccgcgauuaaucagaucaacgguaaguugaaucgccucauugggaagaccaacgagaaauuucaccagauagaaaaggaguucucagaaguggagggcagaauccaggaucuggaaaaauauguagaggacacaaagauugauuuauggaguuacaaugccgagcugcucguggcacuugaaaaccaacauacuaucgaccugaccgauuccgagaugaacaaauuguucgaaaggacaaagcggcagcuacgagagaaugcugaagacaugggaaacggcugcuuuaagaucuaucacaaaugugauaaugccugcauugggagcauacgcaacggaacuuacgaccaugacgucuacagagaugaggcucugaauaacagguuccagaucaaggguguggagcucaaaucuggcuauaaggacuggauucuguggaucucauuugccauuaguugcuuccuucuguguguugcauugcucggguuuaucaugugggccugccagaaaggaaauauacgguguaacaucugcauuuga

SEQ ID NO: 123332 - RNA, 1701 nt, Artificial Sequence
  derived and/or modified sequence opt3 from hemagglutinin__InfluenzaA__ABI92742
augaagaccaucauugcccugagcuacauacucugccuuguguucucccagaaacugcccggcaacgacaauucuacagcuacuuuguguuuagggcaccaugcagucccuaacggaacgaucguuaagaccauuacaaaugaucaaaucgaggugacuaacgccaccgaacugguacagucaaguagcacagguggcauuugcgacuccccacaccagauccuagauggggagaauuguacccucauagacgcgcugcuuggagauccgcagugcgacggcuuucaaaacaaaaagugggaucuguucguggaaagaucuaaggcuuauucgaauuguuaccccuaugacgucccugaucaugccucauugaggagccucguggcaaguuccgguacucuggaguuuaacaaugaaucuuucgacuggacagggguuacccagaacggaacgagcuccgccugcaagcggcgcucaaauaagagcuuuuucagucgacugaacuggcucacucacuuaaaauacaaguauccagcucugaaugugaccaugcccaacaaugagaaauuugauaaacuuuacaucuggggcguccaucacccuggcacagacucugaucagauuuccuuguaugcacaggccucagggcguaucacugugagcaccaaaagaagucaacagacaguaauuccaaacaucggaucuaggccccggguucgcgacguguccagcagaauaucgauuuacuggaccaucgucaagccuggugacauucugcuaaucaacucuacgggcaaucucaucgcuccaaggggguacuucaagauucgguccggaaaaucaaguauaaugcgcagcgaugccccgaucggcaaguguaacuccgagugcauuacucccaaugguucuaucccuaacgacaaaccauuucagaaugugaaccgaauaacauauggggcgugucccagauacgugaagcagaauacccugaaacuugcaacuggaaugaggaacgucccugaaaagcaaacacggggcauuuucggcgccaucgcuggguuuaucgagaauggaugggaagguaugguugauggcugguauggguuccgucaccagaacagcgagggaaccggccaggccgcagaccugaaaucaacgcaagcugccauuaaucagaucaacgguaaguugaaucgccucauugggaagaccaacgagaaauuucaucagauagaaaaggaguucagugaaguggagggcagaauccaggaucuggaaaaauacguagaggacacaaagauugauuuaugguccuauaaugcggagcugcucguggcccuugaaaaccaacacacuaucgaccugaccgauagcgagaugaacaaauuguucgaaaggacaaagaagcagcuacgggagaaugcagaagacaugggaaacggcugcuuuaaaaucuaccauaagugugauaaugcuugcauugggucuauacgaaacggaacuuaugaccacgacgucuaccgcgaugaggcccugaauaacagauuccagaucaaagguguggagcucaagucaggcuacaaagacuggauucuguggaucaguuuugcuauuagcugcuuccuucuguguguugccuugcucggguuuaucaugugggcaugccagaagggaaauauaagguguaacaucugcauuuga

SEQ ID NO: 123333 - RNA, 1701 nt, Artificial Sequence
  derived and/or modified sequence opt3 from hemagglutinin__InfluenzaA__ABI92753
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcauauuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucauuuaaaauacaaguauccagcacugaaugugaccaugcccaacaaugagaaauuugauaaacuuuacaucuggggcguccaccauccuggcacagacagugaucagauuagcuuguacgcccaggcuucugggcguaucacuguguccaccaagagaucacaacagacaguaauuccaaacaucggaagcaggccccggguucgcgacgugaguucuagaauauccauuuauuggaccaucgucaagccuggugacauucugcuaaucaacagcacgggcaaucucaucgccccaaggggguacuucaagauucggucgggaaaaucuuccauaaugcgcucagaugcgccgaucggcaaguguaacagugagugcauuacucccaaugguagcaucccuaacgacaaaccauuucagaaugugaaccgaauaacauauggggcaugucccagauacgugaagcagaauacccugaaacuugccacuggaaugaggaacgucccugaaaagcaaacacggggcauuuucggcgcuaucgccggguuuaucgagaauggaugggaagguaugguugauggcugguauggguuccgucaccagaacuccgagggaaccggccaggcagcugaccugaaaucuacgcaagccgcgauuaaucagaucaacgguaaguugaaucgccucauugggaagaccaacgagaaauuucaccagauagaaaaggaguucagcgaaguggagggcagaauccaggaucuggaaaaauacguagaggacacaaagauugauuuauggucauauaaugccgagcugcucguggcacuugaaaaccaacauacuaucgaccugaccgauagugagaugaacaaauuguucgaaaggacaaagcggcagcuacgagagaaugcugaagacaugggaaacggcugcuuuaagaucuaccacaaaugugauaaugccugcauuggguccauacgcaacggaacuuacgaccaugacgucuauagagaugaggcucugaauaacagguuccagaucaaggguguggagcucaaaagcggcuacaaggacuggauucuguggaucucuuuugccauuucaugcuuccuucuguguguugcauugcucggguuuaucaugugggccugccagaaaggaaauauacgguguaacaucugcauuuga

SEQ ID NO: 123334 - RNA, 1701 nt, Artificial Sequence
  derived and/or modified sequence opt3 from hemagglutinin__InfluenzaA__ABI92764
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucgacuggacagguguuacccagaacgggacgucuagcgcuugcaagcggggauccaauaagucauuuuucagucgccugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcgaaucacugugucaaccaagcguagccaacagacaguaauuccaaacaucggaaguagacccaggguucgggacgugucuucccgcauaagcauuuacuggaccaucgucaagccuggugacauucugcuaaucaacucgacgggcaaucucaucgccccaagaggguauuucaagauuaggucuggaaaauccucaauaaugcggagugaugcgccgaucggcaaguguaacagcgaaugcauuacucccaaugguuccaucccuaacgacaaaccauuucagaaugugaaccgcauaacauacggggcauguccccgauaugugaagcagaauacccugaaacuugccacuggaaugagaaacgucccugagaagcaaacaaggggcauuuucggcgcuaucgccggguuuaucgaaaauggaugggaggguaugguugauggcugguacggguuccggcaccagaacucugagggaaccggccaggcagcugaccugaaaagcacgcaagccgcgauuaaucagaucaacgguaaguugaaucgucucauugggaagaccaacgaaaaauuucaccagauagagaaggaguucucagaaguggaaggccgcauccaggaucuggagaaauauguagaggacacaaagauugauuuauggaguuacaaugccgaacugcucguggcacuugagaaccaacauacuaucgaccugaccgauuccgaaaugaacaaauuguucgagagaacaaagaggcagcuacgggaaaaugcugaggacaugggaaacggcugcuuuaagaucuaucacaaaugugauaaugccugcauugggagcauacgaaacggaacuuacgaccaugacgucuaccgcgaugaggcucugaauaacagauuccagaucaaggguguggaacucaaaucuggcuauaaggacuggauucuguggaucucauuugccauuaguugcuuccuucuguguguugcauugcucggguuuaucaugugggccugccagaaaggaaauauaagguguaacaucugcauuuga

SEQ ID NO: 123335 - RNA, 1701 nt, Artificial Sequence; identical to SEQ ID NO: 123327
  derived and/or modified sequence opt3 from hemagglutinin__InfluenzaA__ABI92775

SEQ ID NO: 123336 - RNA, 1701 nt, Artificial Sequence; identical to SEQ ID NO: 122259
  derived and/or modified sequence opt3 from hemagglutinin__InfluenzaA__ABI92786

SEQ ID NO: 123337 - RNA, 1701 nt, Artificial Sequence
  derived and/or modified sequence opt3 from hemagglutinin__InfluenzaA__ABI92797
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuagcaacaucggaaguaggccacggguucgcgauauacccucuagaauuuccaucuacuggaccauugugaaaccuggugacauccugcuaaucaauagcacgggcaaccucauugccccaaggggguacuuuaagauacggucgggaaagucuuccaucaugcgcucagacgcgccgauuggcaaauguaauagugagugcaucacucccaacgguagcauaccuaaugauaagccauuccagaacgucaaucgaauuacauauggggcaugucccagauacgugaaacagaacacccugaaacuugccacuggaaugaggaaugugccugaaaagcaaacacggggcaucuuuggcgcuaucgccggguucauugagaacggaugggaagguauggucgacggcugguauggguuucgucaccaaaauuccgagggaaucggccaggcagcugaucugaagucuacccaggccgcgauuaaccagauaaaugguaaauugaaccgccucaucgggaagacgaacgagaaguuccaccagauugaaaaagaguucagcgaaguugagggcagaauccaggaccuggaaaaguacguggaggauaccaaaaucgacuuauggucauauaaugccgagcugcucguagcacuugaaaaccaacauacaauugaucugacugacagugagaugaauaaguuguuugaaaggaccaaaaagcagcuacgggagaacgcugaagauaugggaaauggcugcuucaagauauaccacaaaugugacaacgccugcaucggguccauucgaaauggaacauaugaucaugacguguaccgcgacgaggcucugaacaauagauuucagaucaagggugucgagcucaaaagcggcuacaaggauuggauucuguggaucucuuucgccauaucaugcuuucuucuguguguggcauugcucggguucaucaugugggccugccagaaaggaaacauuagguguaauaucugcauuuga

SEQ ID NO: 123338 - RNA, 1701 nt, Artificial Sequence; identical to SEQ ID NO: 122259
  derived and/or modified sequence opt3 from hemagglutinin__InfluenzaA__ABI92808

SEQ ID NO: 123339 - RNA, 1701 nt, Artificial Sequence; identical to SEQ ID NO: 122259
  derived and/or modified sequence opt3 from hemagglutinin__InfluenzaA__ABI92819

SEQ ID NO: 123340 - RNA, 1701 nt, Artificial Sequence; identical to SEQ ID NO: 122259
  derived and/or modified sequence opt3 from hemagglutinin__InfluenzaA__ABI92841

SEQ ID NO: 123341 - RNA, 1701 nt, Artificial Sequence
  derived and/or modified sequence opt3 from hemagglutinin__InfluenzaA__ABI92852
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggauacaggccccggguucgcgauauaccuagcagaauuaguaucuacuggaccauugugaaaccaggugacauccugcuaaucaauucuacgggcaaccucauugccccgaggggguauuuuaagauacgguccggaaagagcucgaucaugcgcucugacgcgcccauuggcaaauguaauuccgagugcaucacuccuaacgguucaauaccaaaugauaagcccuuccagaacgucaaucgaauuacauacggggcauguccuagauaugugaaacagaacacccugaagcuggccacuggaaugaggaaugugccagaaaaacaaacacggggcaucuuuggcgcuaucgccggguucauugagaacggaugggaagguauggucgacggcugguacggguuucgucaccagaauagugagggaaucggccaggcagcugaucuuaagagcacccaagccgcgauuaaccagauaaaugguaaauugaaccgccucaucgggaagacgaacgagaaguuccaccagauugaaaaagaguucuccgaaguugagggcagaauccaggaccuggaaaaguauguggaggauaccaaaaucgacuuauggucuuacaaugccgagcugcucguagcacuugaaaaccaacauacaauugaucugacugacagcgagaugaauaaguuguuugaaaggaccaaaaagcagcuacgggagaacgcugaagauaugggaaauggcugcuucaagauauaucacaaaugugacaacgccugcaucgggucaauucgaaauggaacauacgaucaugacguguaccgcgacgaggcucugaacaauagauuucagaucaagggugucgagcucaaaaguggcuauaaggauuggauucuguggaucuccuucgccauaagcugcuuucuucuguguguggcauugcucggguucaucaugugggccugccagaaaggaaacauuagguguaauaucugcauuuga

SEQ ID NO: 123342 - RNA, 1701 nt, Artificial Sequence
  derived and/or modified sequence opt3 from hemagglutinin__InfluenzaA__ABI92863
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagcccauucuaauuguuaucccuacgacgucccugauuaugcaucguugaggucacucaucgccagcagugguacucuggaguuuaacaaugaauccuucaacuggacaggggugacccagaauggaacgucuagcgcuugcaagcggcgcuccaaccagucauuuuucagucgacugaauuggcucacucacuuaaaguuuaaauacccagcacugaacguuaccaugcccaauaacgagaaguucgacaaacuuuauauuuggggcgugcaucacccuggcacagauagcgaccagaucucuuuguacgcccaagcuccagggcguauuacugucuccaccaagagaucacagcagacagugauccccaacauaggaagcaggccucggguacgcgauauuaguucuagaaucuccauuuauuggaccaucguuaaaccaggugacauccugcuaauuaauagcacgggcaaccucauagccccgaggggguacuuuaagauccggucgggaaagucuuccauuaugaaaucagacgcgcccaucggccgcuguaauagugagugcauaacuccuaacgguagcauuccaaaugauaagcccuuccagaacgugaaucgaaucacauacggggcauguccuagauaugucaaacaaaacacccugaaacuugccacuggaaugaggaaugugccagaaaaacagacacggggcaucuuuggcgcuauugccggguucaucgagaacggaugggaagguaugguggacggcugguacggguuucgucaccaaaauuccgagggaaccggccaggcagcugaucugaagucuacgcaggccgcgauuaaccagauaaaugguaaauugaaccgccucaucgggaagaccaaugagaaguuccaucagauugaaaaagaguucagcgaagucgagggcagaauccaagaccuggaaaaguauguugaggauacaaaaaucgacuuauggucauacaacgccgagcugcucguggcacuugaaaaccagcacacuauugaucugaccgacagugagaugaauaaguuguuugaaaggacaaagaagcagcuacgggagaacgcugaagauaugggaaauggcugcuucaagauauaucauaaaugugacaacgccugcaucggguccauucgaaauggaacuuacgaucacgacguauaucgcgacgaggcucugaacaauagauuucagaucaaggguguggagcucaaaagcggcuacaaggauuggauucuguggaucucuuucgccauaucaugccuucuguugugugucgcacuccugggguuuaucaugugggccugccaaaaaggaaacauuagguguaauaucugcauuuga

SEQ ID NO: 123343 - RNA, 1701 nt, Artificial Sequence; identical to SEQ ID NO: 122259
  derived and/or modified sequence opt3 from hemagglutinin__InfluenzaA__ABI92874

SEQ ID NO: 123344 - RNA, 1701 nt, Artificial Sequence; identical to SEQ ID NO: 122259
  derived and/or modified sequence opt3 from hemagglutinin__InfluenzaA__ABI92885

SEQ ID NO: 123345 - RNA, 1701 nt, Artificial Sequence
  derived and/or modified sequence opt3 from hemagglutinin__InfluenzaA__ABI92907
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccauaucagauccuagauggggagaauuguacccucauagacgcucugcuuggagauccgcagugcgacggcuuucaaaacaaaaagugggaucuguucguggaaagauccaaagccuacucuaauuguuaucccuacgacgucccugauuaugugucguugaggucacucguugcaagcagugguacucuggaguuuaacaaugaauccuucaacuggacaggggugacccagaauggaacgucuagcgccugcaagcggcgcuccaacaauucauuuuucagucgacugaacuggcucacucacuuaaaguuuaaauacccagcucugaaugucaccaugcccaacaacgagaaguucgacaaacuuuauaucuggggcgugcaucacccuggcacagauaaugaccagauuagcuuguacgcacaggccucugggcguaucacuguauccaccaagagaucacaacagacaguuauuccaaacaucggaagcaggccccgggugcgcgauauaccuaguagaauuucuaucuacuggaccauugucaaaccaggugacauccugcuaaucaauuccacgggcaaccucauugcuccgaggggguauuuuaagauacggagcggaaagucgucuaucaugcgcuccgacgcccccauuggcaaauguaauucagagugcaucacuccuaacgguaguauaccaaaugauaagcccuuccagaacgugaaucgaauuacauacggggcguguccuagauaugugaaacagaacacccugaaacuugcaacuggaaugaggaaugucccagaaaagcaaacacggggcaucuuuggcgccaucgcuggguucauugagaacggaugggaagguaugguugacggcugguacggguuucgucaucagaauagcgagggaaucggccaggccgcagaucugaaguccacccaagcugccauuaaccagauaaaugguaaauugaaccgccucaucgggaagacgaacgagaaguuccaccagauugaaaaagaguucucugaaguggagggcagaauccaggaccuggaaaaguauguagaggauaccaaaaucgacuuauggagcuacaaugcggagcugcucguggcccuugaaaaccaacacacaauugaucugacugacucagagaugaauaaguuguuugaaaggaccaaaaagcagcuacgggagaacgcagaagauaugggaaauggcugcuucaagauauaucauaaaugugacaacgcuugcaucgggaguauucgaaauggaacauacgaucacgacgucuaccgcgacgaggcccugaacaauagauuucagaucaaggguguggagcucaaauccggcuauaaggauuggauucuguggaucagcuucgcuauaucuugcuuucuucuguguguugccuugcucggguucaucaugugggcaugccagaaaggaaacauuagguguaauaucugcauuuga

SEQ ID NO: 123346 - RNA, 1701 nt, Artificial Sequence; identical to SEQ ID NO: 122259
  derived and/or modified sequence opt3 from hemagglutinin__InfluenzaA__ABI92918

SEQ ID NO: 123347 - RNA, 1701 nt, Artificial Sequence; identical to SEQ ID NO: 123345
  derived and/or modified sequence opt3 from hemagglutinin__InfluenzaA__ABI92929

SEQ ID NO: 123348 - RNA, 1701 nt, Artificial Sequence
  derived and/or modified sequence opt3 from hemagglutinin__InfluenzaA__ABI92940
augaagaccaucauugccuucaacuacauacugugccucguguuugcucagaaacuucccggcaaugacaacagcacagcaacucuguguuuggggcaccaugccgucccuaauggaacgaucguuaagaccauuacaaacgaucaaaucgaggugacuaaugcgaccgaauuaguacaguccucuucaacagguggcauuugcgacaguccacaccagauccuggauggggagaacuguacccuaauagacgcucuccugggagauccgcagugcgacggcuuccaaaauaaaaagugggaucuuuuuguggaaagaagcaaagccuauuccaacuguuaccccuaugacgucccugauuacgcaucucugaggucguugguggccucaagcgguacucucgaguucaauaacgaaaucuuuaauuggacagggguuacccagaacggaacgaguuccgcuugcaagcggcgcucuaauaacagcuucuuuucccgacugaauuggcugacucaucucaaguucaaauauccagcauuaaacgugaccaugcccaacaaugagaaguuugacaaacuguacauuuggggcguccaccauccuggcacagauaacgaccagaucucacuuuaugcccaggcuagugggcguauuacugugagcaccaagagaucucaacagacaguaaucccaaauauaggauccaggccccggguucgcgauauuccuucaagaaucagcauuuacuggaccaucgugaaaccaggugacaucuugcugauuaacaguacgggcaaucuaauagccccgaggggguacuucaagauccggucuggaaaguccagcauuaugcgcucggacgcgcccaucggcaaauguaacucugagugcauaacuccuaaugguuccauuccaaacgauaagcccuuucagaaugucaaccgaaucacauauggggcauguccuagauacgugaaacagaauacccucaagcuggccacuggaaugaggaacgugccagaaaaacaaacacggggcaucuucggcgcuauugccggguuuaucgagaauggaugggaagguauggucgacggcugguauggguuccgucaccagaacucagagggaaccggccaggcagcugaucuuaagaguacgcaagccgcgauuaaucagauaaacgguaaacugaaccgcuugaucgggaagaccaaugagaaguuccaccagauugaaaaagaguuuagcgaaguugagggcagaauccaggaccucgaaaaguacguggaggauacaaaaaucgaccugugguccuauaacgccgaguuacugguagcacucgaaaaucaacauacuauugaucuuaccgacucugagaugaacaagcuguucgaaaggacuaaaaagcaguugcgggagaaugcugaagauaugggaaacggcugcuuuaagauauaccacaaaugugacaaugccugcaucgggagcauucgaaacggaacauaugaucaugacguguaccgcgacgaggcucuaaauaacagauuccagaucaagggugucgagcugaaaucaggcuacaaggauuggauucucuggaucaguuuugccauauccugcuuccugcuuuguguggcacuguugggguuuaucaugugggccugccagaaaggaaauauuagguguaacaucugcauuuga

SEQ ID NO: 123349 - RNA, 1701 nt, Artificial Sequence
  derived and/or modified sequence opt3 from hemagglutinin__InfluenzaA__ABI92951
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggguacgcgacauuccuucuagaaucuccauuuacuggaccaucguuaagccaggugauauccugcuaauuaacagcacgggcaaucucauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccugaaacuugccacuggaaugaggaacgugccagagaagcaaacacggggcaucuuuggcgcuauugccggguucaucgaaaauggaugggaggguaugguggauggcugguacggguuucgucaccagaacuccgagggaauuggccaggcagcugaccugaaaucuacccaagccgcgauagaucagaucaaugguaaguugaaccgccucauugggaaaacgaaugaaaaguuccaccagaucgagaaggaauuuagcgaggucgaaggcagaauccaggaccuggagaaauauguugaggauaccaagauugacuuauggucauacaacgccgaacugcucguggcacuugagaaccaacauacaauagaucugacugacagugaaaugaauaaauuguuugagaggaccaagaaacagcuacgggaaaacgcugaggauaugggaaauggcugcuucaagaucuaucacaagugugacaacuccugcauugggagcauccgaaauggaacauacgaucaugacguauaccgcgacgaggcccugaacaauagauuucagauuaaagguguggaacucaagucuggcuauaaagauuggauccuguggauaucauucgcuaucaguugcuuucuucugugugucgccuugcucggguucauuaugugggcaugccagaagggaaacaucagguguaauauuugcaucuga

SEQ ID NO: 123350 - RNA, 1701 nt, Artificial Sequence
  derived and/or modified sequence opt3 from hemagglutinin__InfluenzaA__ABI92962
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagaaauaaagccuauuccaacuguuaccccuaugacgucccugauuacgcaucuuugaggucgcucaucgccucaagcgguacucuggaguuuaauaacgaaaguuucaauuggacaggggugacccagaacggaacguccucugcuugcaagcggcgcagcaauuccucauuuuucagucgacugaacuggcucacucauuuaaaguuuaaauauccagcacugaauguuaccaugcccaacaacgaggaguucgacaaacuuuacauuuggggcgugcaccauccuggcacauauaaugaucagaucagcuuguacgcccaggcuucugggcguauuacugucuccaccaagagaucacaacagacagugaucccaaacauaggaagcaggccccggguacgcgacauuccuaguagaaucucuauuuacuggaccaucguuaagccaggugauauccugcuaauuaauuccacgggcaaccucauagccccgaggggguauuuuaaaauccggagcggaaagucgucuauuaugcgcuccgacgcgcccaucggcaaguguaauucagaaugcauaacuccuaacgguaguauuccaaaugacaaacccuuccagaacgugaaucgaaucacauacggggcauguccuagauaugucaagcagaacacccugaaacuugccacuggaaugaggaaugugccagagaagcaaacacggggcaucuuuggcgcuauugccggguucaucgaaaacggaugggaggguaugguggauggcugguacggguuucgucaccagaauagcgagggaauuggccaggcagcugaccugaaauccacccaagccgcgauagaucagaucaacgguaaguugaaucgccucauugggaaaacgaacgaaaaguuccaccagaucgagaaggaguucucugaagucgaaggcagaauccaggaccuggagaaauauguugaggauaccaagauugacuuauggagcuacaacgccgaacugcucguggcacuugagaaucaacauacaauagaucugacugacucagaaaugaacaaauuguuugagaggaccaagaaacagcuacgggaaaaugcugaggauaugggaaacggcugcuucaagaucuaucacaagugugacaaugccugcauugggaguauccgaaacggaacauacgaucaugacguauaccgcgacgaggcucugaauaacagauuucagauuaaagguguggaacucaaguccggcuauaaagauuggauccuguggaucagcuucgccauaucuugcuuucuucugugugucgcauugcucggguucauuaugugggccugccagaagggaaauaucagguguaacauuugcaucuga

SEQ ID NO: 123351 - RNA, 1701 nt, Artificial Sequence; identical to SEQ ID NO: 122649
  derived and/or modified sequence opt3 from hemagglutinin__InfluenzaA__ABI92973

SEQ ID NO: 123352 - RNA, 1701 nt, Artificial Sequence; identical to SEQ ID NO: 122649
  derived and/or modified sequence opt3 from hemagglutinin__InfluenzaA__ABI92984

SEQ ID NO: 123353 - RNA, 1701 nt, Artificial Sequence
  derived and/or modified sequence opt3 from hemagglutinin__InfluenzaA__ABI92995
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggauucgcgacaucccuucuagaauuuccaucuacuggaccaucguaaagccaggugauauucugcuaauaaacagcacgggcaaucucaucgccccgaggggguauuuuaaaauucggucgggaaagucuuccaucaugcgcucagacgcgcccauaggcaaguguaacagugaaugcauuacuccuaaugguagcaucccaaacgacaaacccuuccagaauguuaaccgaaucacauacggggcauguccuaaguaugugaaacagaauacccugaaacuugccacuggaaugagaaacgucccagagaagcaaacaaggggcauuuuuggcgcuaucgccggguucauugaaaauggaugggaggguaugguggauggcugguacggguuucggcaccagaacuccgagggaauaggccaggcagcugaccugaagucuacccaagccgcgaucgaucagauuaaugguaaauugaaccgucucaucgggaagacgaaugaaaaguuccaccagaucgagaaagaauuuagcgagguggaaggccgcauucaggaccuggagaaguaugucgaggauaccaaaauagacuuauggucauacaacgccgaacugcucguugcacuugagaaccaacauacaaucgaucugacugacagugaaaugaauaaguuguuugagagaaccaaaaagcagcuaagggaaaacgcugaggauaugggaaauggcugcuucaagauuuaucacaaaugugacaacgccugcaucggguccauucggaauggaacauacgaucaugacguguaccgagacgaggcucugaacaaucgcuuucagaucaaggguguagaacucaaaagcggcuauaaggauuggauacuguggaucucuuucgccauuucaugcuuucuucuguguguggcauugcucggguucaucaugugggccugccagaaaggaaacauuagauguaauaucugcauauga

SEQ ID NO: 123354 - RNA, 1701 nt, Artificial Sequence; identical to SEQ ID NO: 122649
  derived and/or modified sequence opt3 from hemagglutinin__InfluenzaA__ABI93006

SEQ ID NO: 123355 - RNA, 1701 nt, Artificial Sequence; identical to SEQ ID NO: 122649
  derived and/or modified sequence opt3 from hemagglutinin__InfluenzaA__ABI93017

SEQ ID NO: 123356 - RNA, 1698 nt, Artificial Sequence; identical to SEQ ID NO: 123248
  derived and/or modified sequence opt3 from hemagglutinin__InfluenzaA__ABI93028

SEQ ID NO: 123357 - RNA, 1701 nt, Artificial Sequence; identical to SEQ ID NO: 122982
  derived and/or modified sequence opt3 from hemagglutinin__InfluenzaA__ABI93039

SEQ ID NO: 123358 - RNA, 1701 nt, Artificial Sequence
  derived and/or modified sequence opt3 from hemagglutinin__InfluenzaA__ABI93061
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcauccauuggaaaauguaauucugaaugcauaaccccgaacggcagcauccccaaugacaagccuuuucagaacgugaaucgaauuacguacggugccuguccaagauaugucaaacagaacacucuuaagcuggcuacagggaugaggaauguucccgagaaacaaacccggggaaucuucggcgccauagcaggcuuuauugaaaacgggugggagggaaugguggaugguugguacggcuuccgucaccaaaauucagaggggacuggacaggcugccgacuugaagaguacacaggcggccaucaaccagaucaauggcaaacucaaccgccugauugaaaagaccaaugagaaguuucaucagaucgaaaaagaguucuccgaaguagaggguaggauucaggauuuagagaaguauguggaagacacgaaaauagaucuguggagcuacaacgcagagcuccuugucgcucuggaaaaccaacacaccaucgacuugacagauucugagaugaauaagcuauucgaaagaacuaaaaagcagcugcgggagaacgccgaggacauggggaauggcugcuuuaagauuuaucauaaaugugauaacgcuugcaucggaucaauccgaaauggcaccuacgaccacgauguguaccgcgacgaagcccucaacaauagauuccagauuaaggggguugagcugaaaaguggauauaaggacuggauacuuuggaucagcuuugcaauuuccugcuuccuguugugugugguccuccuggguuuuaucaugugggccugccagaaaggcaacauuagguguaauaucugcauauga

SEQ ID NO: 123359 - RNA, 1701 nt, Artificial Sequence; identical to SEQ ID NO: 122666
  derived and/or modified sequence opt3 from hemagglutinin__InfluenzaA__ABI93072

SEQ ID NO: 123360 - RNA, 1701 nt, Artificial Sequence; identical to SEQ ID NO: 122666
  derived and/or modified sequence opt3 from hemagglutinin__InfluenzaA__ABI93083

SEQ ID NO: 123361 - RNA, 1701 nt, Artificial Sequence; identical to SEQ ID NO: 122666
  derived and/or modified sequence opt3 from hemagglutinin__InfluenzaA__ABI93094

SEQ ID NO: 123362 - RNA, 1701 nt, Artificial Sequence; identical to SEQ ID NO: 122666
  derived and/or modified sequence opt3 from hemagglutinin__InfluenzaA__ABI93105

SEQ ID NO: 123363 - RNA, 1701 nt, Artificial Sequence
  derived and/or modified sequence opt3 from hemagglutinin__InfluenzaA__ABI93116
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaugaggucgggaaagucuuccaucaugcggucagacgcaaguaucggcaaaugcaauagcgaauguauuacccccaacgguuccauaccuaaugacaagccauuucagaacgugaaucgcaucacguacggggccugcccccgauaugucaaacagaacacucuuaagcuggcuacaggaaugagaaauguuccugagaaacaaaccaggggcauuuucggcgccaucgcaggguuuauagaaaacggaugggaggguaugguggauggcugguacggguuccggcaccagaauagcgagggaacuggccaggcugccgacuugaagucuacacaagcggccauuaaccagaucaaugguaaacucaaccgucugaucgaaaagaccaaugagaaguuucaucagauugaaaaagaguucucagaaguagaggggcgcauccaggauuuagagaaguauguggaagacacgaaaauugaucuguggaguuacaacgcagagcuccuugucgcucuggaaaaccaacacaccauagacuugacagauuccgagaugaauaagcuauucgaaagaacuaaaaagcagcugagggagaacgccgaggacaugggcaauggauguuuuaagaucuaucauaaaugcgauaacgcuugcauuggcagcauccggaaugggaccuacgaccacggaguguaccgagaugaagcccucaacaaucgcuuccagaucaaggguguugagcugaaaucuggcuauaaggacuggauucuuuggauaucauuugcaaucaguuguuuccuguugugcgugguccuccugggguuuauuaugugggccugucagaaaggaaacaucagaugcaauauuuguaucuga

SEQ ID NO: 123364 - RNA, 1689 nt, Artificial Sequence
  derived and/or modified sequence opt3 from hemagglutinin__InfluenzaA__ABI94581
augaacacccagauccugguguucgcccucgucgcuagcauucccacaaaugcagacaagauaugccuuggccaccaugccguuuccaacgggacuaaagugaauacgcugaccgagagaggaguagaaguggucaacgcgacagagacuguggaaaggaccaauguuccucggaucuguucuaaggguaaacgcacaguggauuugggccaaugcggguuacugggaaccauuacuggcccaccgcagugugaccaguuucuagaguucucagcugaucucaucauugaacgacgugaggguagugacgucugcuaccccgggaaguuugugaacgaggaagcccugagacagauccuuagggagagcggaggcauagauaaagaaacaaugggcuucaccuauuccgggauccggacgaauggaacuaccucugcaugucgcagaucggguagcagcuuuuacgccgagaugaaguggcuguugaguaacacagacaaugcugcauucccucaaaugacuaaguccuauaaaaacaccaggaaggauccagcccucauuaucuggggcauucaccauucugggagcacaaccgagcagacgaaacuguacggauccggcaauaagcugaucacuguagguucaaguaacuaucagcagagcuuuguucccucuccuggggcucggccacaagugaauggacaguccggccgcauagacuuccacuggcucauuuuaaaccccaaugauacagucaccuuuucauucaacggcgccuuuaucgcgccugaccgagcaucauuccugagagggaaaaguauggguauucagucugaaguccagguggaugccaacugcgagggagacuguuaccauuccggcgggacuaucaucagcaaucuuccauuucaaaacauuaauucgagggcugugggaaagugcccgcgguauguuaagcaggaaucuuugcugcuagccacaggcaugaaaaacgugcccgagauaccuaagcgucgcagaaggggucucuucggggcaaucgcuggcuucauugaaaauggaugggagggccugaucgaugggugguacggauuucggcaccagaacgcccaaggugagggcaccgcggccgacuacaaauccacgcagucagcaauagaccagauuaccgggaaacuuaaucgacugaucgaaaagacaaaccagcaauucgaguugaucgauaaugaauuuacugagguagaaaagcagauuggaaacgugaucaauuggacccgcgacaguaugacagaggucuggagcuauaacgcugagcuccugguggccauggaaaaucagcacacuauugauuuagcugacuccgagaugaacaaacuguacgaaagaguuaagaggcagcuccgggagaaugccgaagaggauggcaccgguuguuucgagauauuucauaagugcgacgaugacuguauggcaucuauccgcaacaacacauaugaucacagcaaauacagagaagaggccauucaaaauaggauccagaucgacccagugaaacuuucaaguggguauaaggaugucauucugugguucuccuuuggcgcuagcugcuucauauugcuagcgaucgcaaugggacugguguuuauuugcguaaagaacggcaauaugcguuguaccaucugcauuuga

SEQ ID NO: 123365 - RNA, 1701 nt, Artificial Sequence; identical to SEQ ID NO: 122782
  derived and/or modified sequence opt3 from hemagglutinin__InfluenzaA__ABI95228

SEQ ID NO: 123366 - RNA, 1701 nt, Artificial Sequence
  derived and/or modified sequence opt3 from hemagglutinin__InfluenzaA__ABI95239
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucaauggcugguauggguuucgucaccagaacagcgagggaaucggccaggcagcugaccugaaguccacccaagccgcgauuaaucagauaaacgguaaauugaaccgccucaucgggaagacgaaugagaaguuccaccagauugaaaaagaguucucugaaguugagggcagaauccaggaucuggaaaaguacguggaggacaccaaaaucgauuuauggagcuauaacgccgagcugcucguagcacuugaaaaucaacauacaauugaccugacugauucagagaugaacaaguuguuugaaaggaccaaaaagcagcuacgggagaaugcugaagacaugggaaacggcugcuucaagauauaccacaaaugugauaaugccugcaucgggaguauucgaaacggaacauaugaccaugauguguaccgcgacgaggcucugaauaacagauuucagaucaagggugucgagcucaaauccggcuacaaggacuggauucuguggaucagcuucgccauaucuugcuuucuucuguguguggcauugcucggguucaucaugugggccugccagaaaggaaauauuagguguaacaucugcauuuga

SEQ ID NO: 123367 - RNA, 1698 nt, Artificial Sequence
  derived and/or modified sequence opt3 from hemagglutinin__InfluenzaA__ABI95250
augaaggccaaacugcucgugcuucugugcaccuucacagcuacuuacgcagacacgaucugugucggcuaucacgccaacaauagcaccgauacaguugacacuguguuggagaagaacguaaccgugacacauuccgucaauuuacuggaagauucucacaacgggaaacuaugccuccugaagggaauugcgccccuucagcuggguaauuguucaguggcuggcuggauauuggggaacccugagugcgaaagucucaucagcaaagaguccuggucuuacauuguugaaaccccaaauccggagaacggaacuuguuaucccggcuacuuugccgacuaugaggaacugagagagcaacugucgucagugagcaguuucgaaagguuugagaucuucccuaaggaguccucuuggccaaaucauacagucaccggugugagcgcauccugcucacacaacgggaagaguagcuuuuaccggaaucucuuauggcugacggagaaaaacggacuuuaucccaauuugucuaaguccuacguaaacaauaaagaaaaggaaguucuggugcuauggggcguccaucacccuucaaacauuggcgaucagcgcgccaucuaccacacugagaacgcuuaugugagcguggucaguucucauuacucccgacguuucaccccagaaauagcaaaaagacccaagguuagggggcaggagggacggaucaauuauuacuggacacuccuggagccuggugacacuauuaucuuugaagccaacggcaaucuuauugcuccaugguaugccuucgcgcugagccgcggguuuggaucgggcaucauaaccucuaacgcaccgaugaaugagugugaugccaagugccagacaccccaaggugcuauuaacuccucauugccuuuccagaaugugcacccaguaaccaucggggaaugucccaaauacgugagaagugccaagcucaggauggucacgggacugcggaacauuccuagcauccagucccgcggcuuauuuggcgcaaucgcuggguucauugagggagguuggacuggcaugauagacgggugguauggauaccaucaccagaaugaacaaggcucugguuacgccgcggaucagaaaagcacacagaacgccaucaaugggauuaccaacaagguaaauucaguuaucgagaaaaugaacacucaguuuacagcagugggcaaggaguucaauaaacuggaacgaagaauggagaaccucaacaagaaggucgacgauggauuccuugacauauggaccuauaaugcugaacuguuggugcuacuggagaacgaaaggacgcucgauuuucacgacaguaaugugaaaaaccuguacgagaagguuaaaucccaacuuaagaauaacgccaaagagauuggcaaugggugcuucgaauuuuaucauaaguguaacaaugagugcauggaaagcgugaagaacggaaccuacgacuauccaaaauacucugaggagucaaagcugaaucgggagaaaaucgauggugucaaguuggaaaguaugggcguguaucagauccucgcuauuuacagcacagucgccuccucucugguguuacugguuucgcuaggggcaaucagcuucuggaugugcuccaacggaucacuccagugucguauuugcauauga

SEQ ID NO: 123368 - RNA, 1698 nt, Artificial Sequence
  derived and/or modified sequence opt3 from hemagglutinin__InfluenzaA__ABI95261
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucagcgcauccugcucacacaacgggaagaguagcuuuuaccggaaucucuuauggcugacggagaaaaacggacuuuaucccaauuugucuaaguccuacgugaacaauaaagaaaaggaaguacugguucuauggggcgugcaucacccuucaaacaucggcguccagcgcgccauauaccacacugagaacgcuuaugugagcguggucaguucucauuacucccgacguuucaccccagaaaucgcaaaaagacccaagguuagggaucaggaggggcggauuaauuauuacuggacacuccuggagccuggagacacuaucauuuuugaagccaacgguaaucuuaucgcuccaugguaugccuucgcgcugagccgcggcuuugagucggggauaauuaccucuaacgcaccgaugaaugaaugugaugccaagugccagacaccccaaggagcuaucaacuccucauugccuuuccagaaugugcacccaguaaccauuggcgagugucccaaauacgugagaagugccaagcucaggauggucacgggucugcggaacaucccuagcauccagucccgcggguuauuuggagcaauugcuggcuucauagaaggcggguggacuggaaugaucgacgguugguauggcuaccaucaccagaaugagcaagggucuggauacgccgcggaucagaaaagcacacagaacgccauuaauggcaucaccaacaagguaaauucaguuauagagaaaaugaacacucaguuuacagcaguggguaaggaguucaauaaacuggaacgaagaauggaaaaccucaacaagaaggucgacgauggguuccuugacauuuggaccuauaaugcugagcuguuggugcuacuggaaaacgagaggacgcucgauuuucacgacaguaaugugaaaaaccuguacgagaagguuaaaucccaacuuaagaauaacgccaaagaaaucggcaauggaugcuucgaguuuuaucauaaguguaacaaugaaugcauggagagcgugaagaacggcaccuacgacuauccaaaauacucugaggaaucaaagcugaaucgggagaaaaucgauggggucaaguuggaaaguaugggaguguaucagauucucgcuaucuacagcacagucgccuccucucugguguuacugguuucgcuaggugcaauuagcuucuggaugugcuccaacggcucacuccagugucguauaugcaucuga

SEQ ID NO: 123369 - RNA, 1698 nt, Artificial Sequence; identical to SEQ ID NO: 123248
  derived and/or modified sequence opt3 from hemagglutinin__InfluenzaA__ABI95272

SEQ ID NO: 123370 - RNA, 1698 nt, Artificial Sequence; identical to SEQ ID NO: 123248
  derived and/or modified sequence opt3 from hemagglutinin__InfluenzaA__ABI95283

SEQ ID NO: 123371 - RNA, 1698 nt, Artificial Sequence; identical to SEQ ID NO: 122312
  derived and/or modified sequence opt3 from hemagglutinin__InfluenzaA__ABI95294

SEQ ID NO: 123372 - RNA, 1698 nt, Artificial Sequence
  derived and/or modified sequence opt3 from hemagglutinin__InfluenzaA__ABI96104
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuaccggaauuuacuguggcuuaccggcaaaaacggauuguaucccaaucugauaaagagcuacgccaacaauaaagaaaaggaggugcuaauccucuggggcguacaucacccuccaaacauuggggaucagcgcacgcuguaccacacugaaaacgcuuauguuucuguggucuccucacauuacagccgacguuucacccccgagaucacaaaaagaccuaaggugagggaccaggaaggacggauuaauuauuacuggacucuucuggagccaggugauaccaucauauuugaggcaaacggcaauuugauugccccgugguaugcuuucgcccucagucgcggguuuggaucuggcaucauuacauccaacgcgcccauggacgaaugugaugcaaagugccagaccccucaaggugccaucaauagcucgcugccauuccagaacgugcaccccgucacgaucggggaguguccuaaauacguuagaucugcuaaguuaaggauggugacuggacugcggaauauuccauccauacagucacgcggccucuuuggcgccaucgcaggguucauugaaggagguuggacaggcaugguagacgggugguauggauaccaucaccagaacgagcaaggcagugguuacgcugccgaucagaaaagcacccagaaugcgaucaacgggauaacuaauaaggugaacuccgucauugaaaagaugaauacacaguuuaccgccgugggcaaagaguucaacaaacuugagcgaagaauggaaaaucugaacaagaagguugacgauggauucuuggacaucuggacguauaacgcagagcuacuggugcuccuggaaaaugagaggacccuugacuuucacgauucuaacgucaaaaaucuguacgaaaaggugaaaagccaauugaagaacaaugcuaaagagaucggcaacgggugcuucgaguuuuaucauaaguguaauaacgaaugcauggagucaguaaagaauggaacauacgacuaucccaaauacagugaagaguccaagcucaaccgggagaaaauugaugguguuaagcuggacagcaugggcguguaucagaucuuagccauuuacucuacugucgcuucaagucuggugcuacucgucagccugggggccauauccuucuggaugugcucuaauggaucgcuucagugucguaucugcauuuga

SEQ ID NO: 123373 - RNA, 1701 nt, Artificial Sequence; identical to SEQ ID NO: 122666
  derived and/or modified sequence opt3 from hemagglutinin__InfluenzaA__ABJ09107

SEQ ID NO: 123374 - RNA, 1701 nt, Artificial Sequence
  derived and/or modified sequence opt3 from hemagglutinin__InfluenzaA__ABJ09140
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuauucuugcaagcgaggaagcgugaacuccuuuuucucacgucucaauugguuacacaaacuggaguacaaguauccagcacuuaacgucaccaugcccaauaacggcaaauuugacaaguuguacaucuggggcgugcaucacccuaguacggauagcgaccaaacuucucuguacguaagagccuccgggaggguuaccgugucaacaaaacggagccagcagacugucauuccaaauaucggauuccgccccugggugagaggucuaaguucuaggauuuccaucuauuggaccauagugaagccuggcgacauucuccugaucaacagcacagggaaccuuauugcuccacggggauacuuuaagauccgcaauggcaaaucgucuaucaugcgauccgaugccccgauugguaacuguucaagugagugcauaacccccaaugggagcaucccuaacgacaagccauuccagaaugucaacagaauuacguauggagcgugucccagguacguuaaacaaaauacucugaaguuggcaacaggcaugcggaacgugccugaaaaacagacccguggcaucuuuggggccauagcuggauucauugagaaugguugggaaggcaugguagaugggugguauggauuucgccaccagaacuccgagggcacuggucaggccgcagaccucaagucuacacaagcugccaucgaucagaucaaugggaaacugaacagauuaauugagaagaccaaugaaaaguuccaucagaucgagaaagaguucagcgaaguggaaggcaggauucaagaccuggagaaguacgucgaggauacgaaaauagaccucuggucauauaacgcgggacuucugguggccuuggaaaaucagcacaccaucgaucuaacagacagugagaugaacaagcuguuugaacggacucgaaaacagcuccgcgagaacgcagaagauaugggcaaugggugcuucaagauuuaccauaagugugacaacgcuugcaucggauccaucagaaaugguaccuacgaccacgauguuuauagggacgaggcccugaacaaucgguuucagauuaaaggcguggagcuuaagagcggguacaaagauuggauacuguggaucucuuucgcuauuucaugcuuuuugcucugugucgugcuguuaggauucaucaugugggccugccaaaagggcaacauucgcuguaauaucugcauauga

SEQ ID NO: 123375 - RNA, 1698 nt, Artificial Sequence
  derived and/or modified sequence opt3 from hemagglutinin__InfluenzaA__ABJ09151
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggggaaagagguacuuguucucuggggagugcaucacccuccaaacaucggugaucagcgcgcccuguaccacacugaaaacgcuuaugucuccguggugucaagccauuacagucgacguuucacccccgagauagcaaagagaccuaaagucagggaccaggaaggccggaucaauuauuacuggacacuucuggagccaggggauacuauuaucuuugaagccaacggaaauuugauugcuccgugguaugccuucgcgcucucucgcggcuuugguuccgggaucauaaccagcaacgcacccaugggagagugugacgccaagugccagacaccucaaggcgcuauuaauucgucucugccauuccagaacguucaccccgugaccaucggcgaguguccuaaguacguaagauccgccaaauuaaggauggugacggggcugcggaauauuccaucaauccagagucgcggacucuuuggugcaaucgcuggcuucauugaagggggauggacuggcauggucgaugguugguauggguaccaucaccagaacgagcaaggcagcggauacgccgcggaccagaaguccacacagaaugccauaaacggcaucaccaauaaagugaacucuguuauugaaaagaugaauacucaguuuacagcaguggggaaagaguucaacaagcuagaacgaagaauggagaaucugaacaaaaaggucgaugacggauucuuggauaucuggaccuauaacgcugagcuacuggugcuccuggaaaaugagaggacgcuugacuuucacgacagcaacguaaagaaucuguacgaaaaaguuaagucacaauugaaaaacaaugccaaggagauagguaacggcugcuucgaauuuuaucauaaauguaauaacgagugcauggagagugugaagaaugggaccuacgauuaucccaaguacuccaaagaaagcaagcucaaccgggagaaaauugacggagucaagcuggaaucuaugggcguguaucagaucuuagcuaucuacucaacagucgccaguagccuggugcuacucguuucccugggugcaauuucuuucuggaugugcucgaaugggagccuucagugucguaucugcauuuga

SEQ ID NO: 123376 - RNA, 1701 nt, Artificial Sequence
  derived and/or modified sequence opt3 from hemagglutinin__InfluenzaA__ABJ09162
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacaaauaacgaucagauuagcuuguaugcccaggcuucugggcguaucacuguguccaccaagagaucacaacagacaguaauuccaaauaucggaagcaggccccggguucgcgacauaccuaguagaauuucuaucuacuggaccauugugaaaccaggugauauccugcuaaucaacuccacgggcaaucucauugccccgaggggguacuuuaagauacggagcggaaagucgucuaucaugcgcuccgacgcgcccauuggcaaauguaacucagagugcaucacuccuaaugguaguauaccaaacgacaagcccuuccagaaugucaaccgaauuacauauggggcauguccuagauacgugaaacagaauacccugaaacuugccacuggaaugaggaacgugccagaaaagcaaacacggggcaucuuuggcgcuaucgccggguucauugagaauggaugggaagguauggucgauggcugguauggguuucgucaccagaacagcgagggaaucggccaggcagcugaccugaaguccacccaagccgcgauuaaucagauaaacgguaaauugaaccgccucaucgggaagacgaaugagaaguuccaccagauugaaaaagaguucucugaaguugagggcagaauccaggaucuggaaaaguacguggaggacaccaaaaucgauuuauggagcuauaacgccgagauucugguagcacucgaaaaucaacauacaauagaccuuacugauucagagaugaacaagcuguuugaaaggaccaaaaagcaguugcgggagaaugcugaagacaugggaaacggcugcuucaagaucuaccacaaaugugauaaugccugcauugggaguauccgaaacggaacauaugaccaugauguguaccgcgacgaggcucuaaauaacagauuucagauuaagggugucgagcugaaauccggcuacaaggacuggauccucuggaucagcuucgccauaucuugcuuucugcuuuguguggcacuguugggguucauuaugugggccugccagaaaggaaauaucagguguaacauuugcaucuga

SEQ ID NO: 123377 - RNA, 1701 nt, Artificial Sequence; identical to SEQ ID NO: 122259
  derived and/or modified sequence opt3 from hemagglutinin__InfluenzaA__ABJ09173

SEQ ID NO: 123378 - RNA, 1698 nt, Artificial Sequence
  derived and/or modified sequence opt3 from hemagglutinin__InfluenzaA__ABJ09184
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggaggccggugauacuauuaucuuugaggcuaacggcaauuugauugccccacgcuucgcguuugcacucucuagaggguucggauccggcaucauaaccagcaacgccccgauggacgaaugugaugcuaagugccagacaccccaaggugccauuaauucgucucugccuuuucagaacguucacccagugaccaucggggagugucccaaauauguaagguccgcaaaguuacggauggcuacgggacugcgcaauauuccuucaauccagagucgaggccucuucggcgccaucgcgggguuuauugaaggagguuggacuggcaugguggacgggugguacggauaucaucaccagaacgagcaaggcagcgguuacgccgcagaucagaaauccacacagaaugcuauaaacgggaucaccaauaaggucaacucugugauugaaaagaugaauacucaguucacagccguuggcaaagaguucagcaaacuugagagaaggauggaaaaccugaauaagaagguggacgauggauuuuuggacaucuggaccuacaacgcugagcuacugguccuccuggaaaacgagcggacgcuugacuuccacgauucaaaugugaaaaaccuguaugaaaagguaaaaagucaauugaagaauaacgccaaagagauaggcaaugggugcuuugaguucuaccauaaguguaacgacgaaugcauggaguccguuaagaauggaaccuaugauuacccaaaauauagcgaagagucuaagcucaaccgugagaaaauugacggugugaagcuggaaucaaugggcgucuaccagaucuuagcaaucuauaguacaguggccagcucccugguccuacucgugucucugggggcuauuucguuuuggaugugcagcaauggaucccuucagugucgcaucugcauuuga

SEQ ID NO: 123379 - RNA, 1701 nt, Artificial Sequence; identical to SEQ ID NO: 122649
  derived and/or modified sequence opt3 from hemagglutinin__InfluenzaA__ABJ09195

SEQ ID NO: 123380 - RNA, 1701 nt, Artificial Sequence; identical to SEQ ID NO: 122649
  derived and/or modified sequence opt3 from hemagglutinin__InfluenzaA__ABJ09206

SEQ ID NO: 123381 - RNA, 1701 nt, Artificial Sequence; identical to SEQ ID NO: 123229
  derived and/or modified sequence opt3 from hemagglutinin__InfluenzaA__ABJ09217

SEQ ID NO: 123382 - RNA, 1701 nt, Artificial Sequence; identical to SEQ ID NO: 122666
  derived and/or modified sequence opt3 from hemagglutinin__InfluenzaA__ABJ09228

SEQ ID NO: 123383 - RNA, 1701 nt, Artificial Sequence
  derived and/or modified sequence opt3 from hemagglutinin__InfluenzaA__ABJ09239
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcccuucugggagauccgcauugcgacggcuuucagaacaaagaaugggauuuguucguggagagauccaaggcuuauucuaauuguuaccccuaugacgucccugauuacgcaucgcucaggucacugguggccagcagugguacuauggaauuuaacaaugaguccuucaacuggacagggguugcucaaaauggaaccucuagcgcaugcaaacggcgcuccaacaagucauuuuucagucgacugaauuggcuccaccaguuaaaguauaaauacccagcccugaacgugacgaugcccaauaacgagaaguuugacaaacuuuauauauggggcguccaucacccuagcacugauucugaccagaucuccuuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucugcuaaucaauuguacaggcaaccucauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucugaagcuagcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgaccugaagucuacacaagcggccaucaaccagaucaaugguaaauugaaccgucucauugaaaagaccaaugagaaguuucaucagaucgaaaaagaguucucagaaguagaggggcgcauucaggaucuggagaaguauguggaagacacgaaaauagauuuauggaguuacaacgcagagcugcucgucgcucuugaaaaccaacacaccaucgaccugacagauuccgagaugaauaaguuguucgaaagaacuaaaaagcagcuaagggagaacgccgaggacaugggcaauggauguuuuaagauuuaucauaaaugcgauaacgcuugcaucggcagcauccggaaugggaccuacgaccacgauguguaccgagacgaagcccugaacaaucgcuuccagauuaagggaguugagcucaaaucugguuauaaggacuggauacuguggaucucauuugcaauuaguuguuuccuucugugcguggucuugcucggcuuuaucaugugggccugucagaaagggaacauuagaugcaauaucuguauauga

SEQ ID NO: 123384 - RNA, 1701 nt, Artificial Sequence
  derived and/or modified sequence opt3 from hemagglutinin__InfluenzaA__ABJ09250
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaauccaucacccuagcacugauucugaccagauuucccuguacgcucaggccucaggcagagucaccgugagcacaaagaggagucaacagacuguaaucccaaacauuggcucucggcccuggguucgcgggguguccagcagaaucucgauauacuggaccauugucaaaccuggagauauccuacucauuaauucuacagguaaccugaucgcgccaaggggcuauuucaagauccgguccgggaagucaaguauuaugcgcagcgacgcaccgauaggaaaauguaauuccgaaugcaucacccccaacggcucuauuccuaaugacaagccauuucagaacgugaaucgaaucacguacggugccugucccagauaugugaaacagaacacucuuaagcuggcuacagggaugaggaaugucccugagaaacaaacccggggaauauucggcgccauugcaggcuuuaucgaaaacgggugggagggaaugguugaugguugguacggcuuccgucaccagaauagcgaggggacuggacaggcugccgacuugaagucaacacaagcggccaucaaccagauuaauggcaaacucaaccgccugaucgaaaagaccaaugagaaguuucaucagauugaaaaagaguucagugaaguggaggguagaauacaggauuuagagaaguauguagaagacacgaaaaucgaucugugguccuacaacgcagagcuccuuguggcucuggaaaaccaacacaccauugacuugacagauagcgagaugaauaagcuauucgaaaggacuaaaaagcagcugcgggagaacgccgaggacauggggaauggcugcuuuaagaucuaucauaaaugugauaacgcuugcaucggaucuauucgaaaugaaaccuacgaccacgaugucuaccgcgacgaggcccucaacaauagauuccagauaaagggcguggaacugaaaucaggguauaaggacuggauccuuuggauuaguuuugcaaucagcugcuuccuguuguguguugugcuccugggauuuauuaugugggccugccagaaagguaacaucagguguaauauaugcaucuga

SEQ ID NO: 123385 - RNA, 1701 nt, Artificial Sequence
  derived and/or modified sequence opt3 from hemagglutinin__InfluenzaA__ABJ09261
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguaaaaucugcgacagcccacaccagauucucgauggcgagaauuguacccugaucgacgcucuacugggggauccgcauugcgacggauuucagaacaaggaaugggauuuguucguggagagauccaaagccuauucuaauuguuaccccuaugacgucccugauuacgcaucgcucaggucacugguggccagcaguggcacucuggaauuuaacaaugaguccuucaacuggacagguguugcucaaaaugggaccucuagcgcaugcaagcggcgcuccauaaagucauuuuucagucgacucaacugguuacaccagcugaaauauaaguacccagcccuuaaugugacgaugcccaacaaugagaaauuugacaaguuguauaucuggggaguccaucacccuagcacugauucugaccagaccucccuguacgcucaggccucaggccgugugacaguaagcacuaaaagaagucaacagaccguuauuccaaacaucggcucuaggcccugggugcgcggggucuccagccggauuucgaucuacuggacaauagugaagccuggagauauucuacucaucaacucuaccgguaaucugauugcgccaagaggcuauuucaagaucagguccgggaaaucaaguaucaugcggagcgacgcaccgauuggaaaguguaacuccgaaugcauaacgcccaauggcucuaucccuaacgacaaaccauuucagaaugugaaccgcauuacuuacggugccuguccccgauaugucaagcagaauacacuuaaacuggcuaccgggaugagaaacguuccugagaagcaaacuaggggaaucuucggcgccauagcaggcuuuauugaaaaugggugggagggaaugguggaugguugguacggcuuccggcaccagaacagcgaggggacaggacaggcugccgacuugaaaucaacccaagcggccaucaaucagaucaacggcaagcucaaucgucugauugaaaagacgaacgagaaauaucaucagaucgaaaaggaguuuagugaaguagagggucgcauucaggauuuagagaaauacguggaagacaccaagauagaucugugguccuauaaugcagagcuccuugucgcucuggaaaaccaacacacaaucgacuugacugauagcgagaugaacaaacuauucgaaagaaccaggaagcagcugcgggagaaugccgaggacauggggaacggcugcuucaagauuuaccauaaaugugauaaugcuugcaucggaucuauccgaaacggcacauacgaccacgauguguaucgcgacgaagcccucaauaacagauuucagauuaaggggguugagcugaaaucaggauacaaggacuggauacuuuggaucaguuucgcaauuagcugcuuucuguugugugugguccuccuggguuucaucaugugggccugccagaaaggcaauauuagguguaacaucugcauauga

SEQ ID NO: 123386 - RNA, 1701 nt, Artificial Sequence
  derived and/or modified sequence opt3 from hemagglutinin__InfluenzaA__ABJ09272
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcaauagcccacaccagauucucgacggcgagaacuguacccugaucgaugcucuacugggggacccgcauugcgauggauuucagaauaaagaaugggacuuguucguggagaggcggaaggccuauuccaacuguuaccccuaugaugucccugacuacgcaucucuccgcucgcugguggccucaagcggcacucuggaauuuaauaacgagaguuucaauuggacagguguugcucaaaacgggaccuccucugcaugcaaacgacguagcauaaaguccuuuuucucaagacucaauugguuacaccagcugaaguauaaauacccagcccuuaacgugacgaugcccaauaacgagaaguuugauaaauuguauaucuggggaguccaucacccuaguacugacagcgaucagauuucucuguacgcucaggccuccggcagggugaccguaucaacaaagcggagccaacagacuguuaucccaaacauuggcagucgccccugggugagaggggucucuuccaggaucagcauauacuggaccauugugaaaccuggagacauccuacucauuaauucgacagguaaccugaucgcgccacggggcuauuucaagauccgcucugggaaguccucaauuaugcgaagugaugcaccgauaggaaaauguaauagcgaaugcaucacccccaacggcuccauuccuaaugacaagccauuucagaacgugaauagaaucacguacggugccugucccagguaugucaaacagaacacucuuaagcuggcuacagggaugcggaauguuccugagaaacaaacccguggaauauucggcgccauugcaggcuuuaucgaaaacgggugggagggaaugguggacgguugguacggcuuccgccaccagaauagcgaggggacuggacaggcugccgauuugaagucuacacaagcggccaucaaccagauuaauggcaaacucaacagacugaucgaaaagaccaaugagaaguuucaucagauugaaaaagaguucucagaaguagaggguaggauacaggacuuagagaaggauguggaagacacgaaaaucgaucuguggaguuauaacgcagagcuccuugucgcucuggaaaaccaacacaccauugacuugacagauuccgagaugaauaagcuauucgaacggacuaaaaagcagcugcgagagaacgccgaggacauggggaauggcugcuuuaagaucuaccauaaaugugauaacgcuugcaucggaagcauucgcaauggcaccuaugaccacgauguguacagagacgaagcccucaacaauagguuccagauaaaggggguugagcugaaaucuggauacaaggacuggauccuuuggauuucauuugcaaucaguugcuuccuguugugugugguccuccuggguuuuauuaugugggccugccagaaaggcaacauccgguguaauauaugcaucuga

SEQ ID NO: 123387 - RNA, 1701 nt, Artificial Sequence; identical to SEQ ID NO: 122088
  derived and/or modified sequence opt3 from hemagglutinin__InfluenzaA__ABJ09294

SEQ ID NO: 123388 - RNA, 1701 nt, Artificial Sequence
  derived and/or modified sequence opt3 from hemagglutinin__InfluenzaA__ABJ09305
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugaaaagaccaaugagaaguuucaucagaucgaaaaagaguucagugaaguagaggguaggauucaggauuuagagaaguauguggaagacacgaaaauagaucugugguccuacaacgcagagcuccuugucgcucuggaaaaccaacacaccaucgacuugacagauagcgagaugaauaagcuauucgaaagaacuaaaaagcagcugcgggagaacgccgaggacauggggaauggcugcuuuaagauuuaucauaaaugugauaacgcuugcaucggaucuauccgaaaugaaaccuacgaccacgauguguaccgcgacgaggcccucaacaauagauuccagauuaagggcguugaacugaaaucaggguauaaggacuggauacuuuggaucaguuuugcaauuagcugcuuccuguugugugugguccuccugggauuuaucaugugggccugccagaaagguaacauuagguguaauaucugcauauga

SEQ ID NO: 123389 - RNA, 1701 nt, Artificial Sequence
  derived and/or modified sequence opt3 from hemagglutinin__InfluenzaA__ABJ09316
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcacugggugcgcggggucuccagcagaauuucgaucuacuggaccauagugaaacccggagauauucuacucaucaauucuacagguaaccugauugcgccuaggggcuauuucaagauccgguccgggaagucaaguaucaugcgcagcgacgcauccauuggaaaauguaauucugaaugcauaaccccaaacggcagcaucccgaaugacaagcccuuucagaacgugaaucgaauuacguacggugccuguccuagauaugucaaacagaacacucuuaagcuggcuacagggaugaggaauguuccagagaaacaaacccggggaaucuucggcgccauagcaggcuuuauugaaaacgggugggagggaaugguggaugguugguacggcuuccgucaucaaaauucagaggggacuggacaggcugccgacuugaagaguacacaggcggccaucaaccagaucaauggcaaacucaaccgccugauugaaaagaccaaugagaaguuucaccagaucgaaaaagaguucuccgaaguagaggguaggauucaggauuuagagaaguauguggaagacacgaaaauagaucuguggagcuacaacgcagagcuccuugucgcucuggaaaaccaacauaccaucgacuugacagauucugagaugaauaagcuauucgaaagaacuaaaaagcagcugcgggagaacgccgaggacauggggaauggcugcuuuaagauuuaucacaaaugugauaacgcuugcaucggaucaauccgaaauggcaccuacgaccacgauguguaccgcgacgaagcccucaacaauagauuccagauuaaggggguugagcugaaaaguggauauaaggacuggauacuuuggaucagcuuugcaauuuccugcuuccuguugugugugguccuccuggguuuuaucaugugggccugccagaaaggcaacauuagguguaauaucugcauauga

SEQ ID NO: 123390 - RNA, 1701 nt, Artificial Sequence; identical to SEQ ID NO: 122666
  derived and/or modified sequence opt3 from hemagglutinin__InfluenzaA__ABJ09338

SEQ ID NO: 123391 - RNA, 1701 nt, Artificial Sequence
  derived and/or modified sequence opt3 from hemagglutinin__InfluenzaA__ABJ09349
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuaauccagucuucaaguacagguggcauuugcgacagcccacaccagauccucgauggggagaauuguacccugauagacgcuuugcugggagauccgcauugcgacggcuuucagaacaaagaaugggauuuguucguagagagauccaaggccuauucuaauuguuaccccuaugacgugccugauuacgcaucgcucaggucacuggucgccagcagugguacucuggaauuuaacaaugaguccuucaacuggacagggguggcucaaaauggaaccucuagcgcaugcaaacggcgcuccaacaagucauuuuucagucgacucaauugguuacaccagcugaaguauaaauacccagcccuuaacguuacgaugcccaauaacgagaaguuugacaaauuguauaucuggggcgugcaucacccuagcacugauucugaccagauuucccuguacgcucaggccccaggccgugucaccgugucaacaaagagaagccaacagacuguaauccccaacauugggaguaggccuuggguucggggagugucuucccgcaucagcauauacuggaccauugucaaaccaggugauauccuacucauuaauuguacaggcaaccugaucgcgccgagaggguauuucaagaucaggucgggaaagucuuccauuaugcggucagacgcaaguauaggcaaaugcaauagcgaauguaucacccccaacgguuccauuccuaaugacaagccauuucagaacgugaaucgcaucacguacggggccugcccccgauaugugaaacagaacacucuuaagcuggcuacaggaaugagaaaugucccugagaaacaaaccaggggcauauucggcgccauugcaggguuuaucgaaaacggaugggaggguaugguugauggcugguacggguuccggcaccaaaauucugagggaacuggccaggcugccgaccuuaagagcacacaggcggccaucaaccagauuaaugguaaacucaaccgucugaucgaaaagaccaaugagaaguuucaucagauugaaaaagaguucucagaaguggaggggcgcauacaggauuuagagaaguauguagaagacacgaaaaucgaucuguggaguuacaacgcagagcuccuuguggcucuggaaaaccaacacaccauugacuugacagauuccgagaugaauaagcuauucgaaagaacuaaaaagcagcugagggagaacgccgaggacaugggcaauggauguuuuaagaucuaucauaaaugcgauaacgcuugcaucggcagcauucggaaugggaccuacgaccacgaugucuaccgagacgaagcccucaacaaucgcuuccagauaaagggaguggagcugaaaucugguuauaaggacuggauccuuuggauuucauuugcaaucaguuguuuccuguugugcguugugcuccugggcuuuauuaugugggccugucagaaagggaacaucagaugcaauauauguaucuga

SEQ ID NO: 123392 - RNA, 1701 nt, Artificial Sequence; identical to SEQ ID NO: 122666
  derived and/or modified sequence opt3 from hemagglutinin__InfluenzaA__ABJ09360

SEQ ID NO: 123393 - RNA, 1701 nt, Artificial Sequence
  derived and/or modified sequence opt3 from hemagglutinin__InfluenzaA__ABJ09371
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaagcuguacauuuggggcgugcaccauccuggcacauauaacgaucagaucucuuuguacgcccaggcuuccgggcguauuacugucucaaccaaaagaagccaacagacagugaucccaaauauaggaaguaggcugcggguacgcgacauucccucuagaaucuccauuuacuggaccaucguuaagccuggugauauccuacucauuaacagcacgggcaaucugauagccccaaggggguauuuuaaaauccggucgggaaagucuuccauuaugcgcucagacgcgccgaucggcaaguguaacagugaaugcauaacucccaaugguagcauuccuaacgacaaaccauuccagaaugugaaccgaaucacauacggggcaugucccagauaugucaagcagaauacccuuaaacuggccacuggaaugaggaacgugccugagaagcaaacacggggcaucuuuggcgcuauugccggguucaucgaaaauggaugggaggguaugguggauggcugguacggguuucgucaccagaacuccgagggaauuggccaggcagcugacuugaaaucuacccaagccgcgauagaucagaucaaugguaagcucaaccgccugauugggaaaacgaaugaaaaguuccaccagaucgagaaggaauuuagcgaggucgaaggcagaauccaggacuuagagaaauauguugaggauaccaagauugaccuguggucauacaacgccgaacuccuuguggcacuggagaaccaacauacaauagauuugacugacagugaaaugaauaaacuauuugagaggaccaagaaacagcugcgggaaaacgcugaggauaugggaaauggcugcuucaagaucuaucacaagugugacaacgccugcauuggguccauccgaaauggaacauacgaucaugacguauaccgcgacgaggcucucaacaauagauuucagauuaaagguguggaacuuaagagcggcuauaaagauuggauccuuuggauaucuuucgccaucucaugcuuucuguugugugucgcacuccugggguucauuaugugggccugccagaagggaaacaucagguguaauauuugcaucuga

SEQ ID NO: 123394 - RNA, 1701 nt, Artificial Sequence; identical to SEQ ID NO: 122649
  derived and/or modified sequence opt3 from hemagglutinin__InfluenzaA__ABJ09382

SEQ ID NO: 123395 - RNA, 1701 nt, Artificial Sequence
  derived and/or modified sequence opt3 from hemagglutinin__InfluenzaA__ABJ16587
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacaccagauucuagauggcgagaauuguacccucaucgacgcucugcuuggggauccgcauugcgacggauuucagaacaaagaaugggaucuguucguggagaggucuaaggccuauucgaauuguuaccccuaugacgucccugauuacgcaucauugcggagccucguggccaguuccggcacucuggaauuuaacaaugagucuuucaacuggacagguguugcucaaaaugggaccagcuccgcaugcaaacgccgaucaauaaagaguuucuucagccgucugaacuggcuccaccaguuaaaguauagauacccagcccugaaugugacgaugcccaacaaugacaaauuugauaaacuuuauaucuggggaguccaucacccuucuacugacuccgaucagaccucauuguacgcucaggccagcggcagggugacaguaaguacuaagcggucucaacagaccguuauuccaaacaucggcucccgccccugggugagaggggucagcucgaggauuucuaucuacuggacaauagugaagccuggagacauucugcuaaucaacuccaccgguaaucucauugcgccacggggcuauuucaaaauccgcucagggaagaguagcaucaugcgauccgacgcaccgauuggaaaguguaacucugagugcauaacgcccaauggcagcaucccuaacgauaaaccauuucagaaugugaacagaauuacuuacggugccugucccagguaugucaagcagaauacacugaaacuugcuaccgggaugcggaacguuccugaaaagcaaacucguggaaucuucggcgccauagcaggcuuuauugagaaugggugggaaggaaugauggacgguugguacggcuuccgccaccagaacucagaggggacaggacaggcugccgaucugaaaaguacccaagcggccaucaaucagaucaacggcaaguugaauagacucauugagaaaacgaacgaaaaguuucaucagaucgagaaggaauuuuccgagguggaagguaggauucaggaccuggagaaauauguagaggauaccaagauagacuuauggagcuacaaugcagaacugcucguggcucuugagaaccaacacacaaucgaucugacugacucugaaaugaacaaauuguucgagcggacccgaaagcagcuacgcgaaaaugccgaggauauggggaacggcugcuuuaaaauuuaucauaagugugacaaugcuugcaucggaucaaucagaaacggcacauacgaucacgacgucuacagggacgaggcccugaauaaccgguuccagauuaaggggguggaacucaaaaguggauauaaggauuggauacuguggaucagcuuugcaauuuccugcuuccuucuguguguuguguugcucgguuuuaucaugugggccugccagaaaggcaauauucgcuguaacaucugcauauga

SEQ ID NO: 123396 - RNA, 1701 nt, Artificial Sequence
  derived and/or modified sequence opt3 from hemagglutinin__InfluenzaA__ABJ16598
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcaauagcccacaccagauucucgacggcgagaacuguacccugaucgaugcucuacugggggacccgcauugcgauggauuucagaauaaagaaugggacuuguucguggagagguccaaggccuauucuaacuguuaccccuaugaugucccugacuacgcaucgcuccggucacugguggccagcaguggcacucuggaauuuaauaacgaguccuucaauuggacagguguugcucaaaacgggaccucuagcgcaugcaaacgccgauccauaaagucauuuuucagucgucucaauugguuacaccagcugaaguauaaauacccagcccuuaacgugacgaugcccaauaacgagaaguuugauaaauuguauaucuggggaguccaucacccuagcacugacucugaucagauuucccuguacgcucaggccucaggcagagugaccguaagcacaaagaggagucaacagacuguuaucccaaacauuggcucucggcccugggugcgcggggucuccagcagaaucucgauauacuggaccauugugaaaccuggagacauccuacucauuaauucuacagguaaccugaucgcgccaaggggcuauuucaagauccgguccgggaagucaaguauuaugcgcagcgaugcaccgauaggaaaauguaauuccgaaugcaucacccccaacggcucuauuccuaaugacaagccauuucagaacgugaaucgaaucacguacggugccugucccagauaugucaaacagaacacucuuaagcuggcuacagggaugaggaauguuccugagaaacaaacccggggaauauucggcgccauugcaggcuuuaucgaaaacgggugggagggaaugguggacgguugguacggcuuccgucaccagaauagcgaggggacuggacaggcugccgauuugaagucaacacaagcggccaucaaccagauuaauggcaaacucaaccgccugaucgaaaagaccaaugagaaguuucaucagauugaaaaagaguucagugaaguagaggguagaauacaggacuuagagaaguauguggaagauacgaaaaucgaccugugguccuacaacgcagagcuccuugucgcucuggaaaaccaacacaccauugauuugacagacagcgagaugaauaagcuauucgaaaggacuaaaaagcagcugcgggagaacgccgaggauauggggaauggcugcuuuaagaucuaucauaaaugugacaacgcuugcaucggaucuauucgaaauggcaccuacgaucacgacguguaccgcgaugaagcccucaacaauagauuccagauaaaggggguugagcugaaaucaggauauaaggacuggauccuuuggauuaguuuugcaaucagcugcuuccuguugugugugguccuccuggguuuuauuaugugggccugccagaaaggcaacaucagguguaauauaugcaucuga

SEQ ID NO: 123397 - RNA, 1701 nt, Artificial Sequence
  derived and/or modified sequence opt3 from hemagglutinin__InfluenzaA__ABJ16620
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcaauagcccacaccagauucucgacggcgagaacuguacccugaucgaugcccuucugggggacccgcauugcgauggauuucagaauaaagaaugggacuuguucguggagaggaacaaggcuuauuccaauuguuaccccuaugaugucccugacuacgcaucucuccggucgcugguggccucaagcggcacucuggaauuuaacaaugagaguuucaacuggacagguguugcucaaaaugggaccuccucugcaugcaaacgccgaagcauaaaguccuuuuucucacgucucaacugguuacaccagcugaaguauaaauacccagcccuuaaugugacgaugcccaacaacgagaaguuugauaaauuguauaucuggggaguccaucacccuaguacugacagcgaucagauuucucuguacgcucaggccuccggcagagugaccguaucaacaaagaggagccaacagacuguuaucccaaauauuggcagucggcccugggugcgcggggucucuuccagaaucagcauauacuggaccauugugaaaccuggagacauccuacucauuaacucgacagguaaucugaucgcgccaaggggcuauuucaagauccggucugggaaguccucaauuaugcgcagugaugcaccgauaggaaaauguaacagcgaaugcaucacccccaauggcuccauuccuaacgacaagccauuucagaaugugaaccgaaucacguacggugccugucccagauaugucaaacagaauacucuuaagcuggcuacagggaugaggaacguuccugagaaacaaacccggggaauauucggcgccauugcaggcuuuaucgaaaaugggugggagggaaugguggacgguugguacggcuuccgucaccagaacucugaggggacuggacaggcugccgaucuaaagagcacacaagcggccaucaaucagauuaacggcaaacucaaucgccugaucgaaaagaccaacaagaaauuucaucagauugagaaggaguucucagaaguagaagguagaauacaggacuuagagaaauauguggaggauacgaagaucgaccuguggaguuacaacgcagaacuccuugucgcucuggagaaucaacacaccauugauuugacagacuccgaaaugaacaaacuauucgagaggacuaagaagcagcugcgggaaaaugccgaggauauggggaacggcugcuuuaaaaucuaucauaagugugacaaugcuugcaucggaagcauucgaaacggcaccuacgaucacgacguguaccgcgaugaggcccucaauaacagauuccagauaaaagggguugaacugaagucuggauauaaagacuggauccuuuggauuucauuugcaaucaguugcuuccuguugugugugguccuccuggguuuuauuaugugggccugccagaagggcaauaucagguguaacauaugcaucuga

SEQ ID NO: 123398 - RNA, 1701 nt, Artificial Sequence
  derived and/or modified sequence opt3 from hemagglutinin__InfluenzaA__ABJ16631
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggguacgcgacauuccuucuagaaucuccauuuacuggaccaucguuaagccaggugauauccugcuaauuaacagcacgggcaaucucauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccugaaacuugccacuggaaugaggaacgugccagagaagcaaacacggggcaucuuuggcgcuauugccggguucaucgaaaauggaugggaggguaugguggauggcugguacggguuucgucaccagaacuccgagggaauuggccaggcagcugaccugaaaucuacccaagccgcgauagaucagaucaaugguaaguugaaccgccucauugggaaaacgaaugaaaaguuccaccagaucgagaaggaauuuagcgaggucgaaggcagaauccaggaccuggagaaauauguugaggauaccaagauugacuuauggucauacaacgccgaacugcucguggcacuugagaaccaacauacaauagaucugacugacagugaaaugaauaaauuguuugagaagaccaaaaagcagcuaagggaaaacgcugaggauaugggaaauggcugcuucaagaucuaucacaaaugugacaacgccugcauuggguccauccggaauggaacauacgaucaugacguauaccgagacgaggcucugaacaaucgcuuucagauuaaggguguggaacucaaaagcggcuauaaggauuggauccuguggauaucuuucgccaucucaugcuuucuucugugugucgcauugcucggguucauuaugugggccugccagaaaggaaacaucagauguaauauuugcaucuga

SEQ ID NO: 123399 - RNA, 1698 nt, Artificial Sequence
  derived and/or modified sequence opt3 from hemagglutinin__InfluenzaA__ABJ16664
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggccauuuugcugacuacgaggaacugagagagcaacucucuucggugagcucauucgaaagguuugagauuuucccuaaggagaguuccuggccaaaucacacagucaccggugugucugccagcugcucccauaacgggaagucaaguuuuuaucggaauuuacuguggcuuacgggcaaaaacggauuguaccccaaucugagcaagucuuaugcaaacaauaaagaaaaggagguucuaguacucuggggcgugcaccacccuccaaacaucggggaucagcgcgcccuguaccauacugaaaacgcuuacgucuccguggugucaagccacuauagucgacguuucacccccgagauagcaaaaagaccuaaggucagggaccaggaaggacggaucaauuacuauuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaucccgugaccaucggggaguguccuaaauacguaagguccgccaaguuacggauggugacgggacugcgcaauauuccaucaauccagagucgaggccucuucggcgcaaucgcuggguuuauugaaggagguuggacuggcauggucgacgggugguauggauaccaccaccagaacgagcaaggcagcgguuaugccgcggaucagaaauccacacagaaugccauaaacgggaucaccaauaaggugaacucuguuauugaaaagaugaauacucaguucacagcagugggcaaagaguucaacaaacuugagagaaggauggaaaaucugaacaagaaggucgacgauggauuuuuggacaucuggaccuacaacgcugagcuacuggugcuccuggaaaaugagcggacgcuugacuuccaugauagcaacguuaaaaaucuguacgaaaagguaaaaucacaauugaagaacaaugccaaagagauaggcaacgggugcuuugaguucuaucacaaguguaaugacgaaugcauggagagugugaagaacggaaccuacgauuaucccaaauacuccgaagagagcaagcucaaucgugagcgcauugacggugucaaacuggaaucuaugggcguguaucagaucuuagcuaucuacucaacagucgccaguagccuggugcuacucguuucccugggggcaauuucuuuuuggaugugcucgaacggaagccuucaguguagaaucugcauuuga

SEQ ID NO: 123400 - RNA, 1698 nt, Artificial Sequence; identical to SEQ ID NO: 123220
  derived and/or modified sequence opt3 from hemagglutinin__InfluenzaA__ABJ16675

SEQ ID NO: 123401 - RNA, 1698 nt, Artificial Sequence
  derived and/or modified sequence opt3 from hemagglutinin__InfluenzaA__ABJ16686
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccgccaaguuacggauggcaacgggacugcgcaauauuccaucaauccagagucgaggccucuucggcgcuaucgccggguuuauugaaggagguuggacuggcaugguggacgggugguacggauaucaucaccagaacgagcaaggcagcgguuacgcggccgaucagaaauccacacagaaugcaauaaacgggaucaccaauaaggucaacucugugauugaaaagaugaauacucaguucacagcuguuggcaaagaguucagcaaacuugagagaaggauggaaaaccugaauaagaagguggacgauggauuuuuggacaucuggaccuacaacgccgagcuacugguccuccuggaaaacgagcggacgcuugacuuccacgauucaaaugugaaaaaccuguaugaaaagguaaaaagucaauugaagaauaacgcuaaagagauaggcaaugggugcuuugaguucuaccauaaguguaacgacgaaugcauggaguccguuaagaauggaaccuaugauuaccccaaauauagcgaagagucuaagcucaaccgugagaaaauugacggugugaagcuggaaucaaugggcgucuaccagaucuuagccaucuauaguacaguggcaagcucccugguccuacucgugucucugggggccauuucguuuuggaugugcagcaauggaucccuucagugucgcaucugcauuuga

SEQ ID NO: 123402 - RNA, 1701 nt, Artificial Sequence
  derived and/or modified sequence opt3 from hemagglutinin__InfluenzaA__ABJ16697
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucuacacaagcggccaucaaccagaucaaugguaaacucaaccgucugauugaaaagaccaaugagaaguuucaucagaucgaaaaagaguucucagaaguagaggggcgcauucaggauuuagagaaguauguggaagacacgaaaauagaucuguggaguuacaacgcagagcuccuugucgcucuggaaaaccaacacaccaucgacuugacagauuccgagaugaauaagcuauucgaaagaacuaaaaagcagcugagggagaacgccgaggacaugggcaauggauguuuuaagauuuaucauaaaugcgauaacgcuugcaucggcagcauccggaaugggaccuacgaccacgauguguaccgagacgaagcccucaacaaucgcuuccagauuaagggaguugagcugaaaucugguuauaaggacuggauacuuuggaucucauuugcaauuaguuguuuccuguugugcgccgugcuccugggcuuuaucaugugggcuugucagaaagggaacauuagaugcaauaucuguauauga

SEQ ID NO: 123403 - RNA, 1701 nt, Artificial Sequence
  derived and/or modified sequence opt3 from hemagglutinin__InfluenzaA__ABJ16730
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucaauagccggcuggauccuggggaacccugagugcgaaaguuuguuuagcaaagaguccuggucuuacauugcagaaaccccaaauccgaagaacggaacuuguuaucccggcuacuucgccgacuaugaggagcucagggaacaacugucgucagucagcaguuuugagcgguucgaaaucuuuccuaaggauuccucuuggccaaaucauacagugaccaaagguguuacggcuagcugcucccacaacgggaagucaaguuucuacaaaaaucugcucugguuaacugagaagaacggacuguaucccaaucuuagcaaaucuuacgugaacaagaagggcaaagaggucuuggugcuguggggcguacaucacccuuccaauaugggggaccagcgcgcaauuuaccacaaggaaaacgccuauguuucagugcuaagcagucauuacucucgacguuuuaccccagagaucgcuagaaggcccaaaguccgggaucaggaaggacgcauaaacuauuacuggacacuccuggagccuggugacacuaucauuuucgaagccaauggcaaccuuaucgcgccaugguaugcauuugcccuguccagaggguucggaagcggcauuaucauaucgaaugcuucuaugggugagugugaugccaagugccagaccccgcaaggggcaauuaacuccucauugcccuuucagaaugugcacccugugacaaucggagaguguccaaaauacgucaggaguaccaagcuccggaugguuacgggccugcgcaacgugcccagcauucagucccgaggcuuauucggggcuaucgccggauuuaucgaagguggcuggacugggaugauugacggaugguauggcuaccaucaccagaaugagcaagguucuggguacgcggccgaucagaaaagcacacagaacgcaauaaauggcaucaccaacaagguaaauucaauuaucgaaaagaugaacacucaguucacagcugugggaaaagaguucaauaagcuggaaagaaggauggagaaccucaauaaaaaggucgacgauggcuuucuugacauauggaccuauaacgccgagcuguuggugcuacuggaaaacgagcggacgcucgacuuccacgauaguaauguuaaaaaccuguacgaaaaggugaagaaucaacuuaaaaacaaugcuaaggagauugggaacggaugcuuugaguucuaucauaaauguaauaacgaaugcauggaguccgucaagaaugguaccuacgacuauccuaaauacagcaaggaaucuaagcugaaccgugagaaaaucgauggcgugaaguuggaaucaauggggguauaucagauccucgccauuuacaguacaguugcaagcucccugguguuacuggucucucuaggagccaucucguuuuggaugugcagcaauggcucccuccagugucgcauuugcauauga

SEQ ID NO: 123404 - RNA, 1701 nt, Artificial Sequence
  derived and/or modified sequence opt3 from hemagglutinin__InfluenzaA__ABJ16741
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagggcuuuuucucacgacucaauugguuacaccagcugaaguauaaauacccagcccuuaacgugacgaugcccaauaacgagaaguuugacaaauuguauauauggggcguccaucacccuaguacugauagcgaccagaucucucuguacgcucaggccccagggcgugugaccguauccacaaagagaucacaacagacuguuauucccaacaucggaagcaggccuugggugcggggugucaguucuauuaucuccauauacuggaccauugugaaaccaggcgauauccuacucauuaauuguacagggaaccugaucgcgccgcgcggauauuucaagaucagaagcggcaagucgucuauuaugagguccgacgcaucaauagguaaaugcaauagugaauguaucacccccaacgggagcauuccuaaugacaagccauuucagaacgugaaucggaucacguacggagccugcccccgcuaugucaaacagaacacucuuaagcuggcuacaggcaugcgaaauguuccugagaaacaaaccagaggcauauucggggccauugcaggauuuaucgaaaacgguugggagggcaugguggaugggugguacggauucaggcaccaaaauuccgagggcacuggucaggcugccgacuugaagucuacacaggcggccaucaaccagauuaaugggaaacucaaccggcugaucggcaagaccaaugaaaaguuucaucagauugagaaagaguucagcgaaguagaaggacguauacaggauuuagagaaguauguggaggacacgaaaaucgaucuguggucauacaacgcagaacuccuugucgcucuggagaaccaacacaccauugacuugacagauagugaaaugaauaagcuauucgagcgcacuaaaaagcagcugagagaaaacgccgaggacaugggcaauggguguuuuaagaucuaucauaaaugcgauaacgcuugcaucggauccauuaggaaugguaccuacgaccacgauguguaccgggacgaggcccucaacaaucgauuccagauaaagggcguugaacugaaaagcggguauaaggacuggauccuuuggauuucuuuugcaaucucauguuuccuguugugcgugguccuccugggauuuauuaugugggccugucagaaaggcaacauccgcugcaauauauguaucuga

SEQ ID NO: 123405 - RNA, 1701 nt, Artificial Sequence
  derived and/or modified sequence opt3 from hemagglutinin__InfluenzaA__ABJ16752
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuuccgguauuagcaucuacuggaccauagugaaaccaggcgauauucuacucaucaauuguacagggaaccugauugcgccgcgcggauauuucaagaucagaucgggcaagucuuccaucaugaggucagacgcaaguauugguaaaugcaauagcgaauguauaacccccaacggguccaucccuaaugacaagccauuucagaacgugaaucggauuacguacggagccugcccccgcuaugucaaacagaacacucuuaagcuggcuacaggcaugcgaaauguuccugagaaacaaaccagaggcaucuucggggccauagcaggauuuauugaaaacgguugggagggcaugguggaugggugguacggauucaggcaccagaauagcgagggcacuggucaggcugccgacuugaagucuacacaagcggccaucaaccagaucaaugggaaacucaaccggcugauugaaaagaccaaugagaaguuucaucagaucgaaaaagaguucucagaaguagagggccguauucaggauuuagagaaguauguggaagacacgaaaauagaucuguggaguuacaacgcagagcuccuugucgcucuggaaaaccaacacaccaucgacuugacagauuccgagaugaauaagcuauucgaacgcacuaaaaagcagcugagagagaacgccgaggacaugggaaauggcuguuuuaagauuuaucauaaaugcgauaacgcuugcaucgggagcaucaggaauggaaccuacgaccacgauguguaccgggacgaagcccucaacaaucgauuccagauuaaggguguugagcugaaaucuggcuauaaggacuggauacuuuggaucucauuugcaauuaguuguuuccuguugugcgugguccuccugggguuuaucaugugggccugucagaaaggaaacauucgcugcaauaucuguauauga

SEQ ID NO: 123406 - RNA, 1701 nt, Artificial Sequence
  derived and/or modified sequence opt3 from hemagglutinin__InfluenzaA__ABJ16763
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggcacugggugcggggagucucuucccgcauuagcaucuacuggaccauagugaaaccuggugauauucuacucaucaauuguacaggcaaccugauugcgccaagaggguauuucaagaucaggucgggaaagucuuccaucaugcggucagacgcaaguauuggcaaaugcaauagcgaauguauaaccccgaacgguuccauccccaaugacaagccuuuucagaacgugaaucgcauuacguacggggccugcccacgauaugucaaacagaacacucuuaagcuggcuacaggaaugagaaauguucccgagaaacaaaccaggggcaucuucggcgccauagcaggguuuauugaaaacggaugggaggguaugguggauggcugguacggguuccggcaucagaauagcgagggaacuggccaggcugccgacuugaagucuacacaagcggccaucaaccagaucaaugguaaacucaaccgucugauugaaaagaccaaugagaaguuucaccagaucgaaaaagaguucucagaaguagaggggcgcauucaggauuuagagaaguauguggaagacacgaaaauagaucuguggaguuacaacgcagagcuccuugucgcucuggaaaaccaacauaccaucgacuugacagauuccgagaugaauaagcuauucgaaagaacuaaaaagcagcugagggagaacgccgaggacaugggcaauggauguuuuaagauuuaucacaaaugcgauaacgcuugcaucggcagcauccggaaugggaccuacgaccacgauguguaccgagacgaagcccucaacaaucgcuuccagauuaagggaguugagcugaaaucugguuauaaggacuggauacuuuggaucucauuugcaauuaguuguuuccuguugugcgugguccuccugggcuuuaucaugugggccugucagaaagggaacauuagaugcaauaucuguauauga

SEQ ID NO: 123407 - RNA, 1701 nt, Artificial Sequence
  derived and/or modified sequence opt3 from hemagglutinin__InfluenzaA__ABJ16774
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaccaacaggaagaaucugcgacaguccgcaucagauucucgauggugagaauuguacccugaucgacgcucuacugggcgauccccacugcgacggguuucagaacaaagaaugggauuuguucgucgagaggagcacugccuauuccaauuguuacccuuaugacgugccagauuacgcaucucuccggucgcugguugccucaagcggaacacuggaauuuaacaaugagaguuucaacuggaccggcguggcucagaaugguacguccucugcaugcaagcgccgaagcauaaaauccuuuuucucacgucucaacugguuacaucaacugaaguauaaguaccccgcccuuaaugucacuaugccuaacaaugagaaauuugacaaguuguauaucuggggagugcaccacccaaguaccgauagcgaccagauuucucuguacgcucaggccuccgggagaguaacaguuucaacuaaaaggagccagcaaaccgugauccccaacauuggcaguggcccuuggguccgcggggugucuucccggaucagcauauacuggacaauugugaagccaggagauauccuacucauuaacucgaccgguaaucugaucgcgccgagaggcuauuucaaaaucaggaacgggaagucuuccauuaugcggucaaauacgcccauaggaaaguguaacagugaaugcaucacuccuaauggcagcauuccaaacgacaaacccuuucagaaugucaaccgcaucacauacggugcauguccucgauauguuaagcagaauacccuuaaacuggccacugggaugagaaacgugccagagaagcagacaaggggaauauucggcgcuauugccggcuuuaucgaaaaugggugggagggaaugguagacgguugguacggcuuccggcaucaaaacuccgaggggaccggacaggcagcugauuugaaaucuacgcaggccgcgaucaaucaaauuaacggcaagcucaaucgucugaucgagaaaaccaacgaaaaguuucaccagauugaaaaggaguucagcgaaguggagggucgcauacaggacuuagagaaauaugucgaagauacaaagaucgaccuguggucauacaacgccgagcuccuuguggcacuggaaaaucagcauacuauugauuugaccgacagugagaugaacaaacuauucgaaagaacaaggaagcaacugcgggagaaugcugaggauauggggaacggcugcuuuaaaaucuaucacaagugugacaaugccugcaucggauccauucgaaacggcacuuacgaucacgacguuuaccgcgaugaagcucucaauaacagauuccagauaaaggggguggagcugaaaagcggauauaaggacuggauccuuuggauuucuuuugccaucucaugcuuccuguugugugucgugcuccuggguuuuauuaugugggcaugccagaaaggcaauaucagguguaacauaugcaucuga

SEQ ID NO: 123408 - RNA, 1701 nt, Artificial Sequence
  derived and/or modified sequence opt3 from hemagglutinin__InfluenzaA__ABJ16785
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuuaugcaugcaaacggcgcagcaacaaguccuuuuucucacgacucaauugguuacaccagcugaaguacaaauauccagcccuuaacgugacgaugcccaauaacgagaaguuugacaaauuguacauauggggcguccaucacccuaguacugauagcgaccagaucucucuguacgcucaggccccaggccgugugaccguauccacaaagagaucacaacagacuguuauucccaacaucgggagcaggccuugggugcggggagucaguucucgcauuuccaucuauuggaccauagugaaaccaggugauauucuacucaucaauuguacaggcaaccugauugcgccgagaggguacuucaagaucaggagcggaaagucgucuaucaugcgguccgacgcaucaauuggcaaaugcaauagugaauguauaacccccaacgguagcaucccuaaugacaagccauuucagaacgugaaucgcauuacguauggggccugcccccgauacgucaaacagaacacucuuaagcuggcuacaggaaugagaaauguuccugagaaacaaaccaggggcaucuucggcgccauagcaggguuuauugaaaacggaugggaggguaugguggauggcugguauggguuccggcaccaaaauuccgagggaacuggccaggcugccgacuugaagucuacacaggcggccaucaaccagaucaaugguaaacucaaccgucugauugaaaagaccaaugagaaguuucaucagaucgaaaaagaguucagcgaaguagaggggcgcauucaggauuuagagaaguacguggaagacacgaaaauagaucuguggucauauaacgcagagcuccuugucgcucuggaaaaccaacacaccaucgacuugacagauagugagaugaauaagcuauucgaaagaacuaaaaagcagcugagggagaacgccgaggacaugggcaauggauguuuuaagauuuaccauaaaugcgauaacgcuugcaucggcuccauccggaaugggaccuacgaccacgauguguaucgagacgaagcccucaacaaucgcuuccagauuaagggaguugagcugaaaagcgguuacaaggacuggauacuuuggaucucuuuugcaauuucauguuuccuguugugcgugguccuccugggcuuuaucaugugggccugucagaaagggaacauuagaugcaauaucuguauauga

SEQ ID NO: 123409 - RNA, 1701 nt, Artificial Sequence; identical to SEQ ID NO: 122926
  derived and/or modified sequence opt3 from hemagglutinin__InfluenzaA__ABJ53438

SEQ ID NO: 123410 - RNA, 1698 nt, Artificial Sequence; identical to SEQ ID NO: 122758
  derived and/or modified sequence opt3 from hemagglutinin__InfluenzaA__ABJ53449

SEQ ID NO: 123411 - RNA, 1701 nt, Artificial Sequence
  derived and/or modified sequence opt3 from hemagglutinin__InfluenzaA__ABJ53471
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacagguggcaucugcgacagcccacaccagauacuggauggggagaauuguacccuaaucgacgcucuccugggagauccgcagugcgacggcuuucaaaacaaaaagugggaucuuuucguggaaagauccaaagccuauucuaauuguuaccccuaugacgucccugauuacgcaucgcugaggucauugguggccagcagugguacucucgaguuuaacaaugaauccuucaacuggacagggguuacccagaauggaacgucuagcgcuugcaagcggggcuccaacaauucauuuuucagucgccugaacuggcugacucaucucaaguuuaaauauccagcauuaaaugugaccaugcccaacaacgagaaguucgacaaacuguacauuuggggcguccaccauccugggacagauaaugaccagaucuuucuuuaugcccaggcuagcggacgaauuacugugucuaccaagcguucccaacagacaguaaucccaaacauagguucaagacccaggguucggaauauuccuagccgcaucaguauuuacuggaccaucgugaaaccaggcgauaucuugcugauuaacucuacggggaaucuaauagccccgagaggauacuucaagaucagguccggcaagagcucgauuaugcggucugacgcgcccaucgguaaauguaacuccgagugcauaacuccuaaugggucaauuccaaacgacaagcccuuucagaaugucaaccgcaucacauauggagcauguccucgauacgugaaacagaauacccucaagcuggccacuggcaugagaaacgugccagaaaaacaaacaaggggcaucuucggggcuauugccggauuuaucgagaaugguugggaaggcauggucgaugggugguauggauuccggcaccagaacagugagggcauuggucaggcagcugaccuuaagagcacccaagccgcgauaaaucagaucaacgggaaacugaaccguuugauuggcaagacgaaugagaaguuccaccagaucgaaaaagaguuuuccgaaguugagggacgcauccaggaucucgaaaaguacguggaggacaccaaaauugaucuguggucuuauaacgccgaguuacugguagcacucgaaaaucaacauacaauagaccuuacugauagcgagaugaacaagcuguucgaaagaaccaaaaagcaguugagggagaaugcugaagacaugggcaacgggugcuuuaagaucuaccacaaaugugauaaugccugcauuggaucaauccggaacgguacauaugaccaugauguguaccgagacgaggcucuaaauaaccgcuuccagauuaagggcgucgagcugaaaaguggguacaaggacuggauccucuggauauccuuugccaucagcugcuuccugcuuuguguggcacuguugggauuuauuaugugggccugccagaaaggcaauaucagauguaacauuugcaucuga

SEQ ID NO: 123412 - RNA, 1701 nt, Artificial Sequence
  derived and/or modified sequence opt3 from hemagglutinin__InfluenzaA__ABJ53482
augaagaccaucauugcccugagcuacauacucugccuuguguucgcucagaaacugcccggcaacgacaauuccacagcaacuuuguguuuagggcaccaugccgucccuaacggaacgaucguuagaaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaagaaaugggaucuguucguggagagguccaaggccuauucuaauuguuaccccuaugacgucccugauuacgcaucguugcggucacucguggccagcaguggcacucuggaauuuaacaaugaguccuucaacuggacagguguuacccagaaugggacgucuagcgcuugcaaacgccgauccaacaauucauuuuucagucgucugaacuggcucacucauuuaaaguuuaaguauccagcacugaaugugaccaugcccaacaacgagaaauucgacaaguuguacaucuggggaguccaccauccuggcacagauaaugaccagauuuuucuuuaugcccaggcuagcggcagaaucacugugucuaccaaaaggucccaacagacaguaauuccaaacaucgggucacggccccgcguuagaaauauaccuagcaggauuaguaucuacuggaccauugugaagccaggagauauccugcuaaucaacucuacggguaaucucauugccccgcggggcuacuucaaaauacgcuccggaaagagcucgaucaugcgaucugacgcgcccauugggaaguguaacuccgaaugcaucacuccuaauggcucaauaccaaacgacaaacccuuucagaaugucaacagaauuacauauggugcauguccuagguacgugaagcagaauacccugaaacuugccacugggaugcggaacgugccagagaagcaaacacguggaaucuucggcgcuaucgccggcuuuauugaaaaugggugggagggaauggucgaugguugguauggcuuccgccaccagaacagugaggggaucggacaggcagcugaccugaaaagcacccaagccgcgauuaaucagauaaacggcaaguugaacagacucaucgguaaaacgaaugaaaaguuccaccagauugagaaggaauuuuccgagguugaagggaggauccaggaucuggagaaauacguggaggacaccaagaucgauuuauggucuuauaacgccgaacugcucguagcacuugagaaucaacauacaauugaccugacugauagcgaaaugaacaaauuguucgagcggaccaagaaacagcuacgagaaaaugcugaggacaugggcaacggaugcuuuaagauauaccacaagugugauaaugccugcaucggcucaauucgcaacgggacauaugaccaugauguguacagagacgaggcucugaauaacagguuccagaucaaaggagucgaacucaagagugguuacaaagacuggauucuguggaucuccuuugccauaagcugcuuccuucuguguguggcauugcucggcuuuaucaugugggccugccagaaggggaauauucgguguaacaucugcauuuga

SEQ ID NO: 123413 - RNA, 1698 nt, Artificial Sequence; identical to SEQ ID NO: 123248
  derived and/or modified sequence opt3 from hemagglutinin__InfluenzaA__ABJ53493

SEQ ID NO: 123414 - RNA, 1698 nt, Artificial Sequence
  derived and/or modified sequence opt3 from hemagglutinin__InfluenzaA__ABJ53504
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucagcgcauccugcucacacaacgggaagaguagcuuuuaccggaaucucuuauggcugacggagaaaaacggacuuuaucccaauuugucuaaguccuacgugaacaauaaagaaaaggaaguacugguucuauggggcgugcaucacccuucaaacaucggcguccagcgcgccauauaccacacugagaacgcuuaugugagcguggucaguucucauuacucccgacguuucaccccagaaaucgcaaaaagacccaagguuagggaucaggaggggcggauuaauuauuacuggacacuccuggagccuggagacacuaucauuuuugaagccaacgguaaucuuaucgcuccaugguaugccuucgcgcugagccgcggcuuugagucggggauaauuaccucuaacgcaccgaugaaugaaugugaugccaagugccagacacccuugggagcuaucaacuccucacucccuuuccaaaaugugcacccaguaaccauuggcgagugucccaaauacgugagaagugccaagcugaggauggucacggguuuacggaacaucccuagcauccagucccgcgggcuguuuggagcaauugcuggcuucauagaaggcggguggacuggaaugaucgacgguugguauggcuaccaucaccagaaugagcaggggucuggauacgccgcggaucagaaaagcacacaaaacgccauuaauggcaucaccaacaagguaaauucaguuauagagaaaaugaacacucaguuuacagcaguggguaaggaguucaauaaacucgaacgaagaauggaaaaccuuaacaagaaggucgacgauggguuccuggacauuuggaccuauaaugcugaguugcuagugcugcucgaaaacgagaggacgcuggauuuucacgacaguaaugugaaaaaccuuuacgagaagguuaaaucccagcugaagaauaacgccaaagaaaucggcaauggaugcuucgaguuuuaucauaaguguaacaaugaaugcauggagagcgugaagaacggcaccuacgacuauccaaaauacucugaggaaucaaaguugaaucgggagaaaaucgauggggucaagcucgaaaguaugggaguguaucaaauucuggcuaucuacagcacagucgccuccucuuuagugcugcuaguuucgcucggugcaauuagcuucuggaugugcuccaacggcucacugcagugucguauaugcaucuga

SEQ ID NO: 123415 - RNA, 1701 nt, Artificial Sequence; identical to SEQ ID NO: 123403
  derived and/or modified sequence opt3 from hemagglutinin__InfluenzaA__ABJ53515

SEQ ID NO: 123416 - RNA, 1701 nt, Artificial Sequence
  derived and/or modified sequence opt3 from hemagglutinin__InfluenzaA__ABK39962
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacagaagacucuuaaacuggccacaggaaugaggaaugugccugagaagcaaacccggggcaucuucggcgcuauagccggguuuauugaaaacggaugggaggguaugauggacggcugguacggguuccgucaccaaaauucugagggaacuggccaggcagcugauuugaaaagcacacaggccgcgaucaaccagaucaaugguaagcucaaccgccugauugaaaagaccaaugagaaauuucaucagaucgaaaaggaguucucagaaguagaggggaggauucaggacuuagagaaauauguggaagauacgaagauagaccuguggaguuacaacgccgagcuccuugucgcacuggaaaaucaacacaccaucgauuugacagacuccgagaugaacaaacuauucgaaagaacuaagaagcagcugcgggagaacgcugaggauaugggcaauggaugcuuuaaaauuuaucauaagugugacaacgccugcaucggcagcauccgaaaugggaccuacgaucacgacguguaccgcgacgaagcucucaacaauagauuccagauuaaaggaguugagcugaagucugguuauaaagauuggauacuuuggaucucauuugccauuaguugcuuccuguuguguaucgugcuccugggcuuuauuaugugggcaugccagaaggggaacaucagguguaauauaugcaucuga

SEQ ID NO: 123417 - RNA, 1701 nt, Artificial Sequence; identical to SEQ ID NO: 122646
  derived and/or modified sequence opt3 from hemagglutinin__InfluenzaA__ABK39973

SEQ ID NO: 123418 - RNA, 1701 nt, Artificial Sequence
  derived and/or modified sequence opt3 from hemagglutinin__InfluenzaA__ABK39984
augaagaccaucauugcccugagcuacauacucugccuuguguucgcucagaaacugcccggcaacgacaauuccagagcaacauuguguuuagggcaccaugccgucccuaacggaacuaucguuaagacgauuaccaaugaucaaaucgaggugacaaacgcgacugaacugguacagucuucaaguaccgguggcauuugcgacagcccacaccagauccuagauggggagaauuguacacucauagacgcucugcuuggagauccgcagugcgacggcuuucaaaacaaaaagugggaucuguucguggaaagguccaaagccuauucuaauuguuaccccuaugacgucccugauuacgcaucguugcggucacucguggccagcagugguacccuggaguuuaacaaugaauccuucaacuggacugggguuacacagaauggaaccucuagcgcuugcaagcgccgauccaacaauucauuuuucagucgucugaacuggcucacgcauuuaaaguuuaaauauccagcacugaaugugacuaugcccaacaacgagaaguucgacaaacuuuacaucuggggcguccaccauccuggcaccgauaaugaccagaucuuuuuguaugcccaggcuagcgggagaauuacagugucuacuaagaggucccaacagaccguaauuccaaacaucggaucacggccccgcguuagaaauauaccuagcaggauuaguaucuacuggacaauugugaaaccaggugauauccugcuaaucaacucuaccggcaaucucauugccccgcggggguacuucaagauacgcuccggaaagagcucgaucaugcgaucugacgcgcccauuggcaaauguaacuccgagugcaucacgccuaaugguucaauaccaaacgacaagcccuuucagaaugucaacagaauuacuuauggggcauguccuagguacgugaaacagaauacacugaagcuggccaccggaaugcggaacgugccagaaaaacaaacucguggcaucuucggcgcuaucgccggguuuauugagaauggaugggaagguauggucgauggcugguauggguuccgccaccagaacagugagggaaucggccaggcagcugaccuuaagagcacacaagccgcgauugaucagauaaaugguaaauugaacagacucaucgggaagaccaacgagaaguuccaccagauugaaaaagaguuuuccgaaguugagggcaggauccaggaccuggaaaaguacguggaggauacgaaaaucgacuuauggucuuauaaugccgagcugcucguagcacuugaaaaccaacauaccauugaucugacagacagcgagaugaauaaguuguucgaacggacuaaaaagcagcuacgagagaacgcugaagauaugggaaauggcugcuuuaagauauaccacaaaugugacaacgccugcaucgggucaauucgcaauggaaccuaugaucaugacguguacagagacgaggcucugaacaauagguuccagaucaagggugucgagcucaaaaguggcuacaaggauuggauucuguggaucuccuuugccauaagcugcuuccuucuguguguggcauugcucggguuuaucaugugggccugccagaaaggaaacauucgguguaauaucugcauuuga

SEQ ID NO: 123419 - RNA, 1698 nt, Artificial Sequence
  derived and/or modified sequence opt3 from hemagglutinin__InfluenzaA__ABK39995
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuuacucauucgaaagguuugagaucuucccuaaggagagcaguuggccaaaucauacugugacaggugucuccgcaucuugcagccacaacgggaaguccucauuuuaucggaauuuacuguggcuuaccggcaaaaacggauuguaccccaaucugaguaagagcuacgccaacaauaaagaaaaggaggugcuaauacucuggggcguacaucacccuccaaacaucgggaaccagcgcacgcuguaucacacugaaaaugcuuacguuucuguggucuccucacauuauagccgacguuucacccccgagauuacaaaaagaccuaaggugagggaucaggaaggacggaucaacuacuauuggacucuucuggagccaggugacaccauuaucuuugaggcaaauggcaacuugauagccccgugguacgcuuucgcccucagucgcggguuuggaucuggcauuaucacauccaaugcgcccauggaugaaugugacgcaaagugccagaccccucaaggugccauuaacagcucgcugccauuccagaaugugcaccccgucacgaucggggaguguccuaaauauguuagaucugcuaaguuaaggauggugacuggacugcggaacaucccauccauucagucacgcggccucuuuggcgccauagcaggguucaucgaaggagguuggacaggcaugguagaugggugguacggauaccaucaccagaaugagcaaggcagugguuaugcugccgaccagaaaagcacccagaacgcgauuaaugggaucacuaacaaggucaauuccgugauagaaaagaugaacacacaguuuaccgccgugggcaaagaguucaauaaacuugagcgaagaauggaaaaccugaacaagaagguugaugacggauucuuggauauuuggacguacaaugcagagcuacuggugcuccuggaaaacgagaggacccuugacuuucacgacucuaaugucaaaaaccuguaugaaaaggugaaaagccaauugaagaauaacgcuaaagagaucggcaaugggugcuucgaguuuuaccauaaguguaacaaugaaugcauggagucaguaaagaacggaacauaugauuaccccaaauauagugaagaguccaagcucaaucgggagaaaaucgacgguguuaagcuggauagcaugggcguguaccagauuuuagccaucuacucuacugucgcuucaagucuggugcuacucgucagccugggggccauuuccuucuggaugugcucuaacggaucgcuucagugucguauaugcaucuga

SEQ ID NO: 123420 - RNA, 1701 nt, Artificial Sequence
  derived and/or modified sequence opt3 from hemagglutinin__InfluenzaA__ABK40017
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacaagaaauucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaagccaggugacauccugcuaaucaauuccacgggcaaccucauugccccgaggggguacuuuaagauacggagcggaaaaucgucuaucaugcgcuccgacgcgcccauuggcaaguguaauucagagugcaucacuccuaacgguaguauaccaaaugauaaacccuuccagaacgucaaucgaauuacauauggggcauguccuagauacgugaagcagaacacccugaaacuugccacuggaaugaggaaugugccagagaagcaaacacggggcaucuuuggcgcuaucgccggguucauugaaaacggaugggaggguauggucgacggcugguauggguuucgucaccagaauagcgaaggaaucggccaggcagcugaucugaaauccacccaagccgcgauuaaccagauaaaugguaaguugaaccgccucaucgggaagacgaacgagaaauuccaccagauugagaaggaguucucugaaguugaaggcagaauccaggaccuggagaaauacguggaagauaccaagaucgacuuauggagcuauaaugccgagcugcucguagcacuugagaaccaacauacaauugaucugacugacucagaaaugaauaaauuguuugagaggaccaagaagcagcuacgggaaaacgcugaggauaugggaaauggcugcuucaaaauauaccacaagugugacaacgccugcaucgggaguauucgaaauggaacauaugaucaugacguguaccgcgacgaagcucugaacaauagauuucagaucaaaggugucgagcucaaguccggcuacaaagauuggauucuguggaucagcuucgccauaucuugcuuucuucuguguguggcauugcucggguucaucaugugggccugccagaagggaaacauuagguguaauaucugcauuuga

SEQ ID NO: 123421 - RNA, 1701 nt, Artificial Sequence
  derived and/or modified sequence opt3 from hemagglutinin__InfluenzaA__ABK40028
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucaauagccggcuggauccuggggaacccugagugcgaaaguuuguuuagcaaagaguccuggucuuacauugcagaaaccccaaauccgaagaacggaacuuguuaucccggcuacuucgccgacuaugaggagcucagggaacaacugucgucagucagcaguuuugagcgguucgaaaucuuuccuaaggauuccucuuggccaaaucauacagugaccaaagguguuacggcuagcugcucccacaacgggaagucaaguuucuacaaaaaucugcucugguuaacugagaagaacggacuguaucccaaucuuagcaaaucuuacgugaacaagaagggcaaagaggucuuggugcuguggggcguacaucacccuuccaauaugggggaccagcgcgcaauuuaccacaaggaaaacgccuauguuaccgugcuaucaagccauuacagucgacguuuuacaccagagaucgcuagaaggcccaaaguccgggaucaggaaggacgcauaaacuauuacuggacucuccuggagccuggugacaccaucauuuucgaagccaauggcaaccuuaucgcgccaugguaugcauuugcccugucuagaggguucggauccggcauuaucauaagcaaugcuucgaugggugagugugaugccaagugccagacaccgcaaggggcaauuaacucuuccuugcccuuucagaaugugcacccugugaccaucggagaguguccaaaauacgucaggucaacgaagcuccggaugguuacuggccugcgcaacgugcccaguauucagagccgaggcuuauucggggcuaucgccggauuuaucgaagguggcuggacagggaugauugacggaugguauggcuaccaucaccagaaugagcaagguuccggguacgcggccgaucagaaaucuacccagaacgcaauaaauggcaucacuaacaagguaaauagcauuaucgaaaagaugaacacacaguucaccgcugugggaaaagaguucaauaagcuggaaagaaggauggagaaccucaauaaaaaggucgacgauggcuuucuugacauauggacguauaacgccgagcuguuggugcuacuggaaaacgagcggacccucgacuuccacgauucaaauguuaaaaaccuguacgaaaaggugaagaaucaacuuaaaaacaaugcuaaggagauugggaacggaugcuuugaguucuaucauaaauguaauaacgaaugcauggagagugucaagaaugguacauacgacuauccuaaauacuccaaggaaagcaagcugaaccgugagaaaaucgauggcgugaaguuggaaucuauggggguauaucagauccucgccauuuacucaacuguugcaaguagccugguguuacuggucucccuaggagccaucucuuuuuggaugugcucgaauggcagccuccagugucgcauuugcauauga

SEQ ID NO: 123422 - RNA, 1701 nt, Artificial Sequence; identical to SEQ ID NO: 123403
  derived and/or modified sequence opt3 from hemagglutinin__InfluenzaA__ABK40039

SEQ ID NO: 123423 - RNA, 1701 nt, Artificial Sequence; identical to SEQ ID NO: 123403
  derived and/or modified sequence opt3 from hemagglutinin__InfluenzaA__ABK40050

SEQ ID NO: 123424 - RNA, 1701 nt, Artificial Sequence; identical to SEQ ID NO: 122666
  derived and/or modified sequence opt3 from hemagglutinin__InfluenzaA__ABK40061

SEQ ID NO: 123425 - RNA, 1701 nt, Artificial Sequence; identical to SEQ ID NO: 122666
  derived and/or modified sequence opt3 from hemagglutinin__InfluenzaA__ABK40075

SEQ ID NO: 123426 - RNA, 1701 nt, Artificial Sequence; identical to SEQ ID NO: 122937
  derived and/or modified sequence opt3 from hemagglutinin__InfluenzaA__ABK40510

SEQ ID NO: 123427 - RNA, 1701 nt, Artificial Sequence; identical to SEQ ID NO: 122937
  derived and/or modified sequence opt3 from hemagglutinin__InfluenzaA__ABK40534

SEQ ID NO: 123428 - RNA, 1701 nt, Artificial Sequence
  derived and/or modified sequence opt3 from hemagglutinin__InfluenzaA__ABK40546
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacaaccacaaugggaaacucugcaagcugaaaggaauagcuccccuucagcuggguaaguguucaaucgccggcuggauuuuggggaacccugagugcgaaagucucuucagcaauaaguccuggucuuauaucgcagagaccccaaacucggaaaauggaacauguuacccgggcuauuuugccgauuacgaggagcugagagaacaacugucaagcgucaguuccuucgagagguuugaaauuuuccccaaagagucuagcuggccuaagcauaacgugaccaaagguguuacugcuuccugcucacacaaggggaaaaguagcuuuuaucggaaucucuuauggcugacagagaagaacggaucuuacccaaaucuuuccaagucauaugugaacaauaaagaaaaggaggucuuggugcuguggggcguacaucaccccagcaacaucgaagaccagaaaaccauauaccgcaaggagaacgcauacguuaguguggucucuucccacuauaaucgacguuucacgccugaaaucgccaaaagaccaaaggugaggaaccaggagggccggauuaauuacuauuggacucuacucgagcccggggauaccaucauuuuugaagcuaacggaaaucugaucgccccuugguacgcguucgcacuuagccgcgguuuuggcucggggauaauuacaucuaacgccuccauggacgagugugaugcuaaaugccagacuccacaaggagccaucaauucaagucugccguuccagaacgugcaucccgucaccauuggcgaauguccuaaguauguuagaagcacaaaguugaggauggugaccggucuccggaauaucccauccauccagucucgcgggcuguuuggagcaauugcuggcuucauagagggcggguggacgggaaugaucgacgguugguacggcuaucaccaucagaacgaacaagggagcggauacgccgcggaucagaaaucaacucagaaugccauuaacggcaucacaaauaagguaaacaguauaauugagaaaaugaauacccaguuuacugcaguggguaaggaguucaacaaauuagaaaagcgaauggagaaccugaauaagaaagucgacgauggguuccucgacaucuggacauacaacgcugaacuucugguguugcuagagaaugaaagaacccuggacuuucacgauuccaacguuaagaaucucuaugagaaagucaagagccaacugaaaaacaaugccaaggagaucggcaacggaugcuucgaauuuuaccacaaguguaauaacgagugcauggaaucugugaaaaauggcacguaugacuaccccaaguauucagaggagaguaaacuuaacagggaaaagauugauggggugaaacuggagagcaugggaguauaccagaucuuggcuauuuauuccaccguugccucuucgcucgugcuguuagucagccugggugcaauauccuucuggaugugcucaaauggcagucuacagugucggaucugcauuuga

SEQ ID NO: 123429 - RNA, 1701 nt, Artificial Sequence; identical to SEQ ID NO: 122937
  derived and/or modified sequence opt3 from hemagglutinin__InfluenzaA__ABK40557

SEQ ID NO: 123430 - RNA, 1701 nt, Artificial Sequence; identical to SEQ ID NO: 122937
  derived and/or modified sequence opt3 from hemagglutinin__InfluenzaA__ABK40568

SEQ ID NO: 123431 - RNA, 1701 nt, Artificial Sequence; identical to SEQ ID NO: 122937
  derived and/or modified sequence opt3 from hemagglutinin__InfluenzaA__ABK40579

SEQ ID NO: 123432 - RNA, 1701 nt, Artificial Sequence
  derived and/or modified sequence opt3 from hemagglutinin__InfluenzaA__ABK40590
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacaaccacaaugggaaacucugcaagcugaaaggaauagcuccccuucagcuggguaaguguucaaucgccggcuggauuuuggggaacccugagugcgaaagucucuucagcaagaaauccuggucuuauaucgcagagaccccaaauucggaaaacggaacauguuacccgggcuauuuugccgauuacgaggagcugagagaacaacugucaagcgucaguuccuucgagagguuugaaauuuuccccaaggagucuagcuggccuaaacauaaugugaccaaggguguuacugcuuccugcucacacaaagggaagaguagcuuuuaucggaaccucuuauggcugacagagaagaauggaucuuacccaaaccuuuccaaaucauaugugaauaacaaggaaaaagaggucuuggugcuguggggcguacaucaccccagcaauaucgaagaccagaagaccauauaccgcaaagagaacgcauacguuaguguggucucuucccacuauaaccgacguuucacgccugaaaucgccaagagaccaaaagugaggaaucaggagggccggauuaacuacuauuggacucuacucgagcccggggauaccaucauuuuugaagcuaauggaaaccugaucgccccuugguacgcguucgcacuuagccgcgguuuuggcucggggauaauuacaucuaaugccuccauggacgagugugaugcuaagugccagacuccacaaggagccaucaacucaagucugccguuccagaaugugcaucccgucaccauuggcgaauguccuaaguauguuagaagcacaaaauugaggauggugaccggucuccggaacaucccauccauccagucucgcgggcuguuuggagcaauugcuggcuucauagagggcggguggacgggaaugaucgacgguugguacggcuaucaccaucagaaugaacaagggagcggauacgccgcggaucagaagucaacucagaacgccauuaauggcaucacaaacaaaguaaauaguauaauugagaagaugaacacccaguuuacugcaguggguaaagaguucaauaaguuagaaaagcgaauggagaaccugaacaaaaaggucgacgauggguuccucgacaucuggacauacaaugcugaacuucugguguugcuagagaacgaaagaacccuggacuuucacgauuccaauguuaaaaaccucuaugagaaggugaaaaaucaacugaagaacaaugccaaggagaucggcaacggaugcuucgaauuuuaccacaaauguaauaacgagugcauggaaagcgucaagaauggcacguaugacuaccccaaauauucugaggagucaaaacuuaacagggaaaagauugauggggugaagcuggagaguaugggaguauaccagaucuuggcuauuuauagcaccguugccuccucucucgugcuguuagucucgcugggugcaaucagcuucuggaugugcuccaauggcucacuacagugucggauaugcauuuga

SEQ ID NO: 123433 - RNA, 1701 nt, Artificial Sequence; identical to SEQ ID NO: 122937
  derived and/or modified sequence opt3 from hemagglutinin__InfluenzaA__ABK40601

SEQ ID NO: 123434 - RNA, 1701 nt, Artificial Sequence; identical to SEQ ID NO: 122666
  derived and/or modified sequence opt3 from hemagglutinin__InfluenzaA__ABK40612

SEQ ID NO: 123435 - RNA, 1701 nt, Artificial Sequence
  derived and/or modified sequence opt3 from hemagglutinin__InfluenzaA__ABK40623
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucgccuacggcgcuugucccagauauguuaagcagaacacucuuaaacuggccacagguaugaggaaugugccugagaagcagacccgggggauauucggagcaauugcuggcuuuaucgaaaacggcugggaggggaugguagacggaugguacgguuuccgucauuugaauagcgagggcacugggcaagccgcggaucucaaaucaacacaggccgcaaucaaccagauuaauggaaagcugaaccgcuuaaucgagaaaaccaaugaaaaguuucaccaaauugaaaaggaguucagugaaguggagggcagaauacaggaccuggagaaauaugucaaggauacgaaaaucgaccucugguccuacaacgcugaacuucugguggccuuggagaaccagcauaccauugaucuaacagacagcgaaaugaauaagcuguucgagaggacucggaaacagcuccgagaaaacgcugaggauguugguaaugggugcuuuaagaucuaucacaagugugacaacgccugcaucggcucuauucgcaauggaaccuacgaucacgacguguacagagaugaggcacugaacaauagguuccaaauaaaaggcgucgaacuuaagucaggguauaaagacuggauccuguggauuaguuuugccaucagcugcuucuugcucugugugguacuguuaggauuuauuaugugggcuugccagaaggguaacauccgguguaauauaugcaucuga

SEQ ID NO: 123436 - RNA, 1701 nt, Artificial Sequence; identical to SEQ ID NO: 123000
  derived and/or modified sequence opt3 from hemagglutinin__InfluenzaA__ABK40645

SEQ ID NO: 123437 - RNA, 1701 nt, Artificial Sequence
  derived and/or modified sequence opt3 from hemagglutinin__InfluenzaA__ABK40656
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcgacaguccgcacaggauucucgauggcaaaaauuguacccugaucgacgcucuacugggggauccccauugcgacggauuucagaacaaggagugggauuuguucguggaacggagcaaagccuauuccaauuguuacccuuaugacgucccagauuacgcaucucuccgcucgcugguggccucaagcggcacucuggaguuuacaaacgaaaauuucaacuggaccgguguugcucaggacgggaagaguuauuccugcaagcgaggaucugugaauagcuuuuucucccgucucaacugguuacacaaacuggaguacaaguaucccgcacuuaaugucacgaugccuaacaauggcaaauuugauaaguuguacauauggggcgugcaucacccaucaacugacagugaucaaaccagccuguacguaagagccucugggaaaguuacaguguccacuaagaggucacagcagaccgucauccccgacauuggauaucggccuugggugcgcggucuaagcaguagaaucucuauuuacuggacaaucgugaagccaggcgacauacuccugauuaacuccaccgggaaccuuaucgcuccgaggggauauuucaaaauucggaauggcaagagcucgaucaugcgcucugaugcccccaucgguaacuguuccucagagugcauuacgccuaaugggaguauaccaaacgacaaacccuuucagaaugucaaccgaaucacuuacggaacauguccuagauauguuaagcaaaauacccugaaauuggcgacuggcaugaggaacgugccagaaaagcagacacggggcauuuucggggcaaucgccggauuuauagagaaugguugggaaggcaugguagaugggugguacggauuccgucaccagaacagcgagggcaccggucaggcugccgaccucaaauccacgcaagcagcuauugaucagaucaaugggaagcugaaccgcuuaguggagaagaccaaugaaaaauuucaucagaucgagaaggaguucucugaagucgaaggcaggauucaagaccuggagaaauauguggaggauacaaagaucgaccucuggagcuacaacgccgaacuucugguugcguuggagaaucagcacacuauugaucuaaccgacucagaaaugaacaaacuguucgagagaacacggaagcagcuccgagaaaacgccgaggauaugggaaauggcugcuuuaagauauaccauaaaugugacaacgcaugcaucgggaguauucgcaauggaacuuaugaccacgauguguacagagacgaggcucugaacaauagguuccagaucaagggugucgaacuuaaauccggcuauaaggauuggauccuguggauuagcuuugccauaucuugcuucuugcucugugugguacuguuaggguuuaucaugugggcuugccaaaaaggaaacauucgguguaauaucugcauuuga

SEQ ID NO: 123438 - RNA, 1701 nt, Artificial Sequence
  derived and/or modified sequence opt3 from hemagglutinin__InfluenzaA__ABK40667
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaaaguccuaugcaugcaagcgaggcucugugaacagcuuuuucucccgucucaauugguuacacaaacuggaguacaaguauccagcccuuaacgucacgaugcccaauaacgauaaauuugacaaguuguacauauggggcgugcaucacccuucaacugauagugaccaaaccagccuguacguacaggcuucugggagaguuacaguguccacuaaaaggucacagcagaccgucaucccaaauauuggaagccggcccugggugcgcgguaucaguucuagaauuuccaucuauuggacaauagugaagccuggcgacauucuacucaucaacagcaccgggaaccugauugccccaaggggauacuucaaacuucggaauggcaagucgucuaucaugcgcuccgaugcgccgaucgacaacuguaauucagagugcauuacgcccaacgguaguauaccuaaugauaagccauuucaaaacgucaaucgaaucacuuauggggcaugucccagauacguuaaacagaacacacugaaguuggccaccggaaugaggaaugugccugaaaaacagacucggggcauuuucggcgcuaucgccggguuuauagagaacggaugggaagguaugguagacggcugguauggguuccgucaccagaauagcgagggaacaggccaagcagcugaucucaaguccacccaggccgcgauugaccagaucaacgguaaacugaaucgcuuaacggagaagaccaacgaaaaguuucaucaaaucgagaaagaguucucugaaguggaagggaggauucaggaucuggagaaguacgucgaggacacaaaaaucgaucucuggagcuauaaugccgaacuucugguggcauuggagaaccagcacacuauugaccuaaccgauucagaaaugaacaagcuguucgagagaacacggaaacagcuccgagaaaaugcugaggacaugggcaacggaugcuuuaagauauaccauaagugugacaaugccugcaucggcaguauucgcaacgggacuuacaaucacgauguuuauagagacgaggcucugaacaauagguuccaaaucaaaggaguggaacuuaaguccgguuacaaagauuggauccuguggauuagcuuugccauaucuugcuucuugcucugugucgugcuguuaggcuuuaucaugugggcaugccagaaggggaacauucgguguaauaucugcauuuga

SEQ ID NO: 123439 - RNA, 1701 nt, Artificial Sequence; identical to SEQ ID NO: 123082
  derived and/or modified sequence opt3 from hemagglutinin__InfluenzaA__ABK40678

SEQ ID NO: 123440 - RNA, 1698 nt, Artificial Sequence
  derived and/or modified sequence opt3 from hemagglutinin__InfluenzaA__ABK40689
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucgggaaccagcgcgcccuguaccacacugaaaaugcuuaugucuccguggugucaagccauuacagucgacguuucacccccgagauagcaaaaagaccuaaggucagggaucaggaaggacggaucaacuauuacuggacacuucuggagccaggugacacuauuaucuuugaggccaauggcaacuugauugcuccgcgcuucgccuuugcgcucucuagaggguucggauccggcaucauaaccagcaaugcacccauggaugaaugugacgccaagugccagacaccucaaggugcuauuaacucgucucugccauuucagaauguucaccccgugaccaucggggaguguccuaaauauguaagguccgccaaguuacggauggcaacgggacugcgcaacauuccaucaauccagagucgaggccucuucggcgcuaucgccggguuuauugaaggagguuggacuggcaugguggaugggugguacggauaucaucaccagaaugagcaaggcagcgguuacgcggccgaccagaaauccacacagaacgcaauaaaugggaucaccaacaaggucaauucugugauugaaaagaugaacacucaguucacagcuguuggcaaagaguucagcaaacuugagagaaggauggaaaaucugaacaagaagguggaugacggauuuuuggauaucuggaccuacaacgccgagcuacugguccuccuggaaaaugagcggacgcuugacuuccacgacucaaacgugaaaaaucuguaugaaaagguaaaaagucaauugaagaacaaugcuaaagagauaggcaacgggugcuuugaguucuaccauaaguguaaugaugaaugcauggaguccguuaagaacggaaccuaugacuaccccaaauauagcgaagagucuaagcucaaucgugagaaaauugauggugugaagcuggaaucaaugggcgucuaccagaucuuagccaucuauaguacaguggcaagcucccugguccuacucgugucucugggggccauuucguuuuggaugugcagcaacggaucccuucagugucgcaucugcauuuga

SEQ ID NO: 123441 - RNA, 1701 nt, Artificial Sequence; identical to SEQ ID NO: 122666
  derived and/or modified sequence opt3 from hemagglutinin__InfluenzaA__ABK40700

SEQ ID NO: 123442 - RNA, 1701 nt, Artificial Sequence; identical to SEQ ID NO: 122666
  derived and/or modified sequence opt3 from hemagglutinin__InfluenzaA__ABK40711

SEQ ID NO: 123443 - RNA, 1701 nt, Artificial Sequence
  derived and/or modified sequence opt3 from hemagglutinin__InfluenzaA__ABK40722
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauaacgaccagaucucucuguacgcucaggccccaggccgugugaccguauccacaaagagaucacaacagacuguuauucccaauaucgggagcaggccuugggugcggggagucaguucucgcauuuccaucuacuggaccauagugaaaccaggugauauucuacucaucaacuguacaggcaaucugauugcgccgagaggguauuucaagaucaggagcggaaagucgucuaucaugcgguccgacgcaucaauuggcaaaugcaacagugaauguauaacccccaaugguagcaucccuaacgacaagccauuucagaaugugaaccgcauuacguacggggccugcccccgauaugucaaacagaauacucuuaagcuggcuacaggaaugagaaacguuccugagaaacaaaccaggggcaucuucggcgccauagcaggguuuauugaaaauggaugggaggguaugguggauggcugguacggguuccggcaccagaacuccgagggaacuggccaggcugccgacuugaagucuacacaagcggccaucaaucagaucaacgguaaacucaaucgucugauugaaaagaccaacgagaaguuucaucagaucgaaaaagaguucagcgaaguagaggggcgcauucaggauuuagagaaguauguggaagacacgaaaauagaucuguggucauacaacgcagagcuccuugucgcucuggaaaaucaacacaccaucgacuugacagauagugagaugaacaagcuauucgaaagaacuaaaaagcagcugagggagaaugccgaggacaugggcaacggauguuuuaagauuuaucauaaaugcgauaaugcuugcaucggcuccauccggaacgggaccuacgaccacgauguguaccgagacgaagcccucaauaaccgcuuccagauuaagggaguugagcugaaaagcgguuauaaggacuggauacuuuggaucucuuuugcaauuucauguuuccuguugugcgugguccuccugggcuuuaucaugugggccugucagaaagggaauauuagaugcaacaucuguauauga

SEQ ID NO: 123444 - RNA, 1701 nt, Artificial Sequence; identical to SEQ ID NO: 122666
  derived and/or modified sequence opt3 from hemagglutinin__InfluenzaA__ABK40733

SEQ ID NO: 123445 - RNA, 1701 nt, Artificial Sequence; identical to SEQ ID NO: 123321
  derived and/or modified sequence opt3 from hemagglutinin__InfluenzaA__ABK40744

SEQ ID NO: 123446 - RNA, 1701 nt, Artificial Sequence; identical to SEQ ID NO: 122931
  derived and/or modified sequence opt3 from hemagglutinin__InfluenzaA__ABK79948

SEQ ID NO: 123447 - RNA, 1698 nt, Artificial Sequence; identical to SEQ ID NO: 123220
  derived and/or modified sequence opt3 from hemagglutinin__InfluenzaA__ABK79959

SEQ ID NO: 123448 - RNA, 1701 nt, Artificial Sequence
  derived and/or modified sequence opt3 from hemagglutinin__InfluenzaA__ABK79970
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucaauagccggcuggauccuggggaacccugagugcgaaaguuuguuuagcaaaaaguccuggucuuacauugcagagaccccaaauccgaagaacggaacuuguuaucccggcuacuucgccgacuaugaagaacucagggagcaacugucgucagucagcaguuuugaacgguucgagaucuuuccuaaagauuccucuuggccaaaucauacagugaccaaggguguuacggcuagcugcucccacaacgggaaaucaaguuucuacaagaaucugcucugguuaacugaaaagaacggacuguaucccaaucuuagcaagucuuacgugaacaagaaaggcaaggaggucuuggugcuguggggcguacaucacccuuccaauaugggggaccagcgcgcaauuuaccacaaagagaacgccuauguuucagugcuaagcagucauuacucucgacguuuuaccccagaaaucgcuagaaggcccaagguccgggaucaggagggacgcauaaacuauuacuggacacuccuggaaccuggugacacuaucauuuucgaggccaauggcaaccuuaucgcgccaugguaugcauuugcccuguccagaggguucggaagcggcauuaucauaucgaaugcuucuaugggugaaugugaugccaaaugccagaccccgcaaggggcaauuaacuccucauugcccuuucagaaugugcacccugugacaaucggagaguguccaaaguacgucaggaguaccaaacuccggaugguuacgggccugcgcaacgugcccagcauucagucccgaggcuuauucggggcuaucgccggauuuaucgaggguggcuggacugggaugauugacggaugguauggcuaccaucaccagaaugaacaagguucuggguacgcggccgaucagaaaagcacacagaacgcaauaaauggcaucaccaacaagguaaauucaauuaucgagaaaaugaacacucaguucacagcugugggaaaggaguucaauaaacuggagagaaggauggaaaaccucaauaagaaagucgacgauggcuuucuugacauauggaccuauaacgccgagcuguuggugcuacuggagaacgaacggacgcucgacuuccacgauaguaauguuaagaaccuguacgagaaggugaaaaaucaacuuaagaacaaugcuaaagaaauugggaacggaugcuuugaguucuaucauaaguguaauaacgaaugcauggaguccgucaaaaaugguaccuacgacuauccuaaguacagcaaggagucuaaacugaaccgugaaaagaucgauggcgugaaauuggagucaauggggguauaucagauccucgccauuuacaguacaguugcaagcucccugguguuacuggucucucuaggagccaucucguuuuggaugugcagcaauggcucccuccagugucgcauuugcauauga

SEQ ID NO: 123449 - RNA, 1701 nt, Artificial Sequence
  derived and/or modified sequence opt3 from hemagglutinin__InfluenzaA__ABK79981
augaagaccaucauugcccugagcuacauacucugccuuguguucacacagaaacugcccggcaacgacaauuccacugcuacguuguguuuagggcaccaugcagucccuaacggaacccugguuaagacaaucacuaaugaucaaauugaggugaccaacgccacagaauugguacagucuucaaguaccgguggcaucugcgacagcccacaccagauucucgauggggagaauuguacucugaucgacgcgcuucugggagauccgcauugcgacggcuuucagaacaaagaaugggauuuguucguggagagauccaaggcuuauucuaauuguuaccccuaugacgucccugauuacgccucgcucaggucacugguggcaagcagugguacacuggaauuuaacaaugaguccuucaacuggaccgggguugcccaaaauggaacgucuagcgcuugcaaacggcgcuccaacaagucauuuuucagucgacucaauugguuacaccagcugaaguauaaauacccagcacuuaacgugacuaugcccaauaacgagaaguuugacaaauuguauauauggggcguccaucacccuagcaccgauucugaccagaucucccuguacgcccaggcuccaggccgugugacaguaucaacuaagagaagccaacagaccguuauucccaacaucgggaguaggccuugggugcggggagucucuucccgcauuagcaucuacuggacaauagugaaaccaggugauauucuacucaucaauuguaccggcaaccugauugccccgagaggguauuucaagaucaggucgggaaagucuuccaucaugcggucagacgcgaguauuggcaaaugcaauagcgaauguauaacgcccaacgguuccaucccuaaugacaagccauuucagaacgugaaucgcauuacuuacggggcaugcccccgauaugucaaacagaacacacuuaagcuggccaccggaaugagaaauguuccugagaaacaaacuaggggcaucuucggcgcuauagccggguuuauugaaaacggaugggaggguaugguggauggcugguacggguuccggcaccaaaauucugagggaacaggccaggcagcugaccuaaagagcacccaggccgcgaucaaccagaucaaugguaaacucaaccgucugauugaaaagacgaaugagaaguuucaucagaucgaaaaagaguucucagaaguagaggggcgcauucaggauuuagagaaguauguggaagacaccaaaauagaucuguggaguuacaacgccgagcuccuugucgcacuggaaaaccaacacacaaucgacuugacugauuccgagaugaauaagcuauucgaaagaaccaaaaagcagcugagggagaacgcugaggacaugggcaauggauguuuuaagauuuaucauaaaugcgauaacgccugcaucggcagcauccggaaugggacauacgaccacgauguguaccgagacgaagcucucaacaaucgcuuccagauuaagggaguugagcugaaaucugguuauaaggacuggauacuuuggaucucauuugccauuaguuguuuccuguugugcgugguccuccugggcuuuaucaugugggcaugucagaaagggaacauuagaugcaauaucuguauauga

SEQ ID NO: 123450 - RNA, 1701 nt, Artificial Sequence; identical to SEQ ID NO: 122666
  derived and/or modified sequence opt3 from hemagglutinin__InfluenzaA__ABK79992

SEQ ID NO: 123451 - RNA, 1701 nt, Artificial Sequence; identical to SEQ ID NO: 122937
  derived and/or modified sequence opt3 from hemagglutinin__InfluenzaA__ABK80025

SEQ ID NO: 123452 - RNA, 1701 nt, Artificial Sequence; identical to SEQ ID NO: 122937
  derived and/or modified sequence opt3 from hemagglutinin__InfluenzaA__ABK80036

SEQ ID NO: 123453 - RNA, 1701 nt, Artificial Sequence; identical to SEQ ID NO: 122937
  derived and/or modified sequence opt3 from hemagglutinin__InfluenzaA__ABK80047

SEQ ID NO: 123454 - RNA, 1701 nt, Artificial Sequence; identical to SEQ ID NO: 122782
  derived and/or modified sequence opt3 from hemagglutinin__InfluenzaA__ABK80058

SEQ ID NO: 123455 - RNA, 1701 nt, Artificial Sequence
  derived and/or modified sequence opt3 from hemagglutinin__InfluenzaA__ABK80069
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggauccgcggcgucuccagcagaauaucgauuuacuggacaaucgugaagccuggggauauucuacucaucaacucuaccggaaaucugaucgcgccaagggguuauuucaaaauucgguccggcaagucaaguauaaugcgcagcaacgcaccgaucgggaaguguaauuccgaaugcauuacgcccaacggaucuaucccuaaugacaaaccauuucagaacgugaaucgaauagccuacggcgcuugucccagauaugucaagcagaacacucuuaaacuggccacagguaugaggaauguuccugagaagcagacccgggggauuuucggagcaaucgcuggcuuuaucgaaaacggcugggaggggaugguggacggaugguacgguuuccgucauuugaauagcgagggcacugggcaagccgcggaucucaaaucaacacaggccgcaauuaaccagaucaauggaaagcugaaccgcuuaauugagaaaaccaaugaaaaguuucaccaaauagaaaaggaguucagugaaguagagggcagaauccaggaccuggagaaauauguggaagauacgaagauugaccucugguccuacaacgcugagcuucuggucgccuuggaaaaccagcauaccaucgaucuaacagacagcgagaugaauaaacuguucgaaaggacucggaagcagcuccgagagaacgcugaggauguggguaaugggugcuuuaaaaucuaucacaagugugacaacgccugcauuggcucuauacgcaauggaaccuacgaucacgacguuuacagagaugaagcacugaacaauagguuccaaaucaagggcguggagcuuaaaucaggguauaaggacuggauucuguggaucaguuuugccauuagcugcuucuugcucugugucgugcuguuaggauuuaucaugugggcuugccagaaagguaacauacgguguaauaucugcauuuga

SEQ ID NO: 123456 - RNA, 1701 nt, Artificial Sequence
  derived and/or modified sequence opt3 from hemagglutinin__InfluenzaA__ABK80080
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacuuaaacuggcuaccgguaugaggaaugugccugagaagcagacucgggggauauucggagccauugcaggcuuuaucgaaaacggcugggaggggaugguagacggaugguacgguuuccgucaucaaaauagcgagggcacagggcaggcugccgauuugaaaucaacccaggcggccaucaaccaaauuaauggaaagcucaaccgccugaucgagaaaacgaaugaaaaguuucaccagauugaaaaggaguucagugaaguggagggcagaauacaggacuuagagaaauaugucgaagauaccaagaucgaccugugguccuacaacgcagagcuccuuguggcucuggaaaaccagcauacaauugauuugacugacagcgagaugaauaaacuauucgaaaggacccggaagcaacugcgagagaacgccgaggauauggguaaugggugccucaaaaucuaucacaagugugacaacgcuugcaucggcucuauucgcaauggaacauacgaucacgacguuuacagagaugaagcccugaacaauagguuucagauaaagggcguggagcuuaaaucaggguauaaggacuggauccuguggauuaguuucgcaaucagcugcuuuuugcucugugucgugcuguuaggauucauuaugugggccugccagaaagguaacauccgguguaauauaugcaucuga

SEQ ID NO: 123457 - RNA, 1701 nt, Artificial Sequence; identical to SEQ ID NO: 122666
  derived and/or modified sequence opt3 from hemagglutinin__InfluenzaA__ABK80091

SEQ ID NO: 123458 - RNA, 1701 nt, Artificial Sequence; identical to SEQ ID NO: 122666
  derived and/or modified sequence opt3 from hemagglutinin__InfluenzaA__ABK80102

SEQ ID NO: 123459 - RNA, 1701 nt, Artificial Sequence; identical to SEQ ID NO: 122067
  derived and/or modified sequence opt3 from hemagglutinin__InfluenzaA__ABK80113

SEQ ID NO: 123460 - RNA, 1701 nt, Artificial Sequence
  derived and/or modified sequence opt3 from hemagglutinin__InfluenzaA__ABK80124
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacgggcccuguccuagauauguuaaacagaauacucuuaagcuggcaacaggaaugaggaacgugccagagaaacaaacccggggcaucuucggcgccauagcuggguuuauugaaaauggaugggaggguaugauggacggcugguacggguuccgucaccagaacucugagggaacuggccaggccgcagaucuaaagagcacacaagcugccaucaaucagaucaacgguaaacucaaucgccugauugaaaagaccaacgagaaguuucaucagaucgaaaaagaguucucagaaguagaggggaggauucaggacuuagagaaguauguggaagauacgaaaauagaccuguggaguuacaaugcggagcuccuugucgcccuggaaaaccaacacaccaucgauuugacagacuccgagaugaacaagcuauucgaaagaacuaaaaagcagcugcgggagaaugcagaggauaugggcaacggaugcuuuaagauuuaucauaaaugugacaaugcuugcaucggcagcauccgaaacgggaccuacgaucacgacguguaccgcgacgaagcccucaauaacagauuccagauuaagggaguugagcugaaaucugguuauaagaauuggauacuuuggaucucauuugcuauuaguugcuuccuguuguguaucgugcuccugggcuuuauuaugugggccugccagaaagggaacaucagguguaauauaugcaucuga

SEQ ID NO: 123461 - RNA, 1701 nt, Artificial Sequence; identical to SEQ ID NO: 122067
  derived and/or modified sequence opt3 from hemagglutinin__InfluenzaA__ABK80135

SEQ ID NO: 123462 - RNA, 1701 nt, Artificial Sequence; identical to SEQ ID NO: 122067
  derived and/or modified sequence opt3 from hemagglutinin__InfluenzaA__ABK80146

SEQ ID NO: 123463 - RNA, 1701 nt, Artificial Sequence; identical to SEQ ID NO: 122067
  derived and/or modified sequence opt3 from hemagglutinin__InfluenzaA__ABK80157

SEQ ID NO: 123464 - RNA, 1701 nt, Artificial Sequence; identical to SEQ ID NO: 122578
  derived and/or modified sequence opt3 from hemagglutinin__InfluenzaA__ABK80168

SEQ ID NO: 123465 - RNA, 1701 nt, Artificial Sequence
  derived and/or modified sequence opt3 from hemagglutinin__InfluenzaA__ABK80179
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccgucccuaacgauaagccauuucagaauguuaaccgaaucacguacggggcaugucccagauaugugaaacagaauacucuuaagcuggccacaggaaugaggaacguaccugagaaacaaacccggggcauuuucggcgcuaucgccggguuuauagaaaauggaugggaggguaugauggacggcugguacggguuccgucaccagaacucugagggaacuggccaggcagcugaucuaaagagcacacaagccgcgauuaaucagaucaacgguaaacucaaucgccugaucgaaaagaccaacgagaaguuucaucagauugaaaaagaguucucagaaguggaggggagaauccaggacuuagagaaguaugucgaagauacgaaaauugaccuguggaguuacaaugccgagcuccuuguggcacuggaaaaccaacacaccauagauuugacagacuccgagaugaacaagcuauucgaaaggacuaaaaagcagcugcgggagaaugcugaggauaugggcaacggaugcuuuaagaucuaucauaaaugugacaaugccugcauuggcagcauccgaaacgggaccuacgaucacgacguuuaccgcgacgaagcucucaauaacagacugcagaucaagggaguggagcuuaaaucugguuauaaggauuggauucuguggauaucauucgccaucaguugcuuuuugcucuguauuguccuguuaggcuucaucaugugggcaugccagaaagggaauauuagguguaacaucugcauauga

SEQ ID NO: 123466 - RNA, 1701 nt, Artificial Sequence; identical to SEQ ID NO: 122578
  derived and/or modified sequence opt3 from hemagglutinin__InfluenzaA__ABK80190

SEQ ID NO: 123467 - RNA, 1701 nt, Artificial Sequence; identical to SEQ ID NO: 123321
  derived and/or modified sequence opt3 from hemagglutinin__InfluenzaA__ABK80201

SEQ ID NO: 123468 - RNA, 1701 nt, Artificial Sequence
  derived and/or modified sequence opt3 from hemagglutinin__InfluenzaA__ABK80212
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugauggcugguacggguuccgucaccagaacucugagggaaccggccaggcagcugaccugaaaagcacgcaagccgcgauuaaucagaucaacgguaaguugaaucgccucauugggaagaccaacgagaaauuucaccagauagaaaaggaguucucagaaguggagggcagaauccaggaucuggaaaaauauguagaggacacaaagauugauuuauggaguuacaaugccgagcugcucguggcacuugaaaaccaacauacuaucgaccugaccgauuccgagaugaacaaauuguucgaaaggacaaagaagcagcuacgggagaaugcugaagacaugggaaacggcugcuuuaaaaucuaucacaagugugauaaugccugcauugggagcauacgaaacggaacuuacgaccaugacgucuaccgcgaugaggcucugaauaacagauuccagaucaaagguguggagcucaagucuggcuauaaaaauuggauucuguggaucucauuugccauuaguugcuuccuucuguguguugcauugcucggguuuaucaugugggccugccagaagggaaacauaagguguaauaucugcauuuga

SEQ ID NO: 123469 - RNA, 1701 nt, Artificial Sequence; identical to SEQ ID NO: 122532
  derived and/or modified sequence opt3 from hemagglutinin__InfluenzaA__ABK80223

SEQ ID NO: 123470 - RNA, 1701 nt, Artificial Sequence
  derived and/or modified sequence opt3 from hemagglutinin__InfluenzaA__ABK80234
augagaaccaucauugcccugagcuacauacucugccuuguguucgcucagaagcugcccggcaacgacaauuccacagcaacuuuguguuuagggcaccaugccgucccuaacggaacgaucguuaaaaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaagaaaugggaucuguucguggaaagguccaaggccuauucuaauuguuaccccuaugacgucccugaucaugcaucguugcggucacucguggccagcagugguacucuggaguuuaacaaugaauccuucgacuggacagggguuacccagaacggaacgucuagcgcuugcaaacgccgauccaauaagucauuuuucagucgucugaacuggcucacucacuuaaaguacaaauauccagcacugaaugugaccaugcccaacaaugagaaguuugauaaacuuuacaucuggggcguccaucacccuggcacagacagcgaucagauuucuuuguaugcccaggcuuccgggagaaucacugugucaaccaagaggagccaacagacaguaauuccaaacaucggaagucggccccgcguuagagacgugucuuccaggauaagcauuuacuggaccaucgucaaaccuggugacauucugcuaaucaacucgacgggcaaucucaucgccccacggggguacuucaagauucgcucuggaaaguccucaauaaugcgaagugaugcgccgaucggcaaauguaacagcgagugcauuacucccaaugguuccaucccuaacgacaagccauuucagaaugugaacagaauaacauauggggcaugucccagguacgugaaacagaauacccugaagcuggccacuggaaugcggaacgucccugaaaaacaaacacguggcauuuucggcgcuaucgccggguuuaucgagaauggaugggaagguaugguugauggcugguauggguuccgccaccagaacucugagggaaccggccaggcagcugaccuuaagagcacgcaagccgcgauuaaucagaucaacgguaaauugaauagacucauugggaagaccaacgagaaguuucaucagauagaaaaagaguucucagaaguggagggcaggauccaggaucuggaaaaguacguagaggacacaaaaauugauuuauggaguuauaaugccgagcugcucguggcacuugaaaaccaacacacuaucgaccugaccgauuccgagaugaacaaguuguucgaacggacuaaaaagcagcuacgagagaaugcugaagacaugggaaacggcugcuuuaagaucuaccauaaaugugauaaugccugcauugggagcauacgcaacggaacauaugaccacgacgucuacagagaugaggcucugaauaacagguuccagaucaaggguguggagcucaaaucuggcuacaaggacuggauucuguggaucucauuugccauuaguugcuuccuucuguguguugcauugcucggguuuaucaugugggccugccagaaaggaaauauacgguguaacaucugcauuuga

SEQ ID NO: 123471 - RNA, 1701 nt, Artificial Sequence
  derived and/or modified sequence opt3 from hemagglutinin__InfluenzaA__ABK80245
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagcccauucuaauuguuaucccuacgacgucccugauuaugcaucguugaggucacucaucgccagcagugguacucuggaguuuaacaaugaauccuucaacuggacaggggugacccagaauggaacgucuagcgcuugcaagcggcgcuccaaccagucauuuuucagucgacugaauuggcucacucacuuaaaguuuaaauacccagcacugaacguuaccaugcccaauaacgagaaguucgacaaacuuuauauuuggggcgugcaucacccuggcacagauagcgaccagaucucuuuguacgcccaagcuccagggcguauuacugucuccaccaagagaucacagcagacagugauccccaacauaggaagcaggccucggguacgcgauauuaguucuagaaucuccauuuauuggaccaucguuaaaccaggugacauccugcuaauuaauagcacgggcaaccucauagccccgaggggguacuuuaagauccggucgggaaagucuuccauuaugaaaucagacgcgcccaucggcaaguguaauagugagugcauaacuccuaacgguagcauuccaaaugauaaacccuuccagaacgugaaucgcaucacauacggggcauguccucgauaugucaagcaaaacacccugaaacuugccacuggaaugagaaaugugccagaaaagcagacaaggggcaucuuuggcgcuauugccggguucaucgagaacggaugggaagguaugguggacggcugguacggguuucggcaccaaaauuccgagggaaccggccaggcagcugaucugaaaucuacgcaggccgcgauuaaccagauaaaugguaaguugaaccgucucaucgggaagaccaaugagaaauuccaucagauugaaaaggaguucagcgaagucgagggccgcauccaagaccuggaaaaauauguugaggauacaaagaucgacuuauggucauacaacgccgagcugcucguggcacuugaaaaccagcacacuauugaucugaccgacagugagaugaauaaauuguuugaaagaacaaagaagcagcuaagggagaacgcugaagauaugggaaauggcugcuucaaaauauaucauaagugugacaacgccugcaucggguccauucggaauggaacuuacgaucacgacguauaucgagacgaggcucugaacaaucgcuuucagaucaaagguguggagcucaagagcggcuacaaagauuggauucuguggaucucuuucgccauaucaugccuucuguugugugucgcacuccugggguuuaucaugugggccugccaaaagggaaacauuagauguaauaucugcauuuga

SEQ ID NO: 123472 - RNA, 1701 nt, Artificial Sequence; identical to SEQ ID NO: 123471
  derived and/or modified sequence opt3 from hemagglutinin__InfluenzaA__ABK80256

SEQ ID NO: 123473 - RNA, 1701 nt, Artificial Sequence; identical to SEQ ID NO: 122628
  derived and/or modified sequence opt3 from hemagglutinin__InfluenzaA__ABK80267

SEQ ID NO: 123474 - RNA, 1701 nt, Artificial Sequence; identical to SEQ ID NO: 122649
  derived and/or modified sequence opt3 from hemagglutinin__InfluenzaA__ABK80278

SEQ ID NO: 123475 - RNA, 1701 nt, Artificial Sequence
  derived and/or modified sequence opt3 from hemagglutinin__InfluenzaA__ABK80289
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuuuucuuuaugcccaggcuagcgggcguaucacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaaguuggccacuggaaugaggaacgugccagaaaaacaaacacggggcaucuucggcgcuaucgccggguuuauugagaauggaugggaagguauggucgauggcugguauggguuccgucaccagaacagugagggaaccggccaggcagcugaccugaaaagcacgcaagccgcgaucaaucagauuaacgguaaauugaaccgccucauagggaagaccaaugagaaguuccaccagaucgaaaaagaguuuuccgaaguugagggcaggauucaggaucuggaaaaguacguggaggacacaaaaaucgauuuauggucuuauaacgccgagcugcucguagcacuugaaaaucaacauacuaucgaccugaccgauagcgagaugaacaaguuguucgaaagaacaaagaagcagcuacgggagaaugcugaagacaugggaaacggcugcuuuaagauuuaccacaaaugugauaaugccugcauagggucaauccgaaacggaacuuaugaccaugauguguaccgcgacgaggcucugaauaacagauuccagauuaagggugucgagcucaaaaguggcuacaaggacuggauccuguggauuuccuuugccaucagcugcuuccuucuguguguggcauugcucggguuuauaaugugggccugccagaaaggaaauaucagguguaacauuugcaucuga

SEQ ID NO: 123476 - RNA, 1701 nt, Artificial Sequence; identical to SEQ ID NO: 122067
  derived and/or modified sequence opt3 from hemagglutinin__InfluenzaA__ABK80300

SEQ ID NO: 123477 - RNA, 1701 nt, Artificial Sequence; identical to SEQ ID NO: 122067
  derived and/or modified sequence opt3 from hemagglutinin__InfluenzaA__ABK80311

SEQ ID NO: 123478 - RNA, 1707 nt, Artificial Sequence
  derived and/or modified sequence opt3 from hemagglutinin__InfluenzaA__ABL07019
auggagaagaucgugcugcuccuuagcauugucucccugguuaaaucugaccagauaugcaucggcuaccacgccaacaauucaaccgaacaaguggauacaauuauggagaagaacguaacugugacgcaugcucaggacaucuuggaaaagacccacaaugggaaauuaugugaucuggacggagucaaaccccuaauucucagagauugcaguguggcagguuggcugcuuggcaacccuaugugugacgaguucaucaauguuccagaauggagcuauauaguggagaaggccaacccgacaaaugaucugugcuaccccggguccuuuaacgacuaugaggaauugaagcaucuccugucuaggaucaaucacuucgagaaaauucagaucauuccuaagucgucauggagcgaucaugaagcgaguuccggagucucuagcgcuuguccauaccugggcucccccucauuuuuccggaacgugguauggcucacuaaaaagaauaguaccuauccuacaaucaaaaagagcuacaacaauaccaaccaggaggacuuacugguucuuugggguauacaccacccaaauaacgaggccgaacaaacucgcuuguaucagaaccccacaaccuacauuucuaucgggacguccacucugaaucagcgucuagugccuaagauugcaacccgaucaaaagucaacggacagagcggcagaauggaguuuuucuggacaauccucaagccaaaugaugccaucaacuuugaaaguaauggcaacuucauugcuccggaguacgcauauaaaauagugaagaaaggggacucugccaucaugaaguccgaacuggaguacagcaauugcaacacuaaaugucaaacccccaugggagcuauuaauucgucuaugccuuuucauaacauccacccacuuacaauaggugagugccccaaguaugugaaguccaauaggcuggucuuggccaccggccuccggaacucaccucagcgcgaaaguagaaggaaaaagcgggggcuguucggagcgauugcaggcuuuaucgaggguggguggcagggaaugguugauggcugguacggcuaucaucacagcaaugaacagggguccggauacgccgcugacaaagagucuacgcaaaaggccaucgacggugugacuaacaaaguaaauagcauuaucgauaagaugaacacacaguucgaagcagugggccgcgaguuuaacaauuuagagcgaagaauugaaaaccugaauaagaaaauggaggacggguuccucgaugucuggaccuauaacgcugaacuucugguguugauggagaaugaaaggacucuagacuuccacgauucaaacguuaagaaucuguacgacaaagugcggcuccagcugcgugauaacgccaaggagcuuggaaauggcuguuuugaguucuaccauaaaugcgacaacgaauguauggagaguauacgcaaugguacauauaacuacccacaauauuccgaagaggcgagacugaagagggaggaaaucagcggggucaaguuggagucuauuggcaccuaccagauccucucaaucuauaguacgguggccagcucccuggcauuagcuauuaugauagccggacugucucuauggaugugcucgaauggcagccuccagugccggaucuguauuuga

SEQ ID NO: 123479 - RNA, 1707 nt, Artificial Sequence
  derived and/or modified sequence opt3 from hemagglutinin__InfluenzaA__ABL07030
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccgacaaaugaucugugcuaccccgggagcuuuaacgacuaugaggaauugaagcaucuccuguccaggaucaaucacuucgagaaaauucagaucauuccuaagucuucguggucagaucaugaagcuagcaguggagucuccucugccuguccauaccugggcagccccuccuuuuuccggaacgugguauggcucaucaaaaagaacucaacuuauccuaccauuaaaaagaguuacaauaauacaaaccaggaggacuuacugguucuuugggguauacaccacccaaaugaugcagccgagcaaacccgcuuguaucagaaccccacuacauacaucagcauugggaccucuacgcugaaccagcggcuagugccuaagaucgcuacucguuccaaagucaauggacagucaggcagaauggaauuuuucugggcaauccucaagccaaacgacgccauuaauuuugagagcaacggcaauuucauagcuccggaauacgccuauaaaaucgugaagaaaggggauagugcgauuaugaagucugagcuggaauacggaaacugcaauaccaaaugucaaacacccaugggugcaaucaacuccagcaugccuuuucauaauauacacccacuuacuauuggcgagugccccaaguaugugaagucgaacaggcuggucuuggccaccgggcuccgaaauucuccucagcgcgaguccagaaggaaaaagcggggacuguucggcgcuaucgccgguuuuaucgaagggggauggcagggcaugguugacggcugguacggguaucaucacucaaacgagcagggaagugguuacgcagcugacaaagaaagcacacaaaaggccauugauggcgugaccaauaaaguaaacuccaucauugacaagaugaauacgcaguucgaggcgguggggcgcgaauuuaacaacuuagagcgaagaauagagaaucugaacaagaaaauggaagauggauuccucgacgucuggacuuauaaugccgagcuucugguguugauggaaaacgagaggacacuagauuuccacgacucuaauguuaagaaccuguacgauaaagugcggcuccagcugcgugacaaugcaaaggaacuuggcaacgguuguuuugaguucuaccauaaaugcgauaaugaguguauggaaagcauccgcaacgggaccuauaauuacccacaauauucagaggaagcuagacugaagagggaggagauuaguggcgucaaguuggaauccaucggaacuuaccagauccucagcauuuauucuacaguggccucaagucuggcuuuagccauaaugaucgcaggccugagccuauggaugugcuccaacgggucucuccagugccggauuuguaucuga

SEQ ID NO: 123480 - RNA, 1707 nt, Artificial Sequence
  derived and/or modified sequence opt3 from hemagglutinin__InfluenzaA__ABL10088
auggagaagaucgugcuucucuucgccauugucagccuuguuaaauccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaugaugcagccgagcagacaaagcuguaucagaacccaaccacuuacaucagugucgggacaagcaccuugaaccagcgacuggugccccguauugcuacgagaucugaagugaauggacaauccggcaggauggaguucuuuuggacuauccuaaaaccuaacgacgcaaucaauuucgaaucaaacggcaauuuugucgccccagaguacgcuuauaagauuguuaaaaagggggauagcaccauaaugaaaagugaacucgaguacggaaacugcaauacaaagugucagacuccgaugggugccaucaacucuuccaugcccuuccauaauauucacccucugaccaucggcgagugcccaaaauauguaaagagcaaccggcuugugcuggcgacaggguugcgcaauucgccccagagagaaaggcggcgcaagaaacgaggacucuuuggcgcaauagccgguuucauugaagggggauggcagggcaugguggacggcugguacggguaucaucacucuaacgaacaaggauccgguuacgcugccaauaaggagucaacccagaaagcaaucgacggcgucacgaacaaggugaauaguaucauugauaaaaugaacacucaguuugaagcuguugggagagaguucaacaaucuggagaggcggaucgaaaacuuaaauaagaagauggaggacggauuccuggauguguggacauauaacgccgaacuccuuguccugauggagaaugaacguaccuuggacuuucacgauagcaacgugaaaaaucuauacgacaagguacgccugcaacucagagauaacgcgaaagagcugggcaaugguuguuucgaguuuuaccauaagugcgacaacgaauguauggaguccguuaggaaugggacuuaugauuacccucaguauucugaagaggcccggcuuaaacgagaggaaauuagcggcgugaagcuggagucaauaggaaucuaccagauuuugaguaucuauuccacagucgcaagcucucucgcucuggccaucaugguggcuggcuuaucacuguggaugugcaguaacgggagccuacagugccgcauuuguauauga

SEQ ID NO: 123481 - RNA, 1707 nt, Artificial Sequence
  derived and/or modified sequence opt3 from hemagglutinin__InfluenzaA__ABL31766
auggagaagaucgugcugcuccuugccauugucagcuucguuaaauccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucaaaccccugauucuaagagauugcucaguggccgguuggcuccugggcaacccuaugugugacgaauuuaucaauguuccagaauggaguuauauaguggagaaggcgaacccgacaaaugaucuuugcuaccccgggagcuucaacgacuaugaggaacugaagcauuugcucuccaggaucaaucacuuugagaaaauucagaucauuccuaagucuucguggucagaucaugaagcuagcaguggagucuccucugccuguccauaccugggcagccccuccuucuuucggaacgugguauggcugaucaaaaagaacucaacuuauccuaccauuaaaaagaguuacaauaauacaaaccaggaggaccucuuaguucugugggguauacaccacccaaaugaugcagccgagcaaacccgccuuuaucagaaccccacuacauacaucagcauugggaccucuacguugaaccagcgacuggugccuaagaucgcuacucguuccaaagucaauggacagucaggcagaauggaguucuuuugggcaauccuaaagccaaacgacgccauuaauuucgaaagcaacggcaauuuuauagcuccggaauacgccuauaaaaucgugaagaaaggggauagugcgauuaugaagucugagcucgaauacggaaacugcaauaccaaaugucaaacacccaugggugcaaucaacuccagcaugccuuuccauaauauacacccacugacuauuggcgagugccccaaguaugugaagucgaacaggcuuguccuggccaccggguugcgcaauucuccucagcgggaguccagaaggaaaaagcggggacucuuuggcgcuaucgccgguuucaucgaagggggauggcagggcaugguugacggcugguacggguaucaucacucaaacgagcagggaagugguuacgcagcugacaaagaaagcacacaaaaggccauugauggcgugaccaauaaaguaaacuccaucauugacaagaugaauacgcaguuugaggcgguggggcgcgaguucaacaaccuggaacgaagaauagagaauuuaaacaagaaaauggaagauggauuccuggacgucuggacuuauaaugccgagcuccuugugcugauggaaaacgagaggacauuggauuuucacgacucuaauguuaagaaccuauacgauaaagugcggcugcagcuccgugacaaugcaaaggaacugggcaacgguuguuucgaguuuuaccauaaaugcgauaaugaguguauggaaagcauccgcaacgggaccuauaauuacccacaauauucagaggaagcuagacuuaagagggaggagauuaguggcgucaagcuggaauccaucggaacuuaccagaucuugagcauuuauucuacaguggccucaagucucgcucuggccauaaugaucgcaggcuuaagccuguggaugugcuccaacgggucucuacagugccggauuuguaucuga

SEQ ID NO: 123482 - RNA, 1707 nt, Artificial Sequence
  derived and/or modified sequence opt3 from hemagglutinin__InfluenzaA__ABL31780
auggagaagaucgugcugcuccuuagcauugucucccugguuaaaucugaccagauaugcaucggcuaccacgccaacaauucaaccgaacaaguggauacaauuauggagaagaacguaacugugacgcaugcucaggacaucuuggagaaaacccacaaugggaaguuaugugaucuggacggagucaaaccccuaauucucagagauugcaguguggcagguuggcugcuuggcaacccuaugugugacgaguucaucaauguuccagaauggagcuauauaguggagaaggccaacccgacaaaugaucugugcuaccccggguccuuuaacgacuaugaggaauugaagcaucuccugucuaggaucaaucacuucgagaaaauucagaucauuccuaagggaucguggucagaucaugaagcgagcaguggcgucuccucugcuuguccauaccugcggagccccuccuuuuuccgcaacgugguauggcucaucaaaaagaacucaacuuauccuaccauuaaaaagaguuacaauaauacaaaccaggaggacuuacugguucuuugggguauacaccacccaaauaacgaggccgaacaaacccgauuguaucagaaccccacuacauacaucagcauugggaccucuacgcugaaucagcgucuagugccuaagaucgcaacuagauccaaagucaacggacagucaggcaggauggaguuuuucuggaccauccucaagccaaaugaugccauuaacuuugaaagcaauggcaacuucauagcuccggaguacgcauauaaaaucgugaagaaaggggacagugccauuaugaagucugaacuggaguacggaaauugcaacacaaaaugucaaacucccaugggugcuaucaauuccagcaugccuuuucauaacauacacccacuuaccauuggcgagugccccaaguaugugaagucgaaucggcuggucuuggccacagggcuccgcaacucuccucagagagaauccaggcggaaaaagcgcggacuguucggcgcgaucgcagguuuuaucgaagggggauggcagggcaugguugauggcugguacggguaucaucacucaaaugaacagggaagugguuacgccgcugacaaagagagcacccaaaaggccauugacggcgugacgaacaaaguaaauuccaucauugauaagaugaacacucaguucgaagcaguggggcgagaguuuaacaauuuagagagaaggauagaaaaccugaauaagaaaauggaggacggauuccucgaugucuggacauauaacgcugaacuucugguguugauggagaaugaacggacccuagacuuccacgauucuaacguuaagaaucuguacgacaaagugcgucuccagcugcgcgauaacgccaaggagcuuggcaaugguuguuuugaguucuaccauaaaugcgacaacgaauguauggagagcaucagaaaugggacuuauaacuacccacaauauucagaagaggcgaggcugaagcgggaggaaauuaguggcgucaaguuggaguccaucggaacauaccagauccucagcauuuauucuaccguggccucaagucuggcauuagcuauaaugaucgccggccugagccuauggaugugcuccaaugggucucuccagugccgaauuuguaucuga

SEQ ID NO: 123483 - RNA, 1701 nt, Artificial Sequence
  derived and/or modified sequence opt3 from hemagglutinin__InfluenzaA__ABL67165
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaagcgguauuugcgacuccccacaccagauccuagauggcgagaauuguacccucauagacgcucugcuuggggauccgcagugcgacggauuucaaaacaaaaagugggaucuguucguggaaagaucuaaagccuauucgaauuguuaccccuaugacgucccugaucaugcaucauugaggagccucguggccaguuccggcacucuggaguuuaacaaugaaucuuucgacuggacagguguuacccagaacgggacgagcuccgcuugcaagcggcgcucaaauaagagcuuuuucagucgacugaacuggcucacucacuuaaaauacaaguauccagcacugaaugugaccaugcccaacaaugagaaauuugauaaacuuuacaucuggggaguccaucacccuggcacagacucugaucagauuuccuuguaugcccaggcuucaggccguaucacugugagcaccaagagaagucaacagacaguaauuccaaacaucgggucuaggccccggguucgcgacguguccagcagaauaucgauuuacuggaccaucgucaagccuggagacauucugcuaaucaacucuacggguaaucucaucgccccaaggggcuacuucaagauucgguccgggaaaucaaguauaaugcgcagcgaugcgccgaucggaaaguguaacuccgagugcauuacucccaauggcucuaucccuaacgacaaaccauuucagaaugugaaccgaauaacauauggugcaugucccagauacgugaagcagaauacccugaaacuugccacugggaugaggaacgucccugaaaagaaaacacggggaauuuucggcgcuaucgccggcuuuaucgagaaugggugggaaggaaugguugaugguugguauggcuuccgucaccaaaacagcgaggggaccggacaggcagcugaccugaagucaacgcaggccgcgauuaaucaaaucaacggcaaguugaaucgccucauugguaaaaccaacgagaaguuucaucagauagaaaaagaguucagugaaguggaggggagaauccaggaucuggaaaaguacguagaggacacaaaaauugauuuaugguccuauaaugccgagcugcucguggcacuugaaaaccagcacacuaucgaccugaccgauagcgagaugaacaaguuguucgaaaggacaaagaaacaacuacgggagaaugcugaagacaugggcaacggaugcuuuaagaucuaccauaaaugugauaaugccugcauuggcucuauacgaaacgggacuuaugaccacgacgucuaccgcgaugaggcucugaauaacagauuccagaucaagggaguggagcucaaaucagguuacaaggacuggauucuguggaucaguuuugccauuagcugcuuccuucuguguguugcauugcucggcuuuaucaugugggccugccagaaggggaauauaagguguaacaucugcauuuga

SEQ ID NO: 123484 - RNA, 1701 nt, Artificial Sequence
  derived and/or modified sequence opt3 from hemagglutinin__InfluenzaA__ABL67176
augaagaccaucauugcccugagcuacauacucugccuuguguucacacagaaacugcccggcaacgacaauuccacugcuacguuguguuuagggcaccaugcagucccuaacggaacccugguuaagacaaucacuaaugaucaaauugaggugaccaacgccacagagcuaguacagucuucaaguaccgguggcaucugcgacagcccacaccagauucucgauggggaaaauuguacucugaucgacgcgcuucugggagauccgcauugcgacggcuuucagaacaaagaaugggauuuguucguggagagauccagggcuuauucuaauuguuaccccuaugacgucccugauuacgccucgcuccggucacugguggcaagcagugguacacuggaauuuaacaaugaguccuucaacuggaccgggguugcccaaaauggaacgucuagcgcuugcaagcgccgauccaacaaaucauuuuucagucgucucaauugguuacaccagcugaaguauaaguacccagcacuuaacgugacuaugcccaauaacgagaaauuugacaaguuguauauauggggcguccaucacccuagcaccgauucugaccagaucucccuguacgcccaggcuccaggcagagugacaguaucaacuaaaaggagccaacagaccguuauucccaacaucgggagucggccuugggugcgcggagucucuuccagaauuagcaucuacuggacaauagugaagccaggugauauucuacucaucaauuguaccggcaaccugauugccccgaggggguauuucaaaauccggucgggaaagucuuccaucaugcgcucagacgcgaguauuggcaagugcaauagcgaauguauaacgcccaacgguuccaucccuaaugacaaaccauuucagaacgugaaucgaauuacuuacggggcaugccccagauaugucaagcagaacacacuuaaacuggccaccggaaugaggaauguuccugagaagcaaacucggggcaucuucggcgcuauagccggguuuauugaaaacggaugggaggguaugguggauggcugguacggguuccgucaccaaaauucugagggaacaggccaggcagcugacuugaaaagcacccaggccgcgaucaaccagaucaaugguaagcucaaccgccugauugagaaaacgaaugaaaaguuucaucagaucgaaaaggaguucucagaaguagaggggaggauucaggauuuagagaaauauguggaagacaccaagauagaucuguggaguuacaacgccgagcuccuugucgcacuggaaaaccaacacacaaucgacuugacugauuccgagaugaauaaacuauucgaaagaaccaagaaacagcugcgggagaacgcugaggacaugggcaauggauguuuuaagauuuaucauaagugcgauaacgccugcaucggcagcauccgaaaugggacauacgaccacgauguguaccgcgacgaagcucucaacaauagauuccagauuaaaggaguugagcugaagucugguuauaaagacuggauacuuuggaucucauuugccauuaguuguuuccuguugugcgugguccuccugggcuuuaucaugugggcaugucagaaggggaacauuaggugcaauaucuguauauga

SEQ ID NO: 123485 - RNA, 1701 nt, Artificial Sequence; identical to SEQ ID NO: 123448
  derived and/or modified sequence opt3 from hemagglutinin__InfluenzaA__ABL67187

SEQ ID NO: 123486 - RNA, 1701 nt, Artificial Sequence; identical to SEQ ID NO: 123403
  derived and/or modified sequence opt3 from hemagglutinin__InfluenzaA__ABL67209

SEQ ID NO: 123487 - RNA, 1701 nt, Artificial Sequence; identical to SEQ ID NO: 122937
  derived and/or modified sequence opt3 from hemagglutinin__InfluenzaA__ABL67253

SEQ ID NO: 123488 - RNA, 1701 nt, Artificial Sequence
  derived and/or modified sequence opt3 from hemagglutinin__InfluenzaA__ABL67264
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacaaccacaaugggaaacucugcaagcugaaaggaauagcuccccuucagcuggguaaguguucaaucgccggcuggauuuuggggaacccugagugcgaaagucucuucagcaagaaauccuggucuuauaucgcagagaccccaaauucggaaaacggaacauguuacccgggcuauuuugccgauuacgaggagcugagagaacaacugucaagcgucaguuccuucgagagguuugaaauuuuccccaaggagucuagcuggccuaaacauaaugugaccaaggguguuacugcuuccugcucacacaaagggaagaguagcuuuuaucggaaccucuuauggcugacagagaagaauggaucuuacccaaaccuuuccaaaucauaugugaauaacaaggaaaaagaggucuuggugcuguggggcguacaucaccccagcaauaucgaagaccagaagaccauauaccgcaaagagaacgcauacguuaguguggucucuucccacuauaaccgacguuucacgccugaaaucgccaagagaccaaaagugaggaaucaggagggccggauuaacuacuauuggacucuacucgagcccggggauaccaucauuuuugaagcuaauggaaaccugaucgccccuugguacgcguucgcacuuagccgcgguuuuggcucggggauaauuacaucuaaugccuccauggacgagugugaugcuaagugccagacuccacaaggagccaucaacucaaguuucccguuucagaaugugcaucccgucaccauuggcgaauguccuaaguauguuagaagcacaaaacugaggauggugaccgguuugcggaacaucccauccauccagucucgcggacucuucggggcaauugcuggcuuuauagagggcggguggacgggaaugaucgacgguugguacggcuaucaccaucagaaugaacaagggagcggauacgccgcggaucagaagucaacucagaacgccauuaauggcaucacaaacaaaguaaauaguauaauugagaagaugaacacccaguucacugcaguggguaaagaguucaauaagcuggaaaagcgaauggagaacuuaaacaaaaaggucgacgauggguuucuggacaucuggacauacaaugcugaacuccuugugcuguuggagaacgaaagaacccuagacuuccacgauuccaauguuaaaaaccuguaugagaaggugaaaagccaacucaagaauaacgccaaggagaucggcaauggaugcuuugaguucuaccacaaauguaacaaugaaugcauggaaucugucaagaacggcacguaugacuaccccaaauauucagaggagaguaagcugaauagggaaaagauugauggggugaaacuugagagcaugggaguauaccagauccuggcuauuuauuccaccguugccucuucguuggugcuccuggucagcuuaggugcaauauccuuuuggaugugcucaaacggcagucugcagugucggaucugcauuuga

SEQ ID NO: 123489 - RNA, 1701 nt, Artificial Sequence
  derived and/or modified sequence opt3 from hemagglutinin__InfluenzaA__ABL67275
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacuuaaacuggcuaccgguaugaggaaugugccugagaagcagacucgggggauauucggagccauugcaggcuuuaucgaaaacggcugggaggggaugguagacggaugguacgguuuccgucaucaaaauagcgagggcacagggcaggcugccgauuugaaaucaacccaggcggccaucaaccaaauuaauggaaagcucaaccgccugaucgagaaaacgaaugaaaaguuucaccagauugaaaaggaguucagugaaguggagggcagaauacaggacuuagagaaauaugucgaagauaccaagaucgaccugugguccuacaacgcagagcuccuuguggcucuggaaaaccagcauacaauugauuugacugacagcgagaugaauaaacuauucgaaaggacccggaagcaacugcgagagaacgccgaggauguugguaaugggugcuuuaaaaucuaucacaagugugacaacgcuugcaucggcucuauucgcaauggaacauacgaucacgacguguacagagaugaagcccucaacaauagguuccagauaaagggcgucaaacugaagucaggguauaaagacuggauccuuuggauuaguuuugcaaucagcugcuuccuguugugugugguacuccugggauuuauuaugugggccugccagaaggguaacauccgguguaauauaugcaucuga

SEQ ID NO: 123490 - RNA, 1701 nt, Artificial Sequence
  derived and/or modified sequence opt3 from hemagglutinin__InfluenzaA__ABL67286
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaucgggugacauucuacucaucaacucuacaggcaaucugauugccccuaggggguauuucaagauccgguccggaaagucaaguaucaugcgcagcgacgcgccaauuggcaaauguaacuccgaaugcauaaccccgaaugguucuauccccaacgauaagccuuuucagaaugucaaccgaauuacguacgggccaugucccagauauguuaaacagaauacucuuaagcuggcaacaggaaugaggaacgugccugagaaacaaacccggggcaucuucggcgccauagcuggguuuauugaaaauggaugggaggguaugauggacggcugguacggguuccgucaccagaacagcgagggaacuggccaggccgcagauuugaagucaacacaagcugccaucaaucagaucaacgguaaacucaaucgccugauugaaaagaccaacgagaaguuucaucagaucgaaaaagaguucagugaaguagaggggaggauucaggacuuagagaaguauguggaagauacgaaaauagaccugugguccuacaaugcggagcuccuugucgcccuggaaaaccaacacaccaucgauuugacagacagcgagaugaacaagcuauucgaaagaacuaaaaagcagcugcgggagaaugcagaggauaugggcaacggaugcuuuaagauuuaucauaaaugugacaaugcuugcaucggcucuauccgaaacgggaccuacgaucacgacguguaccgcgacgaagcccucaauaacagauuccagauuaagggaguugagcugaaaucagguuauaaggauuggauacuuuggaucaguuuugcuauuagcugcuuccuguuguguaucgugcuccugggcuuuauuaugugggccugccagaaagggaauaucagguguaacauaugcaucuga

SEQ ID NO: 123491 - RNA, 1701 nt, Artificial Sequence; identical to SEQ ID NO: 123021
  derived and/or modified sequence opt3 from hemagglutinin__InfluenzaA__ABL67297

SEQ ID NO: 123492 - RNA, 1701 nt, Artificial Sequence
  derived and/or modified sequence opt3 from hemagglutinin__InfluenzaA__ABL67308
augaagaccaucauugcccugagcuacauacucugccuuguguucgcucagaaacugcccggcaacgacaauuccauggcaacauuguguuuagggcaccaugccgucccuaacggaacucugguuaagacgaucaccaaugaucaaauugaggugacaaacgcgacugaacuuguacagucuucaaguaccgguagaaucugcgacagcccacaccagauucucgauggcgagaauuguacacugaucgacgcucuacugggggauccgcauugcgacggauuucagaacaaagaaugggauuuguucguggagagguccaaggccuauucuucguguuaccccuaugacgucccugauuacgugucacuccggagccugguugcaaguuccggcacccuggaauuuaauaacgagucuuucaauuggacugguguggcccaaaacgggacaagcuccgcuugcaaacgccgaucagacaagagcuuuuucagucgucucaauugguuacaccagcugaaguauaaauacccagcacuuaacgucaccaugcccaauaacgagaaguuugauaaauuguauauauggggagugcaucacccuggcacggacucugaucagaucucccuguacgcccaggcuucaggcagaguaacuguuagcaccaagaggagucaacagacagugauuccaaauaucgggucucggcccuggguccgcggaguguccagcagaauuucgaucuacuggacuauagugaaaccuggugacauucuacucaucaacucuaccggcaaccugauugccccaaggggguauuucaagauccgguccggaaagucaaguaucaugcgcagcgacgcgccgauugauaaauguaauuccgaaugcauaacacccaacggcucuaucccuaaugacaagccauuucagaacgucaaucgaauuaccuacggucuuugucccagauauguuaaacagaacacgcugaaguuggcaacugggaugaggaaugugccugagaaacaaacacggggaaucuucggcgccauagcuggcuuuauugaaaacgggugggagggaaugauggaugguugguacggcuuccgucaccagaauagcgaggggaccggacaggccgcagaccucaagucaacucaagcugccaucaaccagaucaauggcaaacugaaccgcuuaauugaaaagacaaaugagaaguuucaucagaucgaaaaagaguucagugaaguagaggguaggauucaggaucuggagaaguauguggaagacaccaaaauagaucucugguccuacaacgcggagcuucuggucgccuuggaaaaucaacacacgaucgaccuaaccgauagcgagaugaacaagcuguucgaaagaacuaaaaagcagcuccgggagaacgcagaggacauggggaauggcugcuuuaagauuuaucauaaaugugauaacgcuugcaucggaucuauccgaaauggcacauacgaccacgacguguaccgcgaugaagcccugaacaauagauuccagauuaaggggguugagcuuaaaucaggauauaaggacuggauacuguggaucaguuuugcuauuagcugcuucuugcucuguaucgugcuguuagguuuuauuaugugggccugccagaaaggcaacgucagguguaauaucugcauauga

SEQ ID NO: 123493 - RNA, 1701 nt, Artificial Sequence; identical to SEQ ID NO: 122578
  derived and/or modified sequence opt3 from hemagglutinin__InfluenzaA__ABL67319

SEQ ID NO: 123494 - RNA, 1701 nt, Artificial Sequence; identical to SEQ ID NO: 123321
  derived and/or modified sequence opt3 from hemagglutinin__InfluenzaA__ABL67330

SEQ ID NO: 123495 - RNA, 1701 nt, Artificial Sequence; identical to SEQ ID NO: 122532
  derived and/or modified sequence opt3 from hemagglutinin__InfluenzaA__ABL67341

SEQ ID NO: 123496 - RNA, 1701 nt, Artificial Sequence; identical to SEQ ID NO: 122532
  derived and/or modified sequence opt3 from hemagglutinin__InfluenzaA__ABL67352

SEQ ID NO: 123497 - RNA, 1701 nt, Artificial Sequence; identical to SEQ ID NO: 122048
  derived and/or modified sequence opt3 from hemagglutinin__InfluenzaA__ABL67363

SEQ ID NO: 123498 - RNA, 1701 nt, Artificial Sequence
  derived and/or modified sequence opt3 from hemagglutinin__InfluenzaA__ABL67374
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagcccauucuaauuguuaucccuacgacgucccugauuaugcaucguugaggucacucaucgccagcagugguacucuggaguuuaacaaugaauccuucaacuggacaggggugacccagaauggaacgucuagcgcuugcaagcggcgcuccaaccagucauuuuucagucgacugaauuggcucacucacuuaaaguuuaaauacccagcacugaacguuaccaugcccaauaacgagaaguucgacaaacuuuauauuuggggcgugcaucacccuggcacagauagcgaccagaucucuuuguacgcccaagcuccagggcguauuacugucuccaccaagagaucacagcagacagugauccccaacauaggaagcaggccucggguacgcgauauuaguucuagaaucuccauuuauuggaccaucguuaaaccaggugacauccugcuaauuaauagcacgggcaaccucauagccccgaggggguacuuuaagaugcggucgggaaagucuuccaucaugaaaucagacgcgcccauuggcaaguguaauagugagugcaucacuccuaacgguagcauaccaaaugauaaacccuuccagaacgugaaucgcauuacauacggggcauguccucgauaugucaagcaaaacacccugaaacuugccacuggaaugagaaaugugccagaaaagcagacaaggggcaucuuuggcgcuaucgccggguucauugagaacggaugggaagguaugguggacggcugguacggguuucggcaccaaaauuccgagggaaccggccaggcagcugaucugaaaucuacgcaggccgcgaucaaccagauuaaugguaaguugaaccgucucauagggaagaccaaugagaaauuccaucagaucgaaaaggaguucagcgaagucgagggccgcauucaagaccuggaaaaauauguugaggauacaaagaucgacuuauggucauacaacgccgagcugcucguggcacuugaaaaccagcacacuaucgaucugaccgacagugagaugaauaaauuguuugaaagaacaaagaagcagcuaagggagaacgcugaagauaugggagacggcugcuucaaaauuuaucauaagugugauaaugccugcauaggguccauccggaacggaacuuacgaccacgacguauaucgagaugaggcucugaauaaccgcuuucagauuaaagguguggagcucaagagcggcuacaaagacuggauccuguggauuucuuucgccaucucaugccuucuguugugugucgcacuccugggguuuauaaugugggccugccaaaagggaaauaucagauguaacauuugcaucuga

SEQ ID NO: 123499 - RNA, 1701 nt, Artificial Sequence; identical to SEQ ID NO: 122298
  derived and/or modified sequence opt3 from hemagglutinin__InfluenzaA__ABL67385

SEQ ID NO: 123500 - RNA, 1701 nt, Artificial Sequence; identical to SEQ ID NO: 122628
  derived and/or modified sequence opt3 from hemagglutinin__InfluenzaA__ABL67396

SEQ ID NO: 123501 - RNA, 1701 nt, Artificial Sequence; identical to SEQ ID NO: 122646
  derived and/or modified sequence opt3 from hemagglutinin__InfluenzaA__ABL67407

SEQ ID NO: 123502 - RNA, 1701 nt, Artificial Sequence
  derived and/or modified sequence opt3 from hemagglutinin__InfluenzaA__ABL67418
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcaauagcccacaccagauccuagacggggagaacuguacccucauagaugcucugcuuggagacccgcagugcgauggcuuucaaaauaaaaagugggaccuguucguggaaagauccaaagccuauucuaacuguuaccccuaugaugucccugacuacgcaucguugaggucacucguggccagcagugguacucuggaguuuaauaacgaauccuucaauuggacagggguuacccagaacggaacgucuagcgcuugcaagcggcgcuccaauaacucauuuuucagucgacugaauuggcucacucauuuaaaguuuaaauauccagcacugaacgugaccaugcccaacaaugagaaguucgauaaacuuuacaucuggggcguccaccauccuggcacagacaacgaucagaucuuuuuguaugcccaggcuagcgggcguauuacugugucuaccaagagaucccaacagacaguaauuccaaauaucggaucaaggccccggguucgcaacauaccuagcagaauuaguaucuacuggaccauugugaaaccaggugacauccugcuaaucaauucuacgggcaaccucauugccccgaggggguacuucaagauacgguccggaaagagcucgaucaugcgcucugaugcgcccauuggcaaauguaauuccgagugcaucacuccuaacgguucaauaccaaaugacaagcccuuucagaacgucaaucgaauuacauauggggcauguccuagauacgugaaacagaacacccugaagcuggccacuggaaugaggaaugugccagaaaaacaaacacggggcaucuucggcgcuaucgccggguuuauugagaacggaugggaagguauggucgacggcugguauggguuccgucaccagaauagugagggaaucggccaggcagcugaucuuaagagcacccaagccgcgauuaaccagauaaacgguaaauugaaucgccucaucgggaagacgaacgagaaguuccaccagauugaaaaagaguuuuccgaaguugagggcagaauccaggaccuggaaaaguacguggaggauaccaaaaucgacuuauggucuuauaaugccgagcugcucguagcacuugaaaaccaacauacaauugaucugacugacagcgagaugaauaaguuguucgaaaggaccaaaaagcagcuacgggagaacgcugaagauaugggaaauggcugcuuuaagauauaccacaaaugugacaacgccugcaucgggucaauucgaaauggaacauaugaucaugacguguaccgcgaugaggcucugaacaauagauuccagaucaagggugucgagcucaaaaguggcuacaaggacuggauucuguggaucuccuuugccauaagcugcuuccuucuguguguggcauugcucggguuuaucaugugggccugccagaaaggaaacauuagguguaauaucugcauuuga

SEQ ID NO: 123503 - RNA, 1707 nt, Artificial Sequence; identical to SEQ ID NO: 122044
  derived and/or modified sequence opt3 from hemagglutinin__InfluenzaA__ABL67781

SEQ ID NO: 123504 - RNA, 1707 nt, Artificial Sequence
  derived and/or modified sequence opt3 from hemagglutinin__InfluenzaA__ABL67794
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaugaugcagccgagcagacaaaacuuuaucagaacccaaccacuuacaucagugucgggacaagcaccuugaaccagcgacuggugccccguauugcuacgagaucuaaagugaauggacaauccggcaggauggaguucuuuuggacuauccuaaagccuaacgacgcaaucaauuucgaaucaaacggcaauuuuauugccccagaauacgcuuauaaaauagucaagaaaggggauagcaccaucaugaagagugagcucgaauacggaaacugcaauacaaaaugucagacuccgaugggugccauuaacucuuccaugcccuuccauaauauccacccucugaccauaggcgagugcccaaaguauguuaagagcaaccggcuugugcuggcgacaggguugcgcaauucgccccagagagagaaaaggcggaagaaacgcggacucuuuggcgcaauugccgguuucaucgaagggggauggcagggcaugguagacggcugguacggguaucaucacucuaacgagcaaggauccgguuacgcugccgacaaggaaucaacccagaaagcaaucgauggcgugacgaauaaggucaacaguauuaucgacaagaugaauacucaguuugaggcuguggggcgagaguucaacaaccuggaaagaaggauugagaauuuaaacaaaaagauggaagauggauuccuggacguuuggacauauaaugccgagcuccuugugcugauggaaaacgagcggaccuuggauuuucacgacagcaaugucaaaaaccuauacgauaaggugcgucugcaacuccgcgacaaugcgaaagaacugggcaacgguuguuucgaguuuuaccauaagugcgauaaugaguguauggaauccguaagaaacgggacuuaugacuacccucaguauucugaggaagccaggcuuaagcgggaggagauaagcggcguuaaacuggaaucaaucggaauuuaccagaucuugaguaucuauuccacaguggcaagcucucucgcucuggccauuauggucgcuggcuuaucacuguggaugugcaguaaugggagccuacagugccgaauauguaucuga

SEQ ID NO: 123505 - RNA, 1707 nt, Artificial Sequence
  derived and/or modified sequence opt3 from hemagglutinin__InfluenzaA__ABL67816
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaugaugcagccgagcagacaaaacuuuaucagaacccaaccacuuacaucagugucgggacaagcaccuugaaccagcgacuggugccccguauugcuacgagaucuaaagugaauggacaauccggcaggauggaguucuuuuggacuauccuaaagccuaacgacgcaaucaauuucgaaucaaacggcaauuuuauugccccagaauacgcuuauaaaauagucaagaaaggggauagcaccaucaugaagagugagcucgaauacggaaacugcaauacaaaaugucagacuccgaugggugccauuaacucuuccaugcccuuccauaauauccacccucugaccauaggcgagugcccaaaguauguuaagagcaaccggcuugugcuggcgacaggguugcgcaauucgccccagagagagaggcggcgcaaaaagcgaggacucuuuggcgcaauugccgguuucaucgaagggggauggcagggcaugguagacggcugguacggguaucaucacucuaacgagcaaggauccgguuacgcugccgacaaagaaucaacccagaaggcaaucgauggcgugacgaauaaagucaacaguauuaucaauaagaugaacacucaguuugaggcuguggggagagaguucaacaaucuggaaaggcggauugagaacuuaaauaagaaaauggaagacggauuccuggauguuuggacauauaacgccgagcuccuugugcugauggaaaaugagcguaccuuggacuuucacgauagcaacgucaagaaucuauacgacaaagugcgccugcaacucagagauaacgcgaaggaacugggcaaugguuguuucgaguuuuaccauaaaugcgacaacgaguguauggaauccguaaggaaugggacuuaugauuacccucaguauucugaggaagcccggcuuaagcgagaggagauaagcggcguuaagcuggaaucaaucggaauuuaccagaucuugaguaucuauuccacaguggcaagcucucucgcucuggccauuauggucgcuggcuuaucacuguggaugugcaguaacgggagccuacagugccgcauauguaucuga

SEQ ID NO: 123506 - RNA, 1707 nt, Artificial Sequence
  derived and/or modified sequence opt3 from hemagglutinin__InfluenzaA__ABL67827
auggagaagaucgugcuccuguucgccauugucagccuuguuaaauccgaccacauaugcaucggcuaccaugcuaacaauucuaccgaacagguggauacaauuauggagaagaacguaacugugacgcacgcacaagacauccuggaaaagacccauaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcacuugcucagcaggaucaaucauuuugagaaaauucagaucauuccuaaguccucuuggucgucacacgaagcuagccugggagugaguuccgccuguccauaccagggcaaaucuagcuucuuucggaacguaguuuggcugaucaagaaaaauuccacauaucccacuauaaagcgcucauacaacaauaccaaccaggaggaccucuuagugcugugggguauucaccauccuaaugaugcagccgagcaaacaaaacuuuaucagaacccaaccacuuacaucagugucgggacaagcaccuugaaccagcgacuggugccccguauugcuacgagaucuaaagugaauggacaguccggcaggauggaguucuuuuggacuauccuaaagccuaacgacgcaaucaauuucgagucaaacggcaauuuuauugccccagaauacgcuuaugagauagucaaaaagggggauagcaccaucaugaaaagugaacucgaguacggaaacugcaauacaaagugucaaacuccgaugggugccauuaacucuuccaugcccuuccacaauauccauccucugaccauaggcgagugcccaaaauauguuaagagcaaccggcuugugcuggcgacaggguugcgcaauucgccccagauugaaagaaggcggaagaaacgcggacucuuuggcgcaaucgccgguuuccuggaagggggauggcagggcaugguagacggcugguacggguaucaccacucuaacgaacagggauccgguuacgcugccgacaaggagucaacccaaaaagcaaucgauggcgugacgaauaaggucaacaguauuaucaauaaaaugaacacucaguuugaagcuguggggcgagaguucaacaauuuagagagaaggauugaaaaccugaauaagaagauggaggacggauuccucgauguuuggacauauaacgccgaacuucugguguugauggagaaugaacggacccuagacuuucaugauagcaacgucaaaaaucuguacgacaaggugcgucuccagcugcgcgauaacgcgaaagagcuuggcaaugguuguuucgaguuuuaccacaagugcgacaacgaauguauggaguccguaagaaaugggacuuaugauuacccucaauauucugaagaggccaggcugaaacgggaggaaauaagcggcguuaaguuggagucaaucggaauuuaccagauccucaguaucuauuccacaguggcaagcucucuggcuuuagccauuauggucgcuggccugucacuauggaugugcaguaacgggagccuccagugccgaauauguaucuga

SEQ ID NO: 123507 - RNA, 1701 nt, Artificial Sequence
  derived and/or modified sequence opt3 from hemagglutinin__InfluenzaA__ABM22015
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguacguggaggacaccaaaaucgauuuauggucuuauaacgccgagcugcucguagcacuugaaaaucaacauacaauugaccugacugauagcgagaugaacaaguuguucgaaaggaccaaaaagcagcuacgggagaaugcugaagacaugggaaacggcugcuuuaagauauaccacaaaugugauaaugccugcaucgggucaauucgaaacggaacauaugaccaugauguguaccgcgacgaggcucugaauaacagauuccagaucaagggugucgagcucaaaaguggcuacaaggacuggauucuguggaucuccuuugccauaagcugcuuccuucuguguguggcauugcucggguuuaucaugugggccugccagaaaggaaauauuaggugugauaucugcauuuga

SEQ ID NO: 123508 - RNA, 1701 nt, Artificial Sequence
  derived and/or modified sequence opt3 from hemagglutinin__InfluenzaA__ABM22026
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucaauagccggcuggauccuggggaacccugagugcgaaaguuuguuuagcaaagaguccuggucuuacauugcagaaaccccaaauccgaagaacggaacuuguuaucccggcuacuucgccgacuaugaggagcucagggaacaacugucgucagucagcaguuuuaagcgguucgagaucuuuccuaaagauuccucuuggccaaaucauacagugaccaaggguguuacggcuagcugcucccacaacgggaaaucaaguuucuacaagaaucugcucugguuaacugaaaagaacggacuguaucccaaucuuagcaagucuuacgugaacaagaaaggcaaggaggucuuggugcuguggggcguacaucacccuuccaauaugggggaccagcgcgcaauuuaccacaaagagaacgccuauguuucagugcuaagcagucauuacucucgacguuuuaccccagaaaucgcuagaaggcccaagguccgggaucaggagggacgcauaaacuauuacuggacacuccuggaaccuggugacacuaucauuuucgaggccaauggcaaccuuaucgcgccaugguaugcauuugcccuguccagaggguucggaagcggcauuaucauaucgaaugcuucuaugggugaaugugaugccaaaugccagaccccgcaaggggcaauuaacuccucauugcccuuucagaaugugcacccugugacaaucggagaguguccaaaguacgucaggaguaccaaacuccggaugguuacgggccugcgcaacgugcccagcauucagucccgaggcuuauucggggcuaucgccggauuuaucgaggguggcuggacugggaugauugacggaugguauggcuaccaucaccagaaugaacaagguucuggguacgcggccgaucagaaaagcacacagaacgcaauaaauggcaucaccaacaagguaaauucaauuaucgagaaaaugaacacucaguucacagcugugggaaaggaguucaauaaacuggaaagaaggauggaaaaccucaauaagaaagucgacgauggcuuucuugacauauggaccuauaacgccgagcuguuggugcuacuggagaacgaacggacgcucgacuuccacgauaguaauguuaagaaccuguacgagaaggugaaaaaucaacuuaagaacaaugcuaaagaaauugggaacggaugcuuugaguucuaucauaaguguaauaacgaaugcauggaguccgucaaaaaugguaccuacgacuauccuaaguacagcaaggagucuaaacugaaccgugaaaagaucgauggcgugaaauuggagucaauggggguauaucagauccucgccauuuacaguacaguugcaagcucccugguguuacuggucucucuaggagccaucucguuuuggaugugcagcaauggcucccuccagugucgcauuugcauauga

SEQ ID NO: 123509 - RNA, 1701 nt, Artificial Sequence; identical to SEQ ID NO: 122649
  derived and/or modified sequence opt3 from hemagglutinin__InfluenzaA__ABM22037

SEQ ID NO: 123510 - RNA, 1701 nt, Artificial Sequence; identical to SEQ ID NO: 122067
  derived and/or modified sequence opt3 from hemagglutinin__InfluenzaA__ABM22059

SEQ ID NO: 123511 - RNA, 1701 nt, Artificial Sequence; identical to SEQ ID NO: 123321
  derived and/or modified sequence opt3 from hemagglutinin__InfluenzaA__ABM22070

SEQ ID NO: 123512 - RNA, 1701 nt, Artificial Sequence
  derived and/or modified sequence opt3 from hemagglutinin__InfluenzaA__ABM22081
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacagcgaucagauuucuuuguaugcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguacuucaagauucggucuggaaaauccucaauaaugcgcagugaugcgccgaucggcaaguguaacagcgagugcauuacucccaaugguuccaucccuaacgacaaaccauuucagaaugugaaccgaauaacauauggggcaugucccagauacgugaagcagaauacccugaaacuugccacuggaaugaggaacauuccugaaaagcaaacacggggcaucuucggcgcuaucgccggguuuauugagaauggaugggaagguauggucgauggcugguauggguuccgucaccagaacucugagggaaccggccaggcagcugaccugaaaagcacgcaagccgcgaucaaucagauuaacgguaaguugaaucgccucauagggaagaccaacgagaaauuucaucagaucgaaaaggaguucucagaaguugagggcaggauucaggaucuggaaaaauacguggaggacacaaagaucgauuuauggaguuauaaugccgagcugcucguagcacuugaaaaccaacacacuaucgaccugaccgauuccgagaugaacaaauuguucgaaagaacaaagaagcagcuacgggagaaugcugaagacaugggaaacggcugcuuuaaaauuuaccauaagugugauaaugccugcauagggagcauccgaaacggaacuuaugaccacgacguguaccgcgaugaggcucugaauaacagauuccagauuaaaggugucgagcucaagucuggcuacaaagacuggauccuguggauuucauuugccaucaguugcuuccuucuguguguggcauugcucggguuuauaaugugggccugccagaagggaaauaucagguguaacauuugcaucuga

SEQ ID NO: 123513 - RNA, 1701 nt, Artificial Sequence
  derived and/or modified sequence opt3 from hemagglutinin__InfluenzaA__ABM22092
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugaucaugcaucguugaggucacucguggccagcaguggcacucuggaauuuaacaaugaguccuucgacugggcugguguuacacagaacgggaccucuagcgcaugcaagcggcgcuccaauaagucauuuuucagucgacugaacuggcucacgcacuuaaaauacaaguauccagcccugaaugugacuaugcccaacaaugagaaauuugauaaacuuuacaucuggggaguccaucacccuggcaccgacagcgaucagauuucuuuguaugcucaggccuccggccguaucacagugucaacuaagagaagccaacagaccguaauuccaaacaucgggaguaggccccggguucgcgacgugucuuccagaauaagcauuuacuggacaaucgucaagccuggagacauucugcuaaucaacucgaccgguaaucucaucgcgccaaggggcuacuucaagauucggucugggaaauccucaauaaugcgcagugaugcaccgaucggaaaguguaacagcgaaugcauuacgcccaauggcuccaucccuaacgacaaaccauuucagaaugugaaccgaauaacuuauggugccugucccagauacgugaagcagaauacacugaaacuugcuaccgggaugaggaacgucccugagaagcaaacucggggaauuuucggcgccaucgcaggcuuuaucgaaaaugggugggagggaaugguugaugguugguauggcuuccgucaccagaacucugaggggacaggacaggcugccgaccugaaaagcacccaagcggccauuaaucagaucaacggcaaguugaaucgccucauugguaagacgaacgaaaaauuucaucagauagagaaggaguucucagaaguggaagggagaauccaggaucuggagaaauacguagaggacaccaagauugauuuauggaguuauaaugcagaacugcucguggcucuugagaaccaacacacaaucgaccugacugauuccgaaaugaacaaauuguucgagaggaccaagaagcagcuacgggaaaaugccgaggacaugggcaacggaugcuuuaaaaucuaccauaagugugauaaugcuugcauuggcagcauacgaaacgggacauaugaccacgacgucuaccgcgaugaggcccugaauaacagauuccagaucaaaggaguggaacucaagucugguuacaaagacuggauucuguggaucucauuugcaauuaguugcuuccuucuguguguugccuugcucggcuuuaucaugugggcuugccagaaggggaauauaagguguaacaucugcauuuga

SEQ ID NO: 123514 - RNA, 1701 nt, Artificial Sequence; identical to SEQ ID NO: 123326
  derived and/or modified sequence opt3 from hemagglutinin__InfluenzaA__ABM22103

SEQ ID NO: 123515 - RNA, 1701 nt, Artificial Sequence; identical to SEQ ID NO: 122532
  derived and/or modified sequence opt3 from hemagglutinin__InfluenzaA__ABM22114

SEQ ID NO: 123516 - RNA, 1701 nt, Artificial Sequence; identical to SEQ ID NO: 123471
  derived and/or modified sequence opt3 from hemagglutinin__InfluenzaA__ABM22125

SEQ ID NO: 123517 - RNA, 1701 nt, Artificial Sequence
  derived and/or modified sequence opt3 from hemagglutinin__InfluenzaA__ABM22136
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccaucggaaugaggaacgugccagaaaaacaaacucggggcaucuucggcgcuauugccggguuuaucgagaauggaugggaagguauggucgauggcugguauggguuccgucaccagaacagugagggaauuggccaggcagcugaccuuaagagcacacaagccgcgauaaaucagaucaacgguaaauugaaccgccucauugggaagaccaaugagaaguuccaccagaucgaaaaagaguuuuccgaaguugagggcagaauccaggaucuggaaaaguacguggaggacacgaaaauugauuuauggucuuauaacgccgagcugcucguagcacuugaaaaucaacauaccauagaccugacagauagcgagaugaacaaguuguucgaaaggacuaaaaagcagcuacgggagaaugcugaagacaugggaaacggcugcuuuaagaucuaccacaaaugugauaaugccugcauugggucaauccgaaacggaaccuaugaccaugauguguaccgcgacgaggcucugaauaacagauuccagauuaagggugucgagcucaaaaguggcuacaaggacuggauccuguggauauccuuugccaucagcugcuuccuucuguguguggcauugcucggguuuauuaugugggccugccagaaaggaaauaucagguguaacauuugcaucuga

SEQ ID NO: 123518 - RNA, 1701 nt, Artificial Sequence; identical to SEQ ID NO: 122649
  derived and/or modified sequence opt3 from hemagglutinin__InfluenzaA__ABM22147

SEQ ID NO: 123519 - RNA, 1701 nt, Artificial Sequence; identical to SEQ ID NO: 122937
  derived and/or modified sequence opt3 from hemagglutinin__InfluenzaA__ABM22158

SEQ ID NO: 123520 - RNA, 1701 nt, Artificial Sequence; identical to SEQ ID NO: 122937
  derived and/or modified sequence opt3 from hemagglutinin__InfluenzaA__ABM22169

SEQ ID NO: 123521 - RNA, 1701 nt, Artificial Sequence; identical to SEQ ID NO: 122937
  derived and/or modified sequence opt3 from hemagglutinin__InfluenzaA__ABM22180

SEQ ID NO: 123522 - RNA, 1701 nt, Artificial Sequence; identical to SEQ ID NO: 122937
  derived and/or modified sequence opt3 from hemagglutinin__InfluenzaA__ABM22191

SEQ ID NO: 123523 - RNA, 1701 nt, Artificial Sequence; identical to SEQ ID NO: 122937
  derived and/or modified sequence opt3 from hemagglutinin__InfluenzaA__ABM22202

SEQ ID NO: 123524 - RNA, 1701 nt, Artificial Sequence; identical to SEQ ID NO: 122937
  derived and/or modified sequence opt3 from hemagglutinin__InfluenzaA__ABM22213

SEQ ID NO: 123525 - RNA, 1701 nt, Artificial Sequence; identical to SEQ ID NO: 122937
  derived and/or modified sequence opt3 from hemagglutinin__InfluenzaA__ABM22224

SEQ ID NO: 123526 - RNA, 1701 nt, Artificial Sequence; identical to SEQ ID NO: 122937
  derived and/or modified sequence opt3 from hemagglutinin__InfluenzaA__ABM22235

SEQ ID NO: 123527 - RNA, 1701 nt, Artificial Sequence
  derived and/or modified sequence opt3 from hemagglutinin__InfluenzaA__ABM22268
augaaggugaaacugcucguccuucugugcgccuucaccgcuacauacgcagacacuaucuguauuggcuaucacgccaacaauagcacggauaccguugacacaguguuggagaagaacguaacugugacccauuccgucaauuuacuggaagauucucacaacgggaaacuaugcagacucaagggaacagcgccccugcagcuugguaauuguucaguggcuggcuggauacuggggaacccugagugcgaaaguuuguuuagcaaagaguccuggucuuacaucgccgaaaccccaaauccggagaacggaacuuguuaucccggcuacuucgcagacuaugaggaacucagggagcaacugucgucaguuagcaguuuugaacgguucgagauuuuuccuaaggaguccucuuggccaaaucauacagugaccaagggugucacggccagcugcucccacaacgggaaaucaaguuucuacaagaaucugcucugguuaacugaaaagaacggacuguaucccaaucuuagcaagucuuacgugaacaauaaagagaaggaaguauugguucuguggggcgugcaucacccuuccaacaucggcgaucagcgcgcuauuuaccacaccgagaacgcauaugucucaguggugagcagucauuacucucgacguuuuacaccagaaaucgccaagagacccaaagucagggaccaggaggggcggauaaauuauuacuggacucuacucgagccuggagauaccaucauuuucgaagcuaacgguaaucugaucgccccaugguaugcguuugcacuuucccgcggcuucgggagcggaauuaucacaucgaacgccucuaugggcgagugugacgcuaagugccagaccccgcaaggugccauaaauuccucacugcccuuucagaacguucacccugugacgauuggggaauguccaaaauacguaagaaguacuaaguugaggauggugacaggacuccggaauauccccagcauucagucccgcggccuguucggcgcaaucgcuggguuuaucgagggagguuggaccggcaugauugaugggugguauggauaccaucaccagaacgaacaaggcucugguuacgccgcggaccagaaaagcacucagaaugccauagaugggaucacaaacaaggucaauucagugauugagaaaaugaacacccaguucacggcaguuggcaaggaguucaauaaguuagaacgaagaauggagaaccugaauaaaaagguggacgauggauuucucgacaucuggaccuauaacgcugaacuucuggucuugcuagagaacgaaaggacacuggacuuccacgauaguaaugugaaaaaccucuacgagaagguuaaaaaucaacugaagaacaaugccaaggagauaggcaacgggugcuuugaguucuaucauaaauguaauaacgaaugcauggaauccguaaagaauggaacuuacgacuauccuaaauacagcgaggagucuaaacuuaaccgggagaaaauugauggugugaagcuggaaucaaugggcgucuaucagaucuuggcuaucuacaguaccguggccagcucccucguccuguuagugucucugggggcaauuucguuuuggaugugcagcaauggaucccuacagugucguaucugcauuuga

SEQ ID NO: 123528 - RNA, 1701 nt, Artificial Sequence
  derived and/or modified sequence opt3 from hemagglutinin__InfluenzaA__ABM22279
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauagacacaacgggaaacuaugcaggcucaagggaacagcuccccugcagcuugguaauuguucugucgccggcuggauacuggggaacccugagugcgaaucauuguuuaguaaagagagcugguccuacaucgcagaaaccccaaauccggagaacggaacuuguuaucccggcuacuucgccgacuaugaggaacuccgggagcaacugucuucggugagcucauuugaacgcuucgagauuuuuccuaaggagaguuccuggccaaaucauacaguuaccaagggugugacggcuucuugcagccacaacgggaaauccucauucuacaagaaucugcucugguuaacugagaaaaacggacuguaucccaaucuuaguaagagcuacgucaacaauaaagaaaaggaaguguugguacuguggggcguucaucacccuucuaacaucggcgaucagcgagcaauuuaccacaccgagaacgccuauguguccgucgugucaagccauuacagucguagauuuacaccagaaaucgcuaagaggcccaaagugcgggaccaggaggggcgcauaaauuauuacuggacucuacucgagccuggagauaccaucauuuucgaagccaacgguaaucugaucgcgccaugguaugcauuugcccuuucuagaggcuucggguccggaauuaucacaagcaacgcuucgaugggcgacugugaugccaagugccagaccccgcaaggugcaauaaauucuucccugcccuuucagaacguccacccuguuacgauugggggauguccaaaauacgugaggucaacuaaguugcggaugguaacaggccuccgcaauauccccaguauucagagccgaggccuguucggggcuaucgccggauuuaucgaggguggcuggaccgggaugauugacggaugguauggcuaccaucaccagaacgaacaagguuccggguacgcggccgauaaaaagucuacucagaaugcaauagacggcaucacaaacaaagugaauagcgucauugagaagaugaacacccaguucacggcugugggaaaggaguucaauaaauuagaaagaaggauggagaaccugaauaagaaaguugaugacggcuuucucgacaucuggaccuauaacgccgaacuucugguguugcuagagaacgaacggacacuggauuaccacgacucaaaugucaagaaccucuaugagaaagugaagaaucagcugaagaacaaugcuaaagaaauagggaacggaugcuucgaguuuuaccauaaguguaauaacgagugcauggaaaguguuaaaaaugguacuuaugauuacccuaaguauuccgaggaaagcaaacuuaagcgugagaagauugacggcguaaaacuggagucuauggggguguaccaaaucuuggccaucuacucaaccgucgcaaguagccucgugcuguuagucucccugggagccauuucuuucuggaugugcucgaacggcagccuacagugucgcaucugcauuuga

SEQ ID NO: 123529 - RNA, 1701 nt, Artificial Sequence
  derived and/or modified sequence opt3 from hemagglutinin__InfluenzaA__ABM22290
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaaaacucucacaaugggaaacuaugcagacucaagggaacagcuccccugcagcuugguaacuguucagucgccggcuggauacuggggaauccugagugcgaaaguuuguuuagcaaagaguccuggucuuacaucgcagaaaccccaaacccggagaauggaacuuguuaucccggcuacuucgccgauuaugaggaacucagggagcaacugucgucagugagcaguuuugaacgguucgagauuuuuccuaaggaguccucuuggccaaaccauacaguuaccaagggugugacggcuagcugcucccacaaugggaaaucaaguuucuacaagaaccugcucugguuaacugaaaagaauggacuguaucccaaccuuagcaagucuuacgucaauaacaaagagaaggaaguguugguacuguggggcguucaucacccuuccaacaucggcgaccagcgcgcaauuuaccacaccgagaaugccuaugugucagucgugagcagucauuacucucgacguuuuacaccagaaaucgcuaagagacccaaagugagggaucaggaggggcggauaaacuauuacuggacucuacucgagccuggagacaccaucauuuucgaagccaaugguaaccugaucgcgccaugguaugcauuugcccuuucccgcggcuucgggagcggaauuaucacaucgaaugcuucuaugggcgagugugaugccaagugccagaccccgcaaggugcaauaaacuccucacugcccuuucagaauguccacccuguuacgauuggggaauguccaaaauacgugagaaguacuaaguugaggaugguaacaggacuccggaacauccccagcauucagucccgcggccuguucggcgcuaucgccggguuuaucgagggagguuggaccggcaugauugacgggugguauggauaccaucaccagaaugaacaaggcucugguuacgcggccgaucagaaaagcacucagaacgcaauagacgggaucacaaauaaggugaacucagucauugagaaaaugaauacccaguucacggcugugggcaaggaguucaacaaguuagaacgaagaauggagaaucugaacaaaaagguugaugacggauuucucgauaucuggaccuauaacgccgaacuucugguguugcuagagaaugaaaggacacuggacuuccacgacaguaacgucaaaaaucucuacgagaaggugaaaaaccaacugaagaauaacgcuaaggagauaggcaaugggugcuuugaguucuaucauaaauguaacaaugaaugcauggaauccguaaagaacggaacuuacgauuauccuaaauacagcgaggagucuaaacuuaaucgggagaaaauugacgguguuaagcuggaaucaaugggcguguaucagaucuuggccaucuacaguaccgucgcaagcucccucgugcuguuagucucucugggggccauuucguuuuggaugugcagcaacggaucccuacagugucguaucugcauuuga

SEQ ID NO: 123530 - RNA, 1701 nt, Artificial Sequence; identical to SEQ ID NO: 122271
  derived and/or modified sequence opt3 from hemagglutinin__InfluenzaA__ABM22301

SEQ ID NO: 123531 - RNA, 1701 nt, Artificial Sequence; identical to SEQ ID NO: 122271
  derived and/or modified sequence opt3 from hemagglutinin__InfluenzaA__ABM22312

SEQ ID NO: 123532 - RNA, 1701 nt, Artificial Sequence; identical to SEQ ID NO: 122271
  derived and/or modified sequence opt3 from hemagglutinin__InfluenzaA__ABM22323

SEQ ID NO: 123533 - RNA, 1701 nt, Artificial Sequence; identical to SEQ ID NO: 122271
  derived and/or modified sequence opt3 from hemagglutinin__InfluenzaA__ABM22334

SEQ ID NO: 123534 - RNA, 1701 nt, Artificial Sequence; identical to SEQ ID NO: 122272
  derived and/or modified sequence opt3 from hemagglutinin__InfluenzaA__ABM22345

SEQ ID NO: 123535 - RNA, 1701 nt, Artificial Sequence; identical to SEQ ID NO: 122272
  derived and/or modified sequence opt3 from hemagglutinin__InfluenzaA__ABM22356

SEQ ID NO: 123536 - RNA, 1701 nt, Artificial Sequence; identical to SEQ ID NO: 122272
  derived and/or modified sequence opt3 from hemagglutinin__InfluenzaA__ABM22367

SEQ ID NO: 123537 - RNA, 1698 nt, Artificial Sequence; identical to SEQ ID NO: 122857
  derived and/or modified sequence opt3 from hemagglutinin__InfluenzaA__ABM66864

SEQ ID NO: 123538 - RNA, 1701 nt, Artificial Sequence; identical to SEQ ID NO: 122937
  derived and/or modified sequence opt3 from hemagglutinin__InfluenzaA__ABM66886

SEQ ID NO: 123539 - RNA, 1701 nt, Artificial Sequence; identical to SEQ ID NO: 122937
  derived and/or modified sequence opt3 from hemagglutinin__InfluenzaA__ABM66897

SEQ ID NO: 123540 - RNA, 1701 nt, Artificial Sequence; identical to SEQ ID NO: 122937
  derived and/or modified sequence opt3 from hemagglutinin__InfluenzaA__ABM66908

SEQ ID NO: 123541 - RNA, 1701 nt, Artificial Sequence; identical to SEQ ID NO: 122272
  derived and/or modified sequence opt3 from hemagglutinin__InfluenzaA__ABM66919

SEQ ID NO: 123542 - RNA, 1701 nt, Artificial Sequence; identical to SEQ ID NO: 122272
  derived and/or modified sequence opt3 from hemagglutinin__InfluenzaA__ABM66930

SEQ ID NO: 123543 - RNA, 1701 nt, Artificial Sequence; identical to SEQ ID NO: 122272
  derived and/or modified sequence opt3 from hemagglutinin__InfluenzaA__ABM66941

SEQ ID NO: 123544 - RNA, 1701 nt, Artificial Sequence; identical to SEQ ID NO: 122272
  derived and/or modified sequence opt3 from hemagglutinin__InfluenzaA__ABM66952

SEQ ID NO: 123545 - RNA, 1701 nt, Artificial Sequence; identical to SEQ ID NO: 122272
  derived and/or modified sequence opt3 from hemagglutinin__InfluenzaA__ABM66963

SEQ ID NO: 123546 - RNA, 1701 nt, Artificial Sequence; identical to SEQ ID NO: 122272
  derived and/or modified sequence opt3 from hemagglutinin__InfluenzaA__ABM66974

SEQ ID NO: 123547 - RNA, 1701 nt, Artificial Sequence; identical to SEQ ID NO: 122272
  derived and/or modified sequence opt3 from hemagglutinin__InfluenzaA__ABM66985

SEQ ID NO: 123548 - RNA, 1701 nt, Artificial Sequence; identical to SEQ ID NO: 122272
  derived and/or modified sequence opt3 from hemagglutinin__InfluenzaA__ABM66996

SEQ ID NO: 123549 - RNA, 1701 nt, Artificial Sequence; identical to SEQ ID NO: 122272
  derived and/or modified sequence opt3 from hemagglutinin__InfluenzaA__ABM67007

SEQ ID NO: 123550 - RNA, 1701 nt, Artificial Sequence; identical to SEQ ID NO: 122272
  derived and/or modified sequence opt3 from hemagglutinin__InfluenzaA__ABM67018

SEQ ID NO: 123551 - RNA, 1701 nt, Artificial Sequence
  derived and/or modified sequence opt3 from hemagglutinin__InfluenzaA__ABM67029
augaagaccaucauugcccugagcuacauaaucugccucguguucgcucagaaacuucccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcgaaaauuguacccuaaucgacgcucuccugggggauccgcagugcgacggauuucaaaacaaaaagugggaucuuuucguggagagauccaaagccuauucuaauuguuaccccuaugacgucccugauuacgcaucgcugaggucauugguggccagcaguggcacucucgaauuuaacaaugaguccuucaacuggacagguguuacccagaaugggacgucuagcgcuugcaagcggcgcuccaacaauucauuuuucagucgacugaacuggcugacucaucucaaguuuaaauauccagcauuaaaugugaccaugcccaacaacgagaaguucgacaaacuguacauuuggggaguccaccauccuggcacagauaaugaccagaucuuucuuuaugcccaggcuagcggccguauuacugugucuaccaagagaucccaacagacaguaaucccaaacauagggucaaggccccggguucgcgauauuccuagcagaaucaguauuuacuggaccaucgugaaaccaggagacaucuugcugauuaauucuacggguaaccuaauagccccgaggggcuacuuccggauccgcuccggaaagagcucgauuaugcgaucugacgcgcccaucgggaaguguaauuccgaaugcauaacuccuaacggcucaauuccaaaugauaaacccuuucagaacgucaauagaaucacauauggugcauguccuagguacgugaagcagaacacccucaaacuggccacugggaugcggaaugugccagagaagcaaacacguggaaucuucggcgcuauugccggcuuuaucgaaaacgggugggagggaauggucgacgguugguauggcuuccgccaccagaauagugaggggauuggacaggcagcugaucuuaaaagcacccaagccgcgauaaaccagaucaauggcaagcugaacagauugauugguaaaacgaacgaaaaguuccaccagaucgagaaggaauuuuccgagguugaagggaggauccaggaccucgagaaauacguggaggauaccaagauugaccuguggucuuauaaugccgaauuacugguagcacucgagaaccaacauacaauagaucuuacugacagcgaaaugaauaaacuguucgagcggaccaagaaacaguugcgagaaaacgcugaggauaugggcaauggaugcuuuaagaucuaccacaagugugacaacgccugcauuggcucaauccgcaaugggacauaugaucaugacguguacagagacgaggcucuaaacaauagguuccagauuaaaggagucgaacugaagagugguuacaaagauuggauccucuggauauccuuugccaucagcugcuuccugcuuuguguggcacuguugggcuuuauuaugugggccugccagaaggggaacauccgguguaauauuugcaucuga

SEQ ID NO: 123552 - RNA, 1698 nt, Artificial Sequence; identical to SEQ ID NO: 122315
  derived and/or modified sequence opt3 from hemagglutinin__InfluenzaA__ABM67051

SEQ ID NO: 123553 - RNA, 1707 nt, Artificial Sequence
  derived and/or modified sequence opt3 from hemagglutinin__InfluenzaA__ABM90467
auggagaagaucgugcugcuccuuagcauugucucccugguuaaaucugaccagauaugcaucggcuaccacgccaacaauucaaccgaacaaguggauacaauuauggagaagaacguaacugugacgcaugcucaggacaucuuggagaaaacccacaaugggaaguuaugugaucuggacggagucaaaccccuaauucucagagauugcaguguggcagguuggcugcuuggcaacccuaugugugacgaguucaucaauguuccagaauggagcuauauaguggagaaggccaacccgacaaaugaucugugcuaccccggguccuuuaacgacuaugaggaauugaagcaucuccugucuaggaucaaucacuucgagaaaauucagaucauuccuaagucgucauggagcgaucaugaagcgaguuccggagucucuagcgcuuguccauaccugggcucccccucauuuuuccggaacgugguauggcucaucaaaaagaauaguacuuauccuaccauuaaaaagagcuacaacaauacaaaccaggaggacuuacugguucuuugggguauacaccacccaaauaacgaggccgaacaaacccgcuuguaucagaaccccacuacauacaucucuauugggaccuccacgcugaaucagcgucuagugccuaagaucgcaacucgaucaaaagucaacggacagagcggcagaauggaguuuuucuggaccauccucaagccaaaugaugccauuaacuuugaaaguaauggcaacuucauagcuccggaguacgcauauaaaaucgugaagaaaggggacucugccauuaugaaguccgaacuggaguacggaaauugcaacacaaaaugucaaacucccaugggugcuaucaauagcucgaugccuuuucauaacauacacccacuuaccauuggcgagugccccaaguaugugaagucuaauaggcuggucuuggccacagggcuccggaacuccccucagcgcgaaucaagaaggaaaaagcggggacuguucggcgcgaucgcagguuuuaucgaagggggauggcagggcaugguugauggcugguacggguaucaucacaguaaugaacagggaagcgguuacgccgcugacaaagaguccacccaaaaggccauugacggcgugacgaacaaaguaaauucuaucauugauaagaugaacacucaguucgaagcaguggggcgcgaguuuaacaauuuagagcgaagaauagaaaaccugaauaagaaaauggaggacggauuccucgaugucuggacauauaacgcugaacuucugguguugauggagaaugaaaggacccuagacuuccacgauagcaacguuaagaaucuguacgacaaagugcggcuccagcugcgugauaacgccaaggagcuuggcaaugguuguuuugaguucuaccauaaaugcgacaacgaauguauggagucaauccgcaaugggacuuauaacuacccacaauauagugaagaggcgagacugaagagggaggaaauuuccggcgucaaguuggagagcaucggaacauaccagauccucucuauuuauucaaccguggccaguagccuggcauuagcuauaaugaucgccggccugucccuauggaugugcucuaaugggucgcuccagugccggauuuguaucuga

SEQ ID NO: 123554 - RNA, 1707 nt, Artificial Sequence
  derived and/or modified sequence opt3 from hemagglutinin__InfluenzaA__ABM90511
auggagaagaucgugcugcuccuuagcauugucucccugguuaaaucugaccagauaugcaucggcuaccacgccaacaauucaaccgaacaaguggauacaauuaucgagaagaacguaacugugacgcaugcucaggacauuuuggaaaagacccacaaugggaaguuaugugaucuggacggagucaaaccccuaauccucaaggauugcaguguggcagguuggcugcuuggcaacccuaugugugacgaguucauaaauguuccagaauggagcuauaucguggagaaggccaacccgacaaaugaucugugcuaccccggguccuuuaacgacuaugaggaauugaaacaucuccugucuagaauuaaucacuucgagaagauccagauuaucccuaaaucgucauggagcgaucaugaagcgaguuccggagucucuagcgcuuguccauaccugggcucccccucauuuuucaggaacgugguauggcucauaaagaaaaauaguacuuauccuaccauuaaaaagagcuacaacaauacaaaccaggaggacuuacugguucuuugggguauccaccacccaaauaacgaggaagaacaaacccgguuguaucagaaccccacuacauacauuucuaucgggaccuccacgcugaaucagcgccuagugccuaaaaucgccacucgaucaaaggucaacggacagagcggccguauggaauuuuucuggaccauucucaaaccaaaugaugcaauaaacuuugagaguaauggcaacuucaucgccccggaauacgcuuauaagauugugaaaaagggggacucugcaaucaugaaauccgagcuggaguacagcaauugcaacacaaagugucaaacucccaugggagccauaaauucgucuaugccuuuucauaacauucacccacuuaccaucggugaaugccccaaguaugugaaauccucaagacuggucuuggcuacaggccucaggaauaguccucagcgggagagccgcagaaagaaaagggggcuguucggagccaucgcgggcuuuauugaagguggguggcagggaaugguugauggcugguacggcuaucaucacuccaacgagcaggggucuggauacgcagccgacaaggaaagcacccaaaaagcuaucgacggugugacgaauaagguaaacucaauuauagauaagaugaauacucaguucgaggccgugggccgggaguuuaacaacuuagaacgccgaaucgagaaucugaacaaaaagauggaagacggguuccucgaugucuggacauauaaugcagagcuucugguguugauggaaaacgagagaacccuagacuuccacgauaguaauguuaaaaaccuguacgacaaggugaggcuccagcugcgggauaaugcuaaagagcuuggaaacggcuguuuugaguucuaccauaagugcgacaaugaguguauggaauccauucguaacgguacuuauaauuacccacaauauagcgaggaggcccgccugaagagagaagagaucucuggggucaaauuggaaucaaucggcacauaccagauucucaguauauauagcaccguggcguccucucuggccuuagcaaucaugauugcuggacugucgcuauggaugugcagcaacggcucccuccagugcaggaucuguauuuga

SEQ ID NO: 123555 - RNA, 1707 nt, Artificial Sequence
  derived and/or modified sequence opt3 from hemagglutinin__InfluenzaA__ABM90533
auggagaagaucgugcugcuccuuagcauugucucccugguuaaaucugaccagauaugcaucggcuaccacgccaacaauucaaccgaacaaguggauacaauuauggagaagaacguaacugugacgcaugcucaggacaucuuggaaaagacccacaaugggaaguuaugugaucuggacggagucaaaccccuaauucucaaggauugcaguguggcagguuggcugcuuggcaacccuaugugugacgaguucaucaauguuccagaauggagcuauauaguggagaaggccaacccgacaaaugaucugugcuaccccggguccuuuaacgacuaugaggaauugaaacaucuccugucuagaaucaaucacuucgagaagauucagaucauuccuaaaucgucauggagcgaucaugaagcgaguuccggagucucuagcgcuuguccauaccugggcucccccucauuuuucaggaacgugguauggcucaucaagaaaaauaguacuuauccuaccauaaagaaaagcuacaacaauacaaaccaggaggacuuacugguucuuugggguauucaccacccaaauaacgaggaagaacaaacccgguuguaucagaaccccacuacauacaucucuauugggaccuccacgcugaaucagcgccuagugccuaaaaucgccacucgaucaaaggucaacggacagagcggccguauggaauuuuucuggaccauccucaaaccaaaugaugcaauuaacuuugagaguaauggcaacuucauagccccggaauacgcuuauaagaucgugaaaaagggggacucugcaauuaugaaauccgagcuggaguacagcaauugcaacacaaagugucaaacucccaugggagccaucaauucgucuaugccuuuucauaacauacacccacuuaccauuggugaaugccccaaguaugugaaauccucaagacuggucuuggcuacaggccucaggaauaguccucagcgggagagccgcagaaagaaaagggggcuguucggagccaucgcgggcuuuaucgaagguggguggcagggaaugguugauggcugguacggcuaucaucacuccaacgagcaggggucuggauacgcagccgacaaggaaagcacccaaaaagcuauugacggugugacgaauaagguaaacucaaucauugauaagaugaauacucaguucgaggccgugggccgggaguuuaacaacuuagaacgccgaauagagaaucugaacaaaaagauggaagacggguuccucgaugucuggacauauaaugcagagcuucugguguugauggaaaacgagagaacccuagacuuccacgauaguaauguuaaaaaccuguacgacaaggugaggcuccagcugcgggauaaugcuaaagagcuuggaaacggcuguuuugaguucuaccauaagugcgacaaugaguguauggaauccauccguaacgguacuuauaauuacccacaauauagcgaggaggcccgccugaagagagaagagauuucuggggucaaauuggaaucaaucggcacauaccagauccucaguauuuauagcaccguggcguccucucuggccuuagcaauaaugaucgcuggacugucgcuauggaugugcagcaacggcucccuccagugcaggauuuguaucuga

SEQ ID NO: 123556 - RNA, 1707 nt, Artificial Sequence; identical to SEQ ID NO: 123555
  derived and/or modified sequence opt3 from hemagglutinin__InfluenzaA__ABM90544

SEQ ID NO: 123557 - RNA, 1701 nt, Artificial Sequence
  derived and/or modified sequence opt3 from hemagglutinin__InfluenzaA__ABN50900
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagagcuccuggccuaagcauaacgugacccgcgguguuacugcuucaugcagucacaaaggaaagagcucuuuuuaucgaaaucucuuauggcugacagagaaaaacggguccuacccaaaucuuucaaagagcuaugugaacaauaaggaaaaagaggucuuggugcuguggggcguacaucaccccaguaacaucgaagaccagaagaccauauaccguaaagagaaugcauacguuucuguggucuccagccacuauaacagaagguucacgccugaaaucgccaagcggccaaaagugcgcggccaggaggggagaauuaacuacuauuggacucuacucgagcccggagauaccaucauuuuugaagcuaaugguaaccugaucgccccuugguacgcguucgcacuuucgaggggcuuugggucuggaauaauuacauccaaugccucaauggacgagugugaugcuaagugccagacuccacaaggcgccaucaacaguagccugccguuccagaaugugcaucccgucaccauuggugaauguccuaaauauguucgguccacaaaguugcgcauggugaccgggcuccgaaacaucccaucuauccagagcagaggacuguuuggcgcaauugcuggcuucauagaagggggauggacggguaugaucgacggcugguacggguaucaccaucagaaugaacaaggaucaggcuacgccgcggaucagaagaguacucagaacgccauuaaugguaucacaaacaaaguaaauuccgugauagagaagaugaacacccaguuuacugcagucgggaaagaguucaauaaguuagaaaagaggauggagaaccugaauaagaagguggacgauggcuuccucgacauuuggacauacaacgcugaacuucugguuuugcuagagaacgaacggacccuggacuuucacgauagcaaugugaaaaaccucuaugagaaggucaaaucucaacugaagaauaacgccaaagagaucggaaauggcugcuucgaauuuuaccacaaguguaacaaugagugcauggaaucagugaagaacgggacguaugacuaccccaaauauagugaggagagcaaacuuaaucgugagaaaaucgauggaguaaagcuggaguccauggguguuuaccagauuuuggcuaucuauucuaccguggccucgagccucguccuguuagugucccugggcgcaauuucauucuggaugugcaguaacgggucucuacagugucgcauaugcaucuga

SEQ ID NO: 123558 - RNA, 1701 nt, Artificial Sequence; identical to SEQ ID NO: 122937
  derived and/or modified sequence opt3 from hemagglutinin__InfluenzaA__ABN50917

SEQ ID NO: 123559 - RNA, 1701 nt, Artificial Sequence
  derived and/or modified sequence opt3 from hemagglutinin__InfluenzaA__ABN50928
augaaggccaagcugcucauccuucugugcgcuuucaccgcaacagacgccgauacuauuuguauaggcuaccacgcgaacaauagcacggacaccguggauacagucuuggagaagaacguuacugugacccauuccguaaauuuacuggaagacucucacaacgggaaacuaugcagacucaagggaaucgcuccccugcagcuugguaauuguucaauugccggcuggauccuggggaacccugagugcgaaaguuuguuuagcaaaaaguccuggucuuauauugcagagacaccaaauucggaaaacggaaccuguuacccgggcuauuucgccgauuacgaggagcucagggaacaacugucaagcgugaguuccuuugagcgguucgaaaucuuucccaaggagucuagcuggccuaaucauacugucacaaaaggugugaccgcuuccugcucacacaaggggaaaaguagcuucuaucgcaaccugcucugguuaacggagaagaauggaucuuacccaaaccuguccaaaucauauguuaauaacaaggaaaaggaggugcuugucuuguggggcgugcaucaccccagcaauauaggcgaccagcgagcaaucuaccacacugaaaacgccuacguaaguguugugucuucccauuauaaccguagauuuaccccugagauugcuaaaaggccaaagguccgggggcaggaaggacgcaucaauuacuauuggacacugcuagagcccggugauacuauuaucuucgaggccaacggcaaucucauagcgccuugguacgcauuugcccugagcagaggguucggaucgggcauuaucaccucuaacgcuuccauggacgaaugugaugccaaaugccagacaccacaaggugcaauuaauucaagucuuccguuucagaacgugcaccccgugaccaucggggaguguccuaaguaugucaggagcacgaaacugcggaugguuacuggauugcgcaauaucccauccauucagucucgaggccucuucggcgcuauagccggguuuaucgaaggagguuggacaggcaugauugacgggugguacggauaucaucaccagaacgagcaaggcagcgguuacgcggccgaucagaagucaacccagaaugcaaucaacgggauaacuaauaaagugaacaguguaauugaaaagaugaauacacaguucaccgcugugggcaaggaguucaacaaacuggagagaaggauggaaaauuuaaacaagaaagucgacgauggauuucuggacaucuggacguacaacgccgagcuccuugugcuguuggaaaaugagcggacccuagacuuccacgauuccaacguuaagaaucuguaugaaaaagucaagagccaacucaagaacaaugcuaaagagaucggcaacgggugcuuugaguucuaccauaaguguaauaacgaaugcauggagucugugaaaaauggaacauaugacuaccccaaguauucagaagagaguaaacugaaccgugagaagauugauggugugaaacuugaaagcaugggcguauaccagauccuggccauuuauuccacuguugcaucuucguuggugcuccuggucagcuuaggggccauauccuuuuggaugugcucaaauggaagucugcagugucgcaucugcauuuga

SEQ ID NO: 123560 - RNA, 1701 nt, Artificial Sequence
  derived and/or modified sequence opt3 from hemagglutinin__InfluenzaA__ABN50940
augaaggccaaacugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucaaucgccggcuggauucuggggaacccugagugcgaaaguuuguuuagcaaaaaguccuggucuuauaucgcagagacaccaaauucggaaaacggaaccuguuacccgggcuauuucucagauuacgaggagcucagggaacaacugagcagugucuccucuuuugagcgguucgaaauuuuucccaaggagagcuccuggccuaaucauacugugacaaaagguguuaccgccucaugcagucacaaggggaaaagcucuuucuaucgcaaccugcucugguuaacggagaagaauggauccuacccaaaccugucaaaaagcuaugugaauaacaaggaaaaggagguccuuguguuguggggcguacaucaccccaguaauaucggcgaccagcgagcuauauaccacacugaaaacgcauacguuucuguggucuccagccauuauaaccguagauuuaccccugagaucgccaaaaggccaaaggugcgggaucaggaagggcgcauuaauuacuauuggacacugcuagagcccgaggacacuaucauuuucgaagcuaacggaaaucucaucgccccuugguacgcguuugcacugucgagagguuucggcucugggauaauuaccuccaacgccucaauggaugagugugacgcuaaaugccagacaccacaaggagccaucaauaguagccuuccguuucagaacgugcaccccgucaccauuggcgaauguccuaaguauguuagguccacgaaacugcggauggugacugguuugcgcaauaucccaucuauccagagccgagggcuuuucggagcaauugcuggcuuuauagagggcggguggacaggaaugaucgaugguugguacggcuaucaucaccagaacgaacaagggucaggauacgccgcggaccagaagaguacccagaaugccauuaacggcaucacuaauaaaguaaacuccgugauagagaagaugaauacacaguucaccgcagucgguaaggaguucaacaaacuggaaagaaggauggagaauuuaaacaagaaaguggaugacggguuucuggacauuuggacguacaacgcugaacuccuuguucuguuggagaaugaacggacccuagauuuccacgacagcaacgugaagaaucuguaugagaaagucaagucucaacucaagaacaaugccaaagagaucggcaacggaugcuuugaguucuaccauaaguguaauaacgaaugcauggaaucagugaaaaauggcacauaugauuaccccaaguauagugaggagagcaaacugaaccgugaaaagaucgacgggguaaagcucgaguccaugggaguuuaccagauucuggcuaucuauucuacuguggccucgagcuugguccuccugguguccuuaggugcaauuucauuuuggaugugcaguaauggcucucugcagugucgcauaugcaucuga

SEQ ID NO: 123561 - RNA, 1701 nt, Artificial Sequence; identical to SEQ ID NO: 123527
  derived and/or modified sequence opt3 from hemagglutinin__InfluenzaA__ABN50951

SEQ ID NO: 123562 - RNA, 1701 nt, Artificial Sequence
  derived and/or modified sequence opt3 from hemagglutinin__InfluenzaA__ABN50962
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugagaaaaacggacuguaucccaaucuuagcaagucuuacgucaacaauaaagaaaaggaaguguugguacuguggggcguucaucacccuuccaacaucggcgaucagcgcgcaauuuaccacaccgagaacgccuaugugucagucgugagcagucauuacucucgacguuuuacaccagaaaucgcuaagagacccaaagugagggaccaggaggggcggauaaauuauuacuggacucuacucgagccuggagauaccaucauuuucgaagccaacgguaaucugaucgcgccaugguaugcauuugcccuuucccgcggcuucgggagcggaauuaucacaucgaacgcuucuaugggcgagugugacgccaagugccagaccccgcaaggugcaauaaauuccucacugcccuuucagaacguccacccuguuacgauuggggaauguccaaaauacgugagaaguacuaaguugaggaugguaacaggacuccggaauauccccagcauucagucccgcggccuguucggcgcuaucgccggguuuaucgagggagguuggaccggcaugauugaugggugguauggauaccaucaccagaacgaacaaggcucugguuacgcggccgacaaaaagagcacucagaaugcaauagaugggaucacaaacaaaguaaauucagucauugagaagaugaacacccaguucacggcugugggcaaggaguucaauaaauuagaacgaagaauggagaaccugaauaagaaaguugacgauggauuucucgacaucuggaccuauaacgccgaacuucugguguugcuagagaacgaaaggacacuggacuuccacgauaguaaugucaagaaccucuacgagaaagugaagaaucagcugaagaacaaugcuaaagagauaggcaacgggugcuuugaguucuaucauaaguguaauaacgaaugcauggaauccgugaaaaauggaacuuacgacuauccuaaguacagcgaggagucuaaacuuaagcgggaaaagauugaugguguuaaacuggagucaaugggcguguaucaaaucuuggccaucuacaguaccgucgcaagcucccucgugcuguuagucucucugggggccauuucguuuuggaugugcagcaacggaucccuacagugucguaucugcauuuga

SEQ ID NO: 123563 - RNA, 1701 nt, Artificial Sequence; identical to SEQ ID NO: 122926
  derived and/or modified sequence opt3 from hemagglutinin__InfluenzaA__ABN50973

SEQ ID NO: 123564 - RNA, 1701 nt, Artificial Sequence; identical to SEQ ID NO: 122271
  derived and/or modified sequence opt3 from hemagglutinin__InfluenzaA__ABN50984

SEQ ID NO: 123565 - RNA, 1701 nt, Artificial Sequence; identical to SEQ ID NO: 122272
  derived and/or modified sequence opt3 from hemagglutinin__InfluenzaA__ABN50995

SEQ ID NO: 123566 - RNA, 1701 nt, Artificial Sequence
  derived and/or modified sequence opt3 from hemagglutinin__InfluenzaA__ABN51043
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcgauauaccuagcagaauuaguaucuacuggaccauugugaaaccaggagacauccugcuaaucaauucuacggguaaccucauugccccgaggggcuacuucaagauacgguccggaaagagcucgaucaugcgcucugacgcgcccauugggaaauguaauuccgaaugcaucacuccuaacggcucaauaccaaaugauaagcccuuucagaacgucaaucgaauuacauauggugcauguccuagauacgugaaacagaacacccugaagcuggccacugggaugaggaaugugccagagaaacaaacacggggaaucuucggcgcuaucgccggcuuuauugaaaacgggugggagggaauggucgacgguugguauggcuuccgucaccagaauagugaggggaucggacaggcagcugaucuuaagagcacccaagccgcgauuaaccagauaaauggcaaauugaaccgccucaucgguaagacgaacgaaaaguuccaccagauugagaaagaauuuuccgagguugaagggagaauccaggaccuggagaaguacguggaggauaccaaaaucgacuuauggucuuauaaugccgaacugcucguagcacuugagaaccaacauacaauugaucugacugacagcgaaaugaauaaguuguucgagaggaccaaaaagcagcuacgggaaaacgcugaggauaugggcaauggaugcuuuaagauauaccacaaaugugacaacgccugcaucggcucaauucgaaaugggacauaugaucaugacguguaccgcgacgaggcucugaacaauagauuccagaucaagggagucgaacucaaaagugguuacaaggauuggauucuguggaucuccuuugccauaagcugcuuccuucugugugugguuuugcucggcuuuaucaugugggcaugccagaaagggaacauuagguguaauaucugcauuuga

SEQ ID NO: 123567 - RNA, 1701 nt, Artificial Sequence; identical to SEQ ID NO: 123412
  derived and/or modified sequence opt3 from hemagglutinin__InfluenzaA__ABN51054

SEQ ID NO: 123568 - RNA, 1701 nt, Artificial Sequence
  derived and/or modified sequence opt3 from hemagglutinin__InfluenzaA__ABN51066
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaagaaguccucuuggccaaaucauacaguuaccaaaggugugacggcuagcugcucccacaacgggaagucaaguuucuacaaaaaucugcucugguuaacugagaagaacggacuguaucccaaucuuagcaaaucuuacgucaacaauaaggaaaaggagguguugguacuguggggcguucaucacccuuccaacaucggcgaucagcgcaccauuuaccacacagaaaacgcauaugugucagucgugagcagucauuacucucgacguuuuacuccagagaucgccaaaagacccaaggugagggaccaggaagggcggauaaauuauuacuggacccuacucgagccuggagauacaaucauuuucgaggcuaacgguaaucugaucgccccaugguaugcguuugcacuuucccgcggcuucgggagcggaauuaucaccucgaacgccucuaugggcgacugugaugcuaaaugccagacgccgcaaggugccauaaauuccucacugcccuuucagaacguccacccuguuacuauuggggaauguccaaaguacgugagaaguacaaaauugaggaugguaaccggacuccggaauauccccagcauucagucccgcggccuguucggcgcaaucgcuggguuuaucgagggagguuggacuggcaugauugacgggugguauggauaccaucaccagaacgaacaaggcucugguuacgccgcggauaagaaaagcacacagaaugccauagacgggaucaccaacaaggucaauucagugauugagaagaugaacacgcaguucaccgcagugggcaaagaguucaauaaguuagaacgaagaauggagaaccugaauaaaaagguugaugacggauuucucgacaucuggacauauaacgcugaacuucugguguugcuagagaacgaaaggacucuggauuuccacgacaguaaugucaaaaaccucuacgagaaggugaagaaucagcugaaaaacaaugccaaggaaauaggcaacgggugcuuugaguucuaucauaaauguaauaacgagugcauugaauccguaaagaauggaaccuacgauuauccuaaauacagcgaggaaucuaaacuuaagcgggagaagaucgacgguguuaagcuggagucaaugggcguguaucaaaucuuggcuauuuacaguacagucgccagcucccucgugcuguuagucucucugggggcaaucggauuuuggaugugcucgaacggcagccuacagugucguauuugcauauga

SEQ ID NO: 123569 - RNA, 1698 nt, Artificial Sequence; identical to SEQ ID NO: 122312
  derived and/or modified sequence opt3 from hemagglutinin__InfluenzaA__ABN51077

SEQ ID NO: 123570 - RNA, 1698 nt, Artificial Sequence; identical to SEQ ID NO: 122315
  derived and/or modified sequence opt3 from hemagglutinin__InfluenzaA__ABN51088

SEQ ID NO: 123571 - RNA, 1701 nt, Artificial Sequence
  derived and/or modified sequence opt3 from hemagglutinin__InfluenzaA__ABN51099
augaagaccaucauugcccugagcuacauauucugccucgcucuuggccaggaccugcccgggaacgauaauuccacagcaacuuuguguuuaggacaccaugccgugccuaacgguacgcuggucaaaaccaucacaaaugaccaaauugagguuacuaacgcgaccgaacuugugcagucuucaaguacaggcaagaucugcaauaacccacacaggauucucgaugggaucgacuguacccugauagaugcucuacugggagacccgcauugcgauguauuucagaaugagacuugggacuuguucguggaaagaagcaaagccuuuuccaacuguuaucccuacgaugucccugacuaugcaucucuccggucgcugguggccucaagcggcacacuggaguucaucaccgaagguuuuacguggacugggguuacccagaauggaggcaguaacgcuugcaagcgcggcccaggguccggauucuuuucucgacucaauugguuaacaaaaagcgguuccacuuaccccgugcugaacgucaccaugccuaauaacgauaauuucgacaaguuguauauuuggggcgugcaccauccaucaacaaaccaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugaugugcuagucauuaauuccaacgggaaucucaucgccccgaggggauacuuuaaaaugcggacuggcaagagcucgaucaugcgcucugacgcucccauugacacauguauauccgagugcaucaccccuaacggcucaauuccaaaugauaaacccuuccagaacguuaauaagaucacguacggggccuguccuaaauaugugaagcagaacacccugaaacuugcgacaggaaugcgaaauguaccagaaaagcagacuagaggucuguuuggcgcaauagccggguucauugagaacggaugggaaggcaugaucgacgguugguacggguuuaggcaccaaaauagugagggcaccggacaggcugccgaucuuaagagcacacaggcagcuaucgaccaaauuaacggcaaacucaaucgggugaucgagaagaugaacgaaaaauuccaccagauugagaaggaguucuccgaagucgaagggcguauacaggaucuggagaaauauguggaggacacuaagaucgauuuauggucuuacaaugccgaacugcucguugcgcuugagaaccagcauaccauugaccugacagauagcgaaaugaacaaguuguuugagaaaacccgcagacaacuaagggaaaaugccgaggacaugggaaacgguugcuucaagaucuaucacaaaugugauaaugcaugcaucgagucaauucggaacggcacuuacgaccaugacguguaucgagaugaagcucugaauaaccgcuuucagauaaagggggucgagcucaaaaguggauacaaggacuggauccuguggauuuccuucgccaucagcugcuuucuucugugugugguauugcucggcuucauuaugugggcuugccagagagguaauaucagguguaacauaugcaucuga

SEQ ID NO: 123572 - RNA, 1701 nt, Artificial Sequence
  derived and/or modified sequence opt3 from hemagglutinin__InfluenzaA__ABN51110
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucaacuguacccugauagaugcucuacugggagacccgcauugcgauguauuucaggacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaacuccaaugggaaccucaucgccccgaggggauacuuuaaaaugcggacuggcaagagcucgaucaugcgcucugacgcucccauugauacauguauauccgagugcaucaccccuaauggcucaauuccaaacgacaaacccuuccagaauguuaacaagaucacguacggggccuguccuaaauaugugaagcagaauacccugaaacuugcgacaggaaugcgaaacguaccagaaaagcagacuagaggucuguuuggcgcaauagccggguucauugagaauggaugggaaggcaugaucgaugguugguacggguuuaggcaccaaaacagugagggcaccggacaggcugccgaccuuaagagcacacaggcagcuaucgaucaaauuaauggcaaacucaaccgggugaucgagaagacuaaugaaaaauuccaccagauugagaaggaguucuccgaagucgaagggcguauacaggaccuggagaaauauguggaggauaccaagaucgacuuauggucuuacaacgccgaacugcucguugcgcuugagaaucagcauacaauugaucugaccgacagcgaaaugaacaaguuguuugagaaaacucgcagacaacuaagggaaaacgccgaggauaugggaaaugguugcuucaagaucuaucacaaaugugacaacgcaugcaucgagucaauucggaauggcacguacgaccaugauguguaucgagacgaagcucugaacaaucgcuuucagauaaagggggucgagcucaaaaguggauacaaggauuggauccuguggauuuccuucgccaucagcugcuuucuucugugugugguauugcucggcuucauuaugugggcuugccagagagguaacaucagguguaauauaugcaucuga

SEQ ID NO: 123573 - RNA, 1701 nt, Artificial Sequence
  derived and/or modified sequence opt3 from hemagglutinin__InfluenzaA__ABN51121
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucaacuguacccugauagaugcucuacugggagacccgcauugcgauguauuucaggacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaacuccaaugggaaccucaucgccccgaggggauacuuuaaaaugcggacuggcaagagcucgaucaugcgcucugacgcucccauugauacauguauauccgagugcaucaccccuaauggcucaauuccaaacgacaaacccuuccagaauguuaacaagaucacguacgggaccuguccuaaauaugugaagcagaauacacugaaacuugccacuggaaugcgaaacguaccagaaaagcagaccagaggucuguuuggcgcgauagcaggguucauugagaauggaugggaaggcaugaucgaugguugguacggguuuaggcaccaaaacagugagggcacaggacaggccgcugaccuuaagagcacucaggccgcaaucgaucaaauuaauggcaaacucaaccgggugaucgagaagaccaaugaaaaauuccaccagauugagaaggaguucuccgaagucgaagggcguauacaggaccuggagaaauauguggaggauacaaagaucgacuuauggucuuacaacgcugaacugcucguugcccuugagaaucagcauaccauugaucugacugacuuggaaaugaacaagcuauuugagaaaacgcgcagacaacugagggaaaacgcggaggauaugggaaaugguugcuucaagaucuaucacaaaugugacaacgccugcaucgagagcauucggaauggcacauacgaccaugauguguaucgagacgaagcacucaacaaucgcuuucagauaaagggggucgagcugaaaucaggauacaaggauuggauccuuuggauuaguuucgcuaucuccugcuuucuguugugugugguacuccugggcuucauuaugugggccugccagagagguaacaucagguguaauauaugcaucuga

SEQ ID NO: 123574 - RNA, 1701 nt, Artificial Sequence
  derived and/or modified sequence opt3 from hemagglutinin__InfluenzaA__ABN51132
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucaacuguacccugauagaugcucuacugggagacccgcauugcgauguauuucaggacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaacuuuauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaacuccaaugggaaccucaucgccccgaggggauacuuuaagaugcggacuggcaagagcucgaucaugcgcucugacgcuuccauugauacauguauaucagagugcaucacccccaauggcaguauuccuaacgacaaaccauuccagaauguuaacaagaucacguacggggccugucccaaauaugugaagcagaauacccugaaacuugcgacaggaaugcgaaacguaccugaaaagcagacuagaggucuguuuggcgcaauagccggguucauugagaauggaugggaaggcaugaucgaugguugguacggguuuaggcaccaaaacagcgagggcaccggacaggcugccgacuugaaguccacacaggcagcuaucgaucaaauuaauggcaaacucaaccgggugaucgagaagacuaaugaaaaauuccaccagauugagaaggaguucucugaagucgaagggcguauacaggaccuggagaaauauguggaggauaccaagaucgacuuauggagcuacaacgccgaacugcucguugcgcuugagaaucagcauacaauugaucugaccgacucagaaaugaacaaguuguuugagaaaacucgcagacaacuaagggaaaacgccgaggauaugggaaaugguugcuucaagaucuaucacaaaugugacaacgcaugcaucgagaguauucggaauggcacguacgaccaugauguguaucgagacgaagcucugaacaaucgcuuucagauaaagggggucgagcucaaauccggauacaaggauuggauccuguggauuagcuucgccaucucuugcuuucuucugugugugguauugcucggcuucauuaugugggcuugccagagagguaacaucagguguaauauaugcaucuga

SEQ ID NO: 123575 - RNA, 1698 nt, Artificial Sequence; identical to SEQ ID NO: 122816
  derived and/or modified sequence opt3 from hemagglutinin__InfluenzaA__ABN51143

SEQ ID NO: 123576 - RNA, 1701 nt, Artificial Sequence
  derived and/or modified sequence opt3 from hemagglutinin__InfluenzaA__ABN51154
augaagaccaucauugcccugagcuacauacucugccuuguguucacacagaaacugcccggcaacgacaauuccacugcuacguuguguuuagggcaccaugcagucccuaacggaacccugguuaagacaaucacuaaugaucaaauugaggugaccaacgccacagaauugguacagucuucaaguaccgguagaaucugcgacagcccacaccagauucucgauggcgagaauuguacucugaucgacgcgcuucugggggauccgcauugcgacggauuucagaacaaagaaugggauuuguucguggagagguccaaggcuuauucuaauuguuaccccuaugacgucccugauuacgugucgcuccggucacugguugccagcaguggcacacuggaauuuaacaaugaguccuucaacuggaccgguguggcacaaaaugggacgucuagcgccugcaaacgccgauccgacaagucauuuuucagucgucucaacugguuacaccagcugaaguauaaauacccagcucuuaaugucacuaugcccaacaaugagaaguuugauaaauuguauauauggggagugcaucacccuggcaccgacagcgaucagaucucucuguacgcacaggccuccggcagaguaacaguuucaacuaagaggagccaacagaccgugauuccaaacaucgggaguggacccuggguccggggugugucuucccgcauuagcaucuacuggacaauagugaaaccuggcgacauucuacucaucaacucgaccgggaaucugauugcuccaagaggauauuucaagaucaggucuggcaaguccucaaucaugcggagugacgccccgauugguaaauguaacagcgaaugcauaacgcccaauggguccaucccuaacgauaagccauuucagaaugucaaccgcauuacuuacggacccuguccucgauauguuaaacagaauacacuuaagcuggcgaccggcaugagaaacgugccagagaaacaaacuaggggcaucuucggggcaauagccggauuuauugaaaaugguugggagggcaugauggacgggugguacggauuccggcaccagaacucugagggcacaggucaggcugccgaucuaaagagcacccaagcagcuaucaaucagaucaacgggaaacucaaucgucugauugaaaagacgaacgagaaguuucaucagaucgaaaaagaguucucagaaguagagggccgcauucaggacuuagagaaguauguggaagauaccaaaauagaccuguggaguuacaaugccgagcuccuugucgcgcuggaaaaccaacacacaaucgauuugacugacuccgagaugaacaagcuauucgaaagaaccaaaaagcagcugagggagaaugccgaggauaugggaaacggcugcuuuaagauuuaucauaaaugugacaaugcaugcaucgggagcauccggaacggaacauacgaucacgacguguaccgagacgaagcucucaauaaccgcuuccagauuaaggguguugagcugaaaucuggcuauaaggauuggauacuuuggaucucauuugccauuaguugcuuccuguuguguaucgugcuccugggguuuauuaugugggcuugccagaaaggaaauaucagauguaacauaugcaucuga

SEQ ID NO: 123577 - RNA, 1701 nt, Artificial Sequence
  derived and/or modified sequence opt3 from hemagglutinin__InfluenzaA__ABN59390
augaagaccaucauugcccugagcuacauaaucugccucguguucgcucagaaacuucccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcgaaaauuguacccuaaucgacgcucuccugggggauccgcagugcgacggauuucaaaacaaaaagugggaucuuuucguggagagauccaaagccuauucuaauuguuaccccuaugacgucccugauuacgcaucgcugaggucauugguggccagcaguggcacucucgaauuuaacaaugaguccuucaacuggacagguguuacccagaaugggacgucuagcgcuugcaagcggcgcuccaacaauucauuuuucagucgacugaacuggcugacucaucucaaguuuaaauauccagcauuaaaugugaccaugcccaacaacgagaaguucgacaaacuguacauuuggggaguccaccauccuggcacagauaaugaccagaucuuucuuuaugcccaggcuagcggccguauuacugugucuaccaagagaucccaacagacaguaaucccaaacauagggucaaggccccggguucgcaauauuccuagcagaaucaguauuuacuggaccaucgugaaaccaggagauaucuugcugauuaacucuacggguaaucuaauagccccgaggggcuacuuccggauccgcuccggaaagagcucgauuaugcgaucugacgcgcccaucgggaaguguaacuccgaaugcauaacuccuaauggcucaauuccaaacgacaaacccuuucagaaugucaacagaaucacauauggugcauguccuagguacgugaagcagaauacccucaaacuggccacugggaugcggaacgugccagagaagcaaacacguggaaucuucggcgcuauugccggcuuuaucgaaaaugggugggagggaauggucgaugguugguauggcuuccgccaccagaacagugaggggauuggacaggcagcugaccuuaaaagcacccaagccgcgauaaaucagaucaacggcaagcugaacagauugauugguaaaacgaaugaaaaguuccaccagaucgagaaggaauuuuccgagguugaagggaggauccaggaucucgagaaauacguggaggacaccaagauugaucuguggucuuauaacgccgaauuacugguagcacucgagaaucaacauacaauagaccuuacugauagcgaaaugaacaaacuguucgagcggaccaagaaacaguugcgagaaaaugcugaggacaugggcaacggaugcuuuaagaucuaccacaagugugauaaugccugcauuggcucaauccgcaacgggacauaugaccaugauguguacagagacgaggcucuaaauaacagguuccagauuaaaggagucgaacugaagagugguuacaaagacuggauccucuggauauccuuugccaucagcugcuuccugcuuuguguggcacuguugggcuuuauuaugugggccugccagaaggggaauauccgguguaacauuugcaucuga

SEQ ID NO: 123578 - RNA, 1701 nt, Artificial Sequence
  derived and/or modified sequence opt3 from hemagglutinin__InfluenzaA__ABN59401
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaauaucgccggcuggauuuuggggaacccugagugcgaaagucucuucagcaagaaguccuggucuuauaucgcagagaccccaaauucggaaaacggaacauguuacccgggcuauuuugccgauuacgaggagcugagggaacaacugucaagcgucaguuccuucgagcgguuugaaauuuuccccaaagagcgcucuuggccuaagcauaauaucacccgaggugugacugcugcaugcagccacaaagggaaguccucauuuuaucguaaccucuuauggcugacagagaaaaauggaaguuacccaaaccuuaauaagagcuauguuaacaauaaggaaaaagagguguugguccuguggggcgugcaucaccccucuaacauagaagaccagaagacccuauacagaaaagagaacgccuacguauccguugugucaagcaauuauaacaggcgguucacgccugaaaucgcugagcgcccaaaggucagaggccaggccgggaggauuaauuacuauuggacucuccuggagcccggagauaccaucauuuuugaagcgaacgguaaucuuaucgcaccuuggcacgccuucgcucugagucggggcuuugggucuggaauaauuacauccaacgccagcauggacgagugugauacuaaaugccagaccccacaaggcgcaaucaauucgucuuugccguuccagaacauucaucccgugacaaucggugaauguccuaaguacgugcgcuccaccaaacuccgaauggucacggggcugagaaauaucccaucaauucagaguaggggauuauuuggcgcuauagccggcuucaucgaagggggauggacugguaugauugacggcugguauggguaccaccaucagaacgagcaaggaagcggcuaugcggccgaucagaaguccacacagaaugcaaucaacgguauaaccaauaagguuaacucugugauugagaaaaugaauacucaguuuacagcuguagggaaggaguucaacaaacuggaaaagcggauggagaaccucaauaaaaagguggacgauggcuuccuugacaucuggaccuacaacgccgaacuguugguccuacuggagaaugaacguacgcucgacuuucacgauagcaacgugaagaaucuguacgagaaaguuaagucacaacuuaaaaacaaugcuaaggagaucggaaacggcugcuucgaauuuuaucacaaauguaauaacgagugcauggaaagugugaagaaugggaccuacgacuaucccaaguacuccgaggagagcaaacugaaccgcgaaaagauugauggagucaaauuggagucuauggguguguaucagauccucgccauuuacucaacaguagcaaguagccugguuuuacuggugucccuaggcgccauaucuuucuggaugugcucgaaugggagccuccaguguagaaucugcauuuga

SEQ ID NO: 123579 - RNA, 1698 nt, Artificial Sequence
  derived and/or modified sequence opt3 from hemagglutinin__InfluenzaA__ABN59412
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacugaagaacucauacgucaauaaaaagggcaaagaggugcuaguacucuggggcauacaucacccacccaacaguaaggaacagcagaaccuguaucagaaugagaacgccuacguuagcguggucacuucuaauuacaaccguagauuuacaccugaaaucgcugagaggccaaaggugcgggaccaagccgggcgcaugaauuauuacuggacccuucugaaaccgggagauacgauuaucuucgaggcgaacgguaauuugauugcacccauguaugccuuugcucucuccagaggcuucgggucaggaaucauaacuagcaacgccaguaugcacgaauguaauaccaagugccagacaccucugggcgcaauuaacucuuccuuaccauaccagaauauccaucccgugacuauuggugaguguccuaaauaugucaggagcgcuaagcugcggaugguuaccgggcuccgcaacaucccaucgauccagucucgaggacuuuuuggcgccauugcgggcuucauagaagggggauggacagguaugaucgacggcugguacggguaucaccaucaaaaugagcagggauccggcuacgccgcagaucagaaaucaacccagaacgcuauuaaugguaucacgaacaaggugaacacuguaauagaaaagaugaauauucaauuuacagccguggggaaggaguucaacaagcuggagaaaagaauggaaaauuugaacaagaaagucgacgauggcuuucuagacaucuggaccuacaaugcugagcugcucgugcugcuugaaaacgagaggacucuggaguuccacgacaguaauguuaagaacuuguaugagaaagugaaaagccagcucaagaauaacgccaaagagaucggaaauggcugcuucgaauuuuaccacaagugugauaacgagugcauggaauccguccggaaugggacauaugacuaccccaaauauucugaggagagcaagcugaaccgugaaaaaguggauggaguaaaguuagagucaauggguauuuaccagauccuggcaauuuauaguaccguugccuccagccuagugcuccuggucucucuuggcgcuauaucauucuggaugugcaguaaugggagcuugcaaugucgcaucugcauuuga

SEQ ID NO: 123580 - RNA, 1701 nt, Artificial Sequence
  derived and/or modified sequence opt3 from hemagglutinin__InfluenzaA__ABN59423
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcauaacgugacccgagguguuacugcuuccugcucacacaaagggaagaguagcuuuuaucguaaucucuuauggcugacagagaaaaacggaucuuacccaaaucuuuccaagucauaugugaacaauaaggaaaaagaggucuuggugcuguggggcguacaucaccccagcaacaucgaaaaucagaagaccauauacagaaaagagaacgcauacguuaguguggucucuuccaacuauaauaggcgguucacgccugaaaucgccgagcgcccaaaggugagagaccaggagggcaggauuaacuacuauuggacucuacucgaacccggggauaccaucauuuuugaggcuaauggaaaccugaucgccccuugguacgcguucgcacuuagccgggguuuuggcucggggauaauuacaucuaaugccuccauggacgaaugugauacuaaaugccagaccccacaaggagcuaucaacucaagucugccguuccagaaugugcaccccgucacaauuggcgaguguccuaaguauguucgcagcaccaaauugcgaauggugacgggucucagaaacaucccauccauccagucuagggggcuguuuggagccauugcaggcuucauagaaggcggguggacuggaaugaucgacgguugguacggcuaucaucaccagaaugagcaagggagcggauacgcugccgaucagaagucaacacagaacgcgauuaauggcaucaccaacaagguaaauagugugauagagaaaaugaacacucaguuuacagccgucgguaaggaguucaauaaauuagaaaagcggauggaaaaccugaacaaaaagguggacgauggguuccucgacauuuggaccuacaaugcagagcuucugguuuugcuagaaaacgagcguacgcuggacuuucaugauuccaaugugaagaaccucuaugagaaagucaagagccaacugaaaaauaacgcuaaggaaaucggcaauggaugcuucgaguuuuaccacaaauguaacaaugaaugcauggagucugugaagaacggcaccuaugacuaccccaaguauucagaggaaaguaaacuuaaucgcgagaagaucgaugggguaaaacuggaaagcaugggaguuuaccagauuuuggccaucuauuccacaguggcuucuucgcucguccuguuagugagccugggugccauuuccuucuggaugugcucaaacggcagucuacaguguagaauaugcaucuga

SEQ ID NO: 123581 - RNA, 1701 nt, Artificial Sequence; identical to SEQ ID NO: 122782
  derived and/or modified sequence opt3 from hemagglutinin__InfluenzaA__ABO32656

SEQ ID NO: 123582 - RNA, 1701 nt, Artificial Sequence
  derived and/or modified sequence opt3 from hemagglutinin__InfluenzaA__ABO32667
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccucaggccgugugaccguaagcacaaagagaagucaacagacuguuauuccaaacaucgggucuaggcccugggugcgggaugucuccagccgcauuucgaucuacuggaccauagugaaaccuggagacauucuacucaucaauucuacagguaaccugauugcgccaagaggcuauuucaagaucagguccgggaagucaaguaucaugcggagcgacgcaccgauuggaaaauguaauuccgaaugcauaacccccaacggcucuaucccuaaugauaagccauuucagaacgugaaucgcauuacguacggugccuguccccgauaugucaaacagaacacucuuaagcuggcuacagggaugagaaauguuccugagaaacaaaccaggggaaucuucggcgccauagcaggcuuuauugaaaacgggugggagggaaugguggacgguugguacggcuuccggcaccagaauagcgaggggacuggacaggcugccgauuugaagucaacacaagcggccaucaaccagaucaauggcaaacucaaccgucugauugguaagaccaaugaaaaguuucaucagaucgagaaagaguucagugaaguagaagggcgcauucaggacuuagagaaguauguggaggauacgaaaauagaccugugguccuacaacgcagaacuccuugucgcucuggagaaccaacacaccaucgauuugacagacagcgaaaugaauaagcuauucgagagaacuaaaaagcagcugagggaaaacgccgaggauaugggcaauggaugcuuuaagauuuaucauaaaugugacaacgcuugcaucggcucuauccggaaugggaccuacgaucacgacguguaccgagacgaggcccucaacaaucgcuuccagauuaagggaguugaacugaaaucagguuauaaggauuggauacuuuggaucaguuuugcaauuagcugcuuccuguugugugugguccuccugggcuuuaucaugugggccugccagaaagggaacauuagauguaauaucugcauauga

SEQ ID NO: 123583 - RNA, 1698 nt, Artificial Sequence
  derived and/or modified sequence opt3 from hemagglutinin__InfluenzaA__ABO32678
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccgccaaguuacggauggcaacgggacugcgcaauauuccaucaauccagagucgaggccucuucggcgcuaucgccggguuuauugaaggagguuggacuggcaugguggacgggugguacggauaucaucaccagaacgagcaaggcagcgguuacgcggccgaucagaaauccacacagaaugcaauaaacgggaucaccaauaaggucaacucugugauugaaaagaugaauacucaguucacagcuguuggcaaagaguucagcaaacuugagagaaggauggaaaaccugcacaagaagguggacgauggauuuuuggacaucuggaccuacaaugccgagcuacugguccuccuggaaaacgagcggacgcuugacuuccaugauucaaacgugaaaaaucuguaugaaaagguaaaaagucaauugaagaacaaugcuaaagagauaggcaacgggugcuuugaguucuaccacaaguguaaugacgaaugcauggaguccguuaagaacggaaccuaugauuaccccaaauauagcgaagagucuaagcucaaucgugagaaaauugacggugugaagcuggaaucaaugggcgucuaccagaucuuagccaucuauaguacaguggcaagcucccugguccuacucgugucucugggggccauuucguuuuggaugugcagcaacggaucccuucagugucgcaucugcauuuga

SEQ ID NO: 123584 - RNA, 1701 nt, Artificial Sequence
  derived and/or modified sequence opt3 from hemagglutinin__InfluenzaA__ABO32692
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguacguggaggacaccaaaaucgauuuauggucuuauaacgccgagcugcucguagcacuugaaaaucaacauacaauugaccugacugauagcgagaugaacaaguuguucgaaaggaccaaaaagcagcuacgggagaaugcugaagacaugggaaacggcugcuuuaagauauaccacaaaugugauaaugccugcaucgggucaauucgaaacggaacauaugaccaugauguguaccgcgacgaggcucugaauaacagauuccagaucaagggugucgagcucaaaaguggcuacaaggacuggauucuguggaucuccuuugccauaagcugcuuccuucugugugugguuuugcucggguuuaucaugugggcaugccagaaaggaaauauuagguguaacaucugcauuuga

SEQ ID NO: 123585 - RNA, 1701 nt, Artificial Sequence; identical to SEQ ID NO: 123449
  derived and/or modified sequence opt3 from hemagglutinin__InfluenzaA__ABO32751

SEQ ID NO: 123586 - RNA, 1701 nt, Artificial Sequence; identical to SEQ ID NO: 123449
  derived and/or modified sequence opt3 from hemagglutinin__InfluenzaA__ABO32762

SEQ ID NO: 123587 - RNA, 1701 nt, Artificial Sequence; identical to SEQ ID NO: 123471
  derived and/or modified sequence opt3 from hemagglutinin__InfluenzaA__ABO32775

SEQ ID NO: 123588 - RNA, 1701 nt, Artificial Sequence; identical to SEQ ID NO: 122259
  derived and/or modified sequence opt3 from hemagglutinin__InfluenzaA__ABO32790

SEQ ID NO: 123589 - RNA, 1701 nt, Artificial Sequence
  derived and/or modified sequence opt3 from hemagglutinin__InfluenzaA__ABO32803
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgugucguugaggucacucguugcaagcagugguacucuggaguuuaacaaugaauccuucaacuggacaggggugacccagaauggaacgucuagcgccugcaagcggcgcuccaacaauucauuuuucagucgacugaacuggcucacucauuuaaaguuuaaauauccagcucugaaugucaccaugcccaacaacgagaaguucgacaaacuuuacaucuggggcgugcaccauccuggcacagauaaugaccagauuagcuuguaugcacaggccucugggcguaucacuguauccaccaagagaucacaacagacaguuauuccaaacaucggaagcaggccccgggugcgcgauauaccuaguagaauuucuaucuacuggaccauugucaaaccaggugacacgcugcuaaucaauuccacuggcaaccucaucgcuccgaggggguacuuuaagauucggagcggaaagucgucuauaaugcgcuccgacgcccccaucgauaaauguaauucagagugcauuacaccuaacggcaguaucccaaaugacaagcccuuccagaacgugaaucgaauaaccuauggugcguguccuagauacgugaaacagaacacucugaaacuugcaacagggaugaggaaugucccagaaaaacaaacccggggaauuuuuggcgccaucgcuggcuucaucgagaacgggugggaaggaaugguugaugguugguauggcuuucgucaccagaauagcgaggggauuggacaggccgcagaccugaaguccacgcaagcugccaucaaccagauuaauggcaaauugaaccgccucauagguaagaccaacgagaaguuccaccagaucgaaaaagaguucucugaaguggaggggaggauucaggaucuggaaaaguacguagaggacacaaaaaucgauuuauggagcuauaaugcggagcugcucguggcccuugaaaaccaacauacuaucgaccugaccgauucagagaugaauaaguuguuugaaagaacaaagaagcagcuacgggagaacgcagaagacaugggcaauggaugcuucaagauuuaccacaaaugugauaacgcuugcauaggcaguauccgaaaugggacuuaugaccaugacgucuaccgcgaugaggcccugaacaauagauuucagauuaagggaguggagcucaaauccgguuacaaggacuggauccuguggauuagcuucgcuaucucuugcuuucuucuguguguugccuugcucggcuucauaaugugggcaugccagaaagggaacaucagguguaauauuugcaucuga

SEQ ID NO: 123590 - RNA, 1701 nt, Artificial Sequence; identical to SEQ ID NO: 122649
  derived and/or modified sequence opt3 from hemagglutinin__InfluenzaA__ABO32816

SEQ ID NO: 123591 - RNA, 1701 nt, Artificial Sequence; identical to SEQ ID NO: 122272
  derived and/or modified sequence opt3 from hemagglutinin__InfluenzaA__ABO32827

SEQ ID NO: 123592 - RNA, 1701 nt, Artificial Sequence
  derived and/or modified sequence opt3 from hemagglutinin__InfluenzaA__ABO32838
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaagaugggaucuguucguggaaagguccaaggccuauucuaauuguuaccccuaugacgucccugauuacgcaucguugcggucacucguggccagcagugguacucuggaguuuaacaaugaauccuucaacuggacagggguuacccagaauggaacgucuagcgcuugcaaacgccgauccaacaauucauuuuucagucgucugaacuggcucacucauuuaaaguuuaaguauccagcacugaaugugaccaugcccaacaacgagaaauucgacaaguuguacaucuggggcguccaccauccuggcacagauaaugaccagauuuuucuuuaugcccaggcuagcgggagaaucacugugucuaccaaaaggucccaacagacaguaauuccaaacaucggaucacggccccgcguuagaaauauaccuagcaggauuaguaucuacuggaccauugugaagccaggugauauccugcuaaucaacucuacgggcaaucucauugccccgcggggguacuucaaaauacgcuccggaaagagcucgaucaugcgaucugacgcgcccauuggcaaguguaacuccgagugcaucacuccuaaugguucaauaccaaacgacaaacccuuucagaaugucaacagaauuacauauggggcauguccuagguacgugaagcagaauacccugaaacuugccacuggaaugcggaacgugccagaaaagcaaacacguggcaucuucggcgcuaucgccggguuuauugagaauggaugggaagguauggucgauggcugguauggguuccgccaccagaacagugagggaaucggccaggcagcugaccugaaaagcacccaagccgcgauuaaucagauaaacgguaaguugaacagacucaucgggaaaacgaaugagaaguuccaccagauugaaaaggaguuuuccgaaguugagggcaggauccaggaucuggaaaaauacguggaggacaccaagaucgauuuauggucuuauaacgccgagcugcucguagcacuugaaaaucaacauacaauugaccugacugauagcgagaugaacaaauuguucgaacggaccaagaaacagcuacgagagaaugcugaagacaugggaaacggcugcuuuaagauauaccacaagugugauaaugccugcaucgggucaauucgcaacggaacauaugaccaugauguguacagagacgaggcucugaauaacagguuccagaucaaaggugucgagcucaagaguggcuacaaagacuggauucuguggaucuccuuugccauaagcugcuuccuucuguguguggcauugcucggguuuaucaugugggccugccagaagggaaauauucgguguaacaucugcauuuga

SEQ ID NO: 123593 - RNA, 1701 nt, Artificial Sequence; identical to SEQ ID NO: 123592
  derived and/or modified sequence opt3 from hemagglutinin__InfluenzaA__ABO32849

SEQ ID NO: 123594 - RNA, 1701 nt, Artificial Sequence
  derived and/or modified sequence opt3 from hemagglutinin__InfluenzaA__ABO32860
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaagaugggaucuguucguggaaagguccaaggccuauucuaauuguuaccccuaugacgucccugauuacgcaucguugcggucacucguggccagcagugguacucuggaguuuaacaaugaauccuucaacuggacagggguuacccagaauggaacgucuagcgcuugcaaacgccgauccaacaauucauuuuucagucgucugaacuggcucacucauuuaaaguuuaaguauccagcacugaaugugaccaugcccaacaacgagaaauucgacaaguuguacaucuggggcguccaccauccuggcacagauaaugaccagauuuuucuuuaugcccaggcuagcgggagaaucacugugucuaccaaaaggucccaacagacaguaauuccaaacaucggaucacggccccgcguuagagauauaccuagcaggauuaguaucuacuggaccauugugaagccaggugacauccugcuaaucaauucuacgggcaaccucauugccccgcggggguacuucaaaauacgcuccggaaagagcucgaucaugcgaucugacgcgcccauuggcaaguguaauuccgagugcaucacuccuaacgguucaauaccaaaugauaaacccuuucagaacgucaauagaauuacauauggggcauguccuagguacgugaagcagaacacccugaaacuugccacuggaaugcggaaugugccagaaaagcaaacacguggcaucuucggcgcuaucgccggguuuauugagaacggaugggaagguauggucgacggcugguauggguuccgccaccagaauagugagggaaucggccaggcagcugaucugaaaagcacccaagccgcgauuaaccagauaaaugguaaguugaacagacucaucgggaaaacgaacgagaaguuccaccagauugaaaaggaguuuuccgaaguugagggcaggauccaggaccuggaaaaauacguggaggauaccaagaucgacuuauggucuuauaaugccgagcugcucguagcacuugaaaaccaacauacaauugaucugacugacagcgagaugaauaaauuguucgaacggaccaagaaacagcuacgagagaacgcugaagauaugggaaauggcugcuuuaagauauaccacaagugugacaacgccugcaucgggucaauucgcaauggaacauaugaucaugacguguacagagacgaggcucugaacaauagguuccagaucaaaggugucgagcucaagaguggcuacaaagauuggauucuguggaucuccuuugccauaagcugcuuccuucuguguguggcauugcucggguuuaucaugugggccugccagaagggaaacauucgguguaauaucugcauuuga

SEQ ID NO: 123595 - RNA, 1701 nt, Artificial Sequence; identical to SEQ ID NO: 123577
  derived and/or modified sequence opt3 from hemagglutinin__InfluenzaA__ABO32871

SEQ ID NO: 123596 - RNA, 1701 nt, Artificial Sequence
  derived and/or modified sequence opt3 from hemagglutinin__InfluenzaA__ABO32882
augaagaccaucauugcccugagcuacauaaucugccucguguucgcucagaaacuucccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcgaaaauuguacccuaaucgacgcucuccugggggauccgcagugcgacggauuucaaaacaaaaagugggaucuuuucguggagagauccaaagccuauucuaauuguuaccccuaugacgucccugauuacgcaucgcugaggucauugguggccagcaguggcacucucgaauuuaacaaugaguccuucaacuggacagguguuacccagaaugggacgucuagcgcuugcaagcggcgcuccaacaauucauuuuucagucgacugaacuggcugacucaucucaaguuuaaauauccagcauuaaaugugaccaugcccaacaacgagaaguucgacaaacuguacauuuggggaguccaccauccuggcacagauaaugaccagaucuuuccauaugcccaggcuagcggccguauuacugugucuaccaagagaucccaacagacaguaauccccaacauagggucaaggccucggguucgcaauauuccaagcagaaucaguauuuacuggaccaucgugaaaccgggagauauccuuuugauuaacucuacggguaaucugauagcccccaggggcuacuuccggauccgcuccggaaagagcucgauuaugcgaucugacgcgccuaucgggaaguguaacuccgaaugcauaacuccaaauggcucaauucccaacgacaaaccuuuucagaaugucaacagaaucacauauggugcauguccaagguacgugaagcagaauacccuaaaacucgccacugggaugcggaacgugcccgagaagcaaacacguggaaucuucggcgcuauugccggcuuuaucgaaaaugggugggagggaauggucgaugguugguauggcuuccgccaccagaacagugaggggauuggacaggcagcugaccugaaaagcacccaagccgcgauaaaucagaucaacggcaaacuuaacagacugauugguaagacgaaugaaaaguuccaccagaucgagaaggaauuuuccgagguugaagggaggauccaggauuuggagaaauacguggaggacaccaagauugaucucuggucuuauaacgccgaacuguuaguagcacuggagaaucaacauacaauagaccucacugauagcgaaaugaacaaacuuuucgagcggaccaagaaacagcugcgagaaaaugcugaggacaugggcaacggaugcuuuaagaucuaccacaagugugauaaugccugcauuggcucaauccgcaacgggacauaugaccaugauguguacagagacgaggcuuugaauaacagguuccagauuaaaggagucgaacuaaagagugguuacaaagacuggauccuguggauauccuuugccaucagcugcuuccuccuguguguggcacuucugggcuuuauuaugugggccugccagaaggggaauauccgguguaacauuugcaucuga

SEQ ID NO: 123597 - RNA, 1701 nt, Artificial Sequence
  derived and/or modified sequence opt3 from hemagglutinin__InfluenzaA__ABO32893
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauuacauauggugcauguccuagauacgugaaacagaauacccugaagcuggccacugggaugaggaacgugccagagaaacaaacacggggaaucuucggcgcuaucgccggcuuuauugaaaaugggugggagggaauggucgaugguugguauggcuuccgucaccagaacagugaggggaucggacaggcagcugaccuuaagagcacccaagccgcgauuaaucagauaaacggcaaauugaaccgccucaucgguaagacgaaugaaaaguuccaccagauugagaaagaauuuuccgagguugaagggagaauccaggaucuggagaaguacguggaggacaccaaaaucgauuuauggucuuauaacgccgaacugcucguagcacuugagaaucaacauacaauugaccugacugauagcgaaaugaacaaguuguucgagaggaccaaaaagcagcuacgggaaaaugcugaggacaugggcaacggaugcuuuaagauauaccacaaaugugauaaugccugcaucggcucaauucgaaacgggacauaugaccaugauguguaccgcgacgaggcucugaauaacagauuccagaucaagggagucgaacucaaaagugguuacaaggacuggauucuguggaucuccuuugccauaagcugcuuccuucugugugugguuuugcucggcuuuaucaugugggcaugccagaaagggaauauuagguguaacaucugcauuuga

SEQ ID NO: 123598 - RNA, 1701 nt, Artificial Sequence; identical to SEQ ID NO: 123597
  derived and/or modified sequence opt3 from hemagglutinin__InfluenzaA__ABO32904

SEQ ID NO: 123599 - RNA, 1701 nt, Artificial Sequence; identical to SEQ ID NO: 123412
  derived and/or modified sequence opt3 from hemagglutinin__InfluenzaA__ABO32915

SEQ ID NO: 123600 - RNA, 1701 nt, Artificial Sequence; identical to SEQ ID NO: 123412
  derived and/or modified sequence opt3 from hemagglutinin__InfluenzaA__ABO32926

SEQ ID NO: 123601 - RNA, 1701 nt, Artificial Sequence
  derived and/or modified sequence opt3 from hemagglutinin__InfluenzaA__ABO32937
augaagaccaucauugcccugagcuacauacucugccuuguguucgcucagaaacugcccggcaacgacaauuccacagcaacuuuguguuuagggcaccaugccgucccuaacggaacgaucguuagaaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaagaaaugggaucuguucguggagagguccaaggccuauucuaauuguuaccccuaugacgucccugauuacgcaucguugcggucacucguggccagcaguggcacucuggaauuuaacaaugaguccuucaacuggacagguguuacccagaaugggacgucuagcuccugcaaacgccgaucaaacaauagcuuuuucagucgucugaacuggcucacucauuuaaaguuuaaguauccagcucugaaugugaccaugcccaacaacgagaaauucgacaaguuguacaucuggggaguccaccauccuggcacagauaaugaccagauuuuucuuuaugcacaggccucuggcagaaucacuguguccaccaaaaggucacaacagacaguaauuccaaacaucgggagccggccccgcguuagaaauauaccuaguaggauuucuaucuacuggaccauugugaagccaggagauauccugcuaaucaacuccacggguaaucucauugcuccgcggggcuacuucaaaauacgcagcgggaagucgucuaucaugcgauccgacgcccccauuggaaaguguaacucagaaugcaucacuccuaauggcaguauaccaaacgacaaacccuuucagaaugucaacagaauuacauauggugcguguccuagguacgugaagcagaauacccugaaacuugcaacugggaugcggaacgugccagagaagcaaacacguggaaucuucggcgccaucgcuggcuuuauugaaaaugggugggagggaauggucgaugguugguauggcuuccgccaccagaacagcgaggggaucggacaggccgcagaccugaaauccacccaagcugccauuaaucagauaaacggcaaguugaacagacucaucgguaaaacgaaugaaaaguuccaccagauugagaaggaauuuucugagguugaagggaggauccaggaucuggagaaauacguggaggacaccaagaucgauuuauggagcuauaacgcggaacugcucguagcccuugagaaucaacauacaauugaccugacugauucagaaaugaacaaauuguucgagcggaccaagaaacagcuacgagaaaaugcagaggacaugggcaacggaugcuuuaagauauaccacaagugugauaaugcuugcaucggcaguauucgcaacgggacauaugaccaugauguguacagagacgaggcccugaauaacagguuccagaucaaaggagucgaacucaaguccgguuacaaagacuggauucuguggaucagcuuugcuauaucuugcuuccuucuguguguggccuugcucggcuuuaucaugugggcaugccagaaggggaauauucgguguaacaucugcauuuga

SEQ ID NO: 123602 - RNA, 1698 nt, Artificial Sequence
  derived and/or modified sequence opt3 from hemagglutinin__InfluenzaA__ABO32948
augagagccaagcugcucgugcuucugugcaccuucacagcuacuuacgcagacacgaucuguauuggcuaucacgccaacaauagcaccgauacagucgacacuguuuuggagaaaaacgugaccguaacacauuccgugaauuuacuggaagauucucacaacgggaagcuaugccuccugaaaggaauagcgccccuucagcuggguaauuguucagucgcuggcuggaucuuggggaacccugagugcgaacuccugauuaguaaggagagcugguccuacaucguggaaaccccaaauccggagaacggaacuuguuaucccggcuacuuugccgacuaugaggaacugagggagcaacucucuucgguuagcucauucgaacgguuugagauuuucccuaaagguaguuccuggccaaaucauacagugaccggggucucugcaagcugcucccacaacggaaagucaaguuuuuaccgcaauuuacuguggcuuacgggcaagaacggcuuguaucccaaucugagcaugucuuacgugaacaauaaagagaaggaaguucuaguacucuggggagugcaucacccuccaaacaucggggaucagcgagcccuguaccacacugagaacgcuuaugucuccguggugucaagccauuacagucguagauucacccccgaaauagcaaaaaggccuaagguccgggaccaggagggucgcaucaauuauuacuggacacuucuggaaccaggcgauacuauuaucuuugaggccaacgggaauuugauugcuccgugguaugccuucgcgcucucuagaggauuuggcuccgguaucauaaccagcaacgcacccauggacgagugugaugccaaaugccagacaccucaaggggcuauuaauucgucucugccauuccagaacguucaccccgugaccaucggagaauguccuaaguacguaagguccgccaaguuacggauggugacgggccugcgcaauauuccaucaauccagagucgaggccucuuuggggcaaucgcuggauucauugaggguggcuggacugggauggucgacggaugguauggcuaccaucaccagaacgaacaagguagcggguacgccgcggaucagaaauccacacagaaugccauaaacggcaucaccaauaaggugaacucuguuauugagaaaaugaauacucaguuuacagcagugggaaaggaguucaacaaacuugaaagaaggauggagaaucugaacaagaaagucgacgauggcuucuuggacaucuggaccuauaacgcugaacuacuggugcuccuggagaaugaacggacgcuugacuuucacgauagcaacguaaagaaucuguacgagaagguuaaaucacaauugaagaacaaugccaaagaaauagggaacggaugcuucgaguuuuaucauaaguguaauaacgagugcauggaaagugugaaaaaugguaccuacgacuaucccaaguacuccgaggaaagcaagcucaaccgugagaaaauugauggcgucaagcuggagucuauggggguguaucagaucuuagcuaucuacucaacagucgccaguagccuggugcuacucguuucccugggagcaauuucuuucuggaugugcucgaauggcagccuucagugucgcaucugcauuuga

SEQ ID NO: 123603 - RNA, 1698 nt, Artificial Sequence
  derived and/or modified sequence opt3 from hemagglutinin__InfluenzaA__ABO32959
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcagcuucgaaagguuugagauuuucccuaaggagaguuccuggccaaaucauacagugaccggugucucugcaagcugcucccacaacgggaagucaaguuuuuaccggaauuuacuguggcuuacgggcaaaaacggauuguaucccaaucugagccgcucuuacgugaacaauaaggaaaaagagguucuaguacucuggggcgugcaucacccuccaaacaucggggaucagcgagcccuguaccacacugaaaacgcuuaugucuccguggugucaagccauuacagucguagauucacccccgagauagcaaagaggccuaaaguccgggaccaggaaggacgcaucaauuauuacuggacacuucuggagccaggugauacuuugauuuuugaggccaacggcaaucucaucgcuccgugguaugccuucgcgcugucuagaggguuuggauccggcauuaucaccagcaacgcacccauggacgaaugugaugccaagugccagacaccucaaggugcuauaaauucgucuuuaccauuccagaacguucaccccgugaccauuggggaguguccuaaguacguaagguccacgaaacugcggauggugacuggacuccgcaauaucccaucaauucagagucgaggccuuuuuggcgccaucgcaggguucaucgaaggagguuggacaggcauggucgacgggugguauggauaccaucaccagaacgagcaaggcagcgguuacgcugccgaucagaaguccacccagaaugcgauuaacgggauaacuaauaaagugaacucuguuaucgaaaagaugaauacacaguuuaccgccgugggcaaagaguucaacaagcuggagagaaggauggaaaauuugaacaaaaaggucgacgauggauuccuagacauuuggacguauaacgcagagcugcucgugcugcuugaaaaugagcggacccuggacuuucacgauagcaacguaaagaauuuguacgaaaaaguuaagucacaacucaaaaacaaugcuaaggagaucggcaacgggugcuucgaguuuuaucauaaauguaauaacgaaugcauggagagugugaagaauggaacauacgacuaucccaaguacuccgaagagagcaaacugaaccgugagaagauagauggugucaaauuagaaucuaugggcguguaucagauucuggccaucuacucaacugucgcuaguagccuagugcuccugguuucccuuggggccaucucuuucuggaugugcucgaauggaucauugcagugucgcauuugcaucuga

SEQ ID NO: 123604 - RNA, 1698 nt, Artificial Sequence; identical to SEQ ID NO: 123220
  derived and/or modified sequence opt3 from hemagglutinin__InfluenzaA__ABO32970

SEQ ID NO: 123605 - RNA, 1701 nt, Artificial Sequence
  derived and/or modified sequence opt3 from hemagglutinin__InfluenzaA__ABO32981
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcauaacgugacccgagguguuacugcuuccugcucacacaaagggaagaguagcuuuuaucguaaucucuuauggcugacagagaaaaacggaucuuacccaaaucuuuccaagucauaugugaacaauaaggaaaaagaggucuuggugcuguggggcguacaucaccccagcaacaucaaggaccagaaaaccauauacagaaaggaaaaugcauacguuaguguggucucuuccaacuauaacaggcgguucacgccugagaucgccgaacgcccaaaagugagagaucaggcuggcaggauuaauuacuauuggacucuacucgagcccggggacaccaucauuuuugaggccaacggaaaucugaucgcgccuugguacgcauucgcccuuagccgggguuuuggcucggggauaauuacaucuaacgcuuccauggaugaaugugacacuaagugccagaccccacaaggagccaucaauucaagucugccguuccagaacgugcaccccgucacaauuggcgaguguccuaaauauguucgcagcaccaaguugcgaauggugacgggucucagaaauaucccauccauccagucuagggggcuguuuggagcaauugcuggcuucauagaaggcggguggacuggaaugaucgaugguugguacggcuaucaucaccagaacgagcaagggagcggauacgccgcggaccagaagucaacacagaaugccauuaacggcaucaccaauaaaguaaacagugugauagaaaagaugaauacucaguuuacagcagucgguaaagaguucaacaaguuagagaaacggauggaaaaucugaacaagaagguggaugacggguuccucgacauuuggaccuacaacgcugagcuucugguuuugcuagaaaaugagcguacgcuggauuuucaugacuccaacgugaaaaaucucuaugaaaaggucaaaagccaacugaagaacaaugccaaagagaucggcaacggaugcuucgaguuuuaccacaaguguaauaacgaaugcauggagucugugaagaauggcaccuaugauuaccccaaauauucagaagagaguaaacuuaaccgcgagaagaucgacgggguaaagcuggaaagcaugggaguuuaccagauuuuggcuaucuauuccacaguggccucuucgcucguccuguuagugagccugggugcaauuuccuucuggaugugcucaaauggcagucuacaguguagaauaugcaucuga

SEQ ID NO: 123606 - RNA, 1701 nt, Artificial Sequence
  derived and/or modified sequence opt3 from hemagglutinin__InfluenzaA__ABO32992
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcaugacgugacccgagguguuacugcuuccugcucacacaaagggaagaguagcuuuuaucguaaccucuuauggcugacagagaaaaauggaucuuacccaaaccuuuccaagucauaugugaauaacaaggaaaaagaggucuuggugcuguggggcguacaucaccccagcaauaucgaagaucagaagaccauauacagaaaagagaacgcauacguuaguguggucucuuccaauuauaacaggcgguucacgccugaaaucagcgagcgcccaaaggugagagaccagaaaggcaggauuaacuacuauuggacucuacucgagcccggggauaccaucauuuuugaagccaauggaaaccugaucgcuccuugguacgccuucgcgcuuucgcgggguuuuggcucugggauaauuacauccaaugcaucaauggacgagugugauacuaagugccagaccccacaaggagccaucaacaguagccugccguuccagaaugugcaccccgucacaauuggcgaauguccuaaauauguucgcuccaccaaguugcgaauggugacgggucucagaaacaucccaucuauccagagcagggggcuguuuggagcuauugccggcuucauagagggcggguggacuggaaugaucgacgguugguacggcuaucaucaccagaaugaacaagggucaggauacgcagcugaucagaagaguacacagaacgccauuaauggcaucaccaacaaaguaaauuccgugauagagaagaugaacacucaguuuacagcggucgguaaagaguucaauaaguuagaaaaacggauggagaaccugaauaagaagguggacgacggguuccucgauauuuggaccuacaacgccgaacuucugguuuugcuagagaacgaacguacgcuggacuuucaugauagcaaugugaaaaaccucuaugagaaggucaaaucucaacugaagaauaacgcaaaagagaucggcaauggaugcuucgaauuuuaccacaaguguaacaaugagugcauggaaucagugaagaacggcaccuaugacuaccccaaauauagugaggagagcaaacuuaaucgcgaaaagaucgaugggguaaagcuggaguccaugggaguuuaccagauuuuggcuaucuauucuacaguggccucgagccucguccuguuagugucccugggugcuauuucauucuggaugugcaguaacggcucucuacaguguagaauaugcaucuga

SEQ ID NO: 123607 - RNA, 1701 nt, Artificial Sequence
  derived and/or modified sequence opt3 from hemagglutinin__InfluenzaA__ABO33006
augaaggccaaaauccuggugcuccuuugcgcucugagcgcaaccgacgccgauacaauuuguauaggcuaccacgcgaacaauuccacugacacggucgauaccguuuuggagaagaacgugacaguaacucauucugugaauuuacuggaagacucacacaacgggaaacuaugcagacucaagggaaucgcuccccugcagcuugguaaauguaguauugccggcuggauccuggggaauccugagugcgagagcuuguucuccaagaagucuuggucguauauugcagaaaccccaaacucagaaaauggaacauguuacccgggcuauuuugccgauuacgaggagcucagggaacaacugagcagugucuccucuuucgagcgguuugaaaucuuccccaaagagcgcagcuggccuaagcauaacgugacccgagguguuacugcuuccugcucacacaaagggaagaguagcuuuuaucguaaucugcucugguuaacagagaaaaacggaucuuacccaaaucuguccaagucauaugugaacaauaaggaaaaagagguccuuguguuguggggcguacaucaccccagcaacauagaagaccagaagaccaucuacagaaaagagaaugcauacguuaguguggucucuuccaacuauaacaggcgguucacgccugaaauuagcaagcgcccaaaagugagagaucaggagggcaggaucaauuacuauuggacucugcuagagcccggggacaccauuaucuuugaagccaacggaaaucucauagcuccuugguacgccuucgcgcugucgcgggguuuuggcucugggauuaucacauccaacgcaucaauggaugagugugacacuaagugccagaccccacaaggagccauuaauaguagccuuccguuccagaacgugcaccccgucacaaucggcgaauguccuaaauauguucgcuccaccaagcugcgaauggugacggguuugagaaauaucccaucuauucagagcagggggcucuuuggagcuauagccggcuucaucgagggcggguggacuggaaugauugaugguugguacggcuaucaucaccagaacgaacaagggucaggauacgcagcugaccagaagaguacacagaaugccaucaacggcauaaccaauaaaguaaacuccgugauugagaagaugaauacucaguuuacagcggucgguaaagaguucaacaagcuggaaaaacggauggagaauuuaaacaagaagguggaugacggguuccuggacaucuggaccuacaacgccgaacuccuuguucuguuggagaaugaacguacgcuagauuuucaugacagcaacgugaaaaaucuguaugagaaggucaaaucucaacucaagaacaaugcaaaagagaucggcaacggaugcuucgaauuuuaccacaaguguaauaacgagugcauggaaucagugaagaauggcaccuaugauuaccccaaauauagugaggagagcaagcugaaccgcgaaaagauugacgggguaaaacuugaguccaugggaguuuaccagauccuggcuauuuauucuacaguggccucgagcuugguccuccugguguccuuaggugcuauaucauucuggaugugcaguaauggcucucugcaguguagaaucugcauuuga

SEQ ID NO: 123608 - RNA, 1701 nt, Artificial Sequence
  derived and/or modified sequence opt3 from hemagglutinin__InfluenzaA__ABO33025
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacaaccacaaugggaaacucugcaagcugaaaggaauagcuccccuucagcuggguaaguguucaaucgccggcuggauuuuggggaacccugagugcgaaagucucuucagcaagaaauccuggucuuauaucgcagagaccccaaauucggaaaacggaacauguuacccgggcuauuuugccgauuacgaggagcugagagaacaacugucaagcgucaguuccuucgagagguuugaaauuuuccccaaggagucuagcuggccuaaucauaacgugaccaaagguguuacugcuuccugcucacacaaggggaaaaguagcuuuuaucggaaucucuuauggcugacagagaagaacggaucuuacccaaaucuuuccaagucauaugugaacaauaaagaaaaggaggucuuggugcuguggggcguacaucaccccagcaacaucaaagaccagcgcaccauauaccgaaaggaaaacgcauacguuaguguggucucuucccacuauaaucguagauucacgccugagaucgccaaaaggccaaaggugcgggaucaggaaggccgcauuaacuacuauuggacucuacucgagcccggggacaccaucauuuuugaggcuaauggaaaccugaucgccccuugguacgcguucgcacuuagcagagguuuuggcucggggauaauuacaucuaaugccuccauggaugaaugugacgcuaaaugccagacuccacaaggagccaucaacucaagucugccguuccagaaugugcaucccgucaccauuggcgaguguccuaaguauguuaggagcacaaaguugcggauggugaccggucuccgcaacaucccauccauccagucucgagggcuguuuggagcaauugcuggcuucauagaaggcggguggacgggaaugaucgaugguugguacggcuaucaccaucagaaugagcaagggagcggauacgccgcggaccagaaaucaacucagagugccauuaacggcaucacaaauaagguaaacuccauaauugaaaagaugaauacccaguuuacugcaguggguaaagaguucaacaaauuagagaagagaauggaaaaucugaacaagaaagucgaugacggguuccucgacaucuggacauacaacgcugagcuucugguguugcuagaaaaugagaggacccuggauuuucacgacagcaacguuaagaaucucuaugaaaaagugaagucucaacugaaaaacaaugccaaggagaucggcaacggaugcuucgaguuuuaccacaaguguaauaacgaaugcauggagucagucaaaaauggcacguaugauuaccccaaguauagugaagagagcaaacuuaaccgggagaagauugacggggugaaacuggaauccaugggaguauaccagaucuuggcuauuuauucuaccguugccucgagccucgugcuguuagucucccugggugcaauaucauucuggaugugcaguaauggcucucuacagugucguaucugcauuuga

SEQ ID NO: 123609 - RNA, 1701 nt, Artificial Sequence
  derived and/or modified sequence opt3 from hemagglutinin__InfluenzaA__ABO33036
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcaauagcccacaccagauucucgacggcgagaacuguacccugaucgaugcucuacugggggacccgcauugcgauggauuucagaauaaagaaugggacuuguucguggagaggcggaaggccuauuccaacuguuaccccuaugaugucccugacuacgcaucucuccgcucgcugguggccucaagcggcacucuggaauuuaauaacgagaguuucaauuggacagguguugcucaaaacgggaccuccucugcaugcaaacgacguagcauaaaguccuuuuucucaagacucaauugguuacaccagcugaaguauaaauacccagcccuuaacgugacgaugcccaauaacgagaaguuugauaaauuguauaucuggggaguccaucacccuaguacugacagcgaucagauuucucuguacgcucaggccuccggcagggugaccguaucaacaaagcggagccaacagacuguuaucccaaacauuggcagucgccccugggugagaggggucucuuccaggaucagcauauacuggaccauugugaaaccuggagacauccuacucauuaauucgacagguaaccugaucgcgccacggggcuauuucaagauccgcucugggaaguccucaauuaugcgaagugaugcaccgauaggaaaauguaauagcgaaugcaucacccccaacggcuccauuccuaaugacaagccauuucagaacgugaauagaaucacguacggugccugucccagguaugucaaacagaacacucuuaagcuggcuacagggaugcggaauguuccugagaaacaaacccguggaauauucggcgccauugcaggcuuuaucgaaaacgggugggagggaaugguggacgguugguacggcuuccgccaccagaauagcgaggggacuggacaggcugccgauuugaagucuacacaagcggccaucaaccagauuaauggcaaacucaacagacugaucgaaaagaccaaugagaaguuucaucagauugaaaaagaguucucagaaguagaggguaggauacaggacuuagagaaguauguggaagauacgaaaaucgaccuguggaguuacaacgcagagcuccuugucgcucuggaaaaccaacacaccauugauuugacagacuccgagaugaauaagcuauucgaacggacuaaaaagcagcugcgagagaacgccgaggauauggggaauggcugcuuuaagaucuaucauaaaugugacaacgcuugcaucggaagcauucgcaauggcaccuacgaucacgacguguacagagaugaagcccucaacaauagguuccagauaaaggggguugagcugaaaucuggauauaaggacuggauccuuuggauuucauuugcaaucaguugcuuccuguugugugugguccuccuggguuuuauuaugugggccugccagaaaggcaacauccgguguaauauaugcaucuga

SEQ ID NO: 123610 - RNA, 1701 nt, Artificial Sequence; identical to SEQ ID NO: 122088
  derived and/or modified sequence opt3 from hemagglutinin__InfluenzaA__ABO33047

SEQ ID NO: 123611 - RNA, 1701 nt, Artificial Sequence; identical to SEQ ID NO: 122666
  derived and/or modified sequence opt3 from hemagglutinin__InfluenzaA__ABO33058

SEQ ID NO: 123612 - RNA, 1701 nt, Artificial Sequence
  derived and/or modified sequence opt3 from hemagglutinin__InfluenzaA__ABO33069
augaagaccaucauugcccugagcuacauauucugccucguguuugcucagaaccuucccggcaaugacaacuccacagcaacucuguguuuggggcaccaugccgucccuaauggaacguuaguuaaaaccaucacaaacgaucaaauugaggugacuaaugcgaccgaacugguacagucuucaaguacagguagaaucugcgacagcccacacaggauucuagauggcaagaacuguacccucaucgacgcucugcuuggggauccgcauugcgacggauuccagaaugagaaaugggaucuguuuguggaacgguccaaggccuucucuaacuguuaucccuacgacgucccugauuaugcaucguugcgcucacucguggccagcaguggcacucuggaguuuauaaaugaagguuucaacuggacagggguuacccagaauggaggcuccuacgcuugcaaacgaggcccagacaacagcuuuuucucucgucugaauuggcucuaugaguccgagucaaaguaccccguguuaaacgucacgaugccuaauaacgauaacuuugacaagcuguauaucuggggagugcaccauccaaguacugauaaagaacaaaccaaucuuuacguacaggcaagcgggagaguuacagugucuacuaagaaaucccagcagaccauuauccccaacgucgguucaaggccuugggugcggggcuugagcagucgcauuucuaucuacuggacaauagugaagccaggggacauucugcuaaucaauuccaacggaaaucucauugccccgagaggcuauuucaaaaucaggaccgguaagagcucgaucaugcggucugacgcucccauugggacguguuccucagagugcauaacuccuaacggaaguaucccaaaugauaagcccuuucaaaacgucaauaaaauuacauacggcgccuguccuaaguauguuaaacagaacacccugaaacuugcgacuggcaugcgcaaugugccagaaaagcagacacgagggaucuucggagcaauagccgguuuuauugagaacggcugggaggggaugguagacggaugguacggcuucagacaccagaauagcgaagguaccgggcaagcugccgaucugaaguccacgcaggcagcuaucgaccagaucaacggcaaauugaauagggugauugagaagaccaacgaaaaguuccaccaaaucgagaaagaauuuucugaggucgagggacggauucaggaucucgaaaaguauauagaggacacaaaaaucgaucuguggagcuacaacgccgaauuacugguggcgcucgagaaucagcauacuauugaccuuaccgauucaaagaugaacaaacuguucgaaaagacacgucgccaguugagagagaaugccgaggacaugggcaacgggugcuuuaagaucuaucacaaaugugauaaugcaugcaucggaaguauuaggaacgguacuuacgaccaugacguuuaccgggaugaagcucuaaauaaccgauuccaaauaaagggcguggagcugaaauccggguauaaggacuggauccucuggauuagcuuugccaucucuugcuuccugcuuugugucgugcuguugggauuuauuaugugggcuugccagaaaggcaauauccgcuguaacauaugcaucuga

SEQ ID NO: 123613 - RNA, 1701 nt, Artificial Sequence; identical to SEQ ID NO: 122937
  derived and/or modified sequence opt3 from hemagglutinin__InfluenzaA__ABO37988

SEQ ID NO: 123614 - RNA, 1701 nt, Artificial Sequence
  derived and/or modified sequence opt3 from hemagglutinin__InfluenzaA__ABO38010
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugagaaaaacggacuguaucccaaucuuagcaagucuuacgucaacaauaaagaaaaggaaguguugguacuguggggcguucaucacccuuccaacaucggcgaucagcgcgcaauuuaccacaccgagaacgccuaugugucagucgugagcagucauuacucucgacguuuuacaccagaaaucgcuaagagacccaaagugagggaccaggaggggcggauaaauuauuacuggacucuacucgagccuggagauaccaucauuuucgaagccaacgguaaucugaucgcgccaugguaugcauuugcccuuucccgcggcgucgggagcggaauuaucacaucgaacgcuucuaugggcgacugugaugccaagugccagaccccgcaaggugcaauaaauuccucacugcccuuccagaacguucacccugugacgauuggggaguguccaaaauacguaagaaguacuaaguugaggauggugacaggacuccggaauauccccagcauucagucccgcggccuguuuggcgcuaucgccggguucaucgaaggagguuggaccggcaugauugacgggugguauggauaccaucaccagaacgagcaaggcucugguuacgcggccgauaaaaagagcacucagaaugcaauagacgggaucacaaacaaagucaauucagugauugaaaagaugaacacccaguuuacggcuguuggcaaggaguucaauaaauuagagcgaagaauggaaaaccugaauaagaaaguggaugacggauuccucgacaucuggaccuauaacgccgagcuucuggucuugcuagaaaacgagaggacacuggauuuucacgacaguaaugugaagaaccucuacgaaaaaguaaagaaucagcugaagaacaaugcuaaagagauaggcaacgggugcuucgaguuuuaucauaaguguaauaacgaaugcauggaguccguuaaaaauggaacuuacgauuauccuaaguacagcgaagagucuaaacuuaagcgggagaagauugacggugugaaacuggaaucaaugggcgucuaucaaaucuuggccaucuacaguaccguggcaagcucccucguccuguuagugucucugggggccauuucguucuggaugugcagcaacggaucccuacagugucguaucugcauuuga

SEQ ID NO: 123615 - RNA, 1698 nt, Artificial Sequence
  derived and/or modified sequence opt3 from hemagglutinin__InfluenzaA__ABO38021
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuccaaaagagaguuggagcuacaucguggaaaccccgaaucccgagaacggaacuuguuauccuggcuacuuugccgacuaugaggaacugagagagcaacucuccucuguuucgucauucgaaagguuugagauuuucccaaaggagagcaguuggcccaaucauacagugaccggugucuccgcaucuugcagccacaacgggaaguccucauuuuaccggaauuuacuguggcuuacgggcaaaaacggauuguauccuaaucugaguaagagcuacgccaacaauaaagaaaaggaggugcuaguacucuggggcguucaucacccacccaacaucggggaucagcgcgcucuguaccacacugaaaacgcauaugugucugucguguccucacauuacagccgacguuucauaccugagauggccaaaagaccaaaggugagggaccaggaaggacggaucaauuauuacuggacccuucuggagccgggugauacaauuaucuuugaggcuaacggcaauuugauugcccccugguaugcguucgcacucagucgcggguuuggaucuggcaucauaacuuccaacgccccuaugggugaaugugacgcuaagugccagaccccacaaggggccauuaauagcucgcugcccuuccagaacguccacccuguuacaaucggagaguguccaaaauacgugagaucugcaaaguuaaggaugguaaccggccugcggaauauucccuccauccagucacgcggccucuuuggggcuaucgccggauucauugaagguggcuggacggggaugguggauggaugguauggcuaccaucaccagaacgagcaagguaguggguacgcggccgaccagaaaagcacucagaaugcaauaaacggcaucacaaauaaggucaacuccgugauugaaaagaugaauacccaguuuacugcuguuggaaaagaguucaacaaacuugagcgaagaauggaaaaucugaacaagaagguggaugacggcuucuuggauaucuggacauauaacgccgagcuacugguccuccuggaaaaugagaggacccuugacuuucacgacucuaacgugaaaaaucuguacgaaaagguaaaaagccaauugaagaacaaugcuaaagagauagggaacggaugcuucgaguuuuaucauaaguguaauaacgaaugcauggagucaguuaagaaugguacguacgauuauccgaaauacagugaagaguccaagcucaaccgggagaaaauugacggcgugaagcuggaaagcaugggggucuaucagaucuuagccaucuacucuaccguggcaucaagucugguccuacucgugagccugggagccauuuccuucuggaugugcucuaauggcucgcuucagugucguaucugcauuuga

SEQ ID NO: 123616 - RNA, 1698 nt, Artificial Sequence
  derived and/or modified sequence opt3 from hemagglutinin__InfluenzaA__ABO38032
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccagacccggagaauggaacuuguuaucccggcuacuuugcugauuaugaggaacugagagagcaacucucuucggugagcucauucgaaagguuugagauuuucccuaaggagaguuccuggccaaaccauacagucaccggugugucugccagcugcucccacaaugggaagucaaguuuuuaccggaacuuacuguggcuuacgggaaagaauggcuuguaucccaaccugagcaagucuuacgcaaauaacaaagaaaaggaggugcuaguucucuggggcgugcaucacccuccaaauaucggggaccagcgcgcccuguaccacacugaaaacgcuuaugucuccguggugucaagccauuacagucgacguuucacccccgagauagcaaaaagaccuaaggucagggaucaggaaggacggaucaacuauuacuggacacuucuggagccaggugacacuauuaucuuugaggccaauggcaacuugauugcuccgcgcuaugccuucgcgcucucuagaggguuuggauccggcaucauaaccagcaaugcacccauggaugaaugugacgccaagugccagacaccuaaaggugcuauuaacucgucucugccauuccaaaauguucaccccgugaccaucggggaguguccuaaguacguaagguccgccaaauuacggauggugacgggacugcgcaacauuccaucaauccagagucgaggccucuuuggcgcaaucgcuggguucauugaaggagguuggacuggcauggucgaugggugguauggauaccaucaccagaaugagcagggcagcgguuacgccgcggaccaaaaguccacacagaacgccauaaaugggaucaccaacaaaguaaauucuguuauugaaaagaugaacacucaguuuacagcagugggcaaagaguucaauaaacuugagagaaggauggaaaaccugaauaagaaagucgaugacggauucuuggacaucuggaccuauaacgcugagcuacuggugcuccuggaaaacgagcggacgcuugauuuucacgacagcaauguaaagaaccuguacgaaaaaguuaagucacaguugaaaaauaacgccaaggagauaggcaaugggugcuucgaguuuuaucauaaguguaacaaugaaugcauggagagugugaaaaacggaaccuacgauuaucccaaguacuccgaagagagcaaacucaaucgugagaagauugacggugucaaacuggaaucuaugggcaucuaucaaaucuuagcuauuuacucaacaguggccaguagccugguccuacucgugucccugggggcaaucucuuucuggaugugcucgaacggaagccuucagugucgcauuugcauauga

SEQ ID NO: 123617 - RNA, 1698 nt, Artificial Sequence; identical to SEQ ID NO: 122816
  derived and/or modified sequence opt3 from hemagglutinin__InfluenzaA__ABO38043

SEQ ID NO: 123618 - RNA, 1701 nt, Artificial Sequence
  derived and/or modified sequence opt3 from hemagglutinin__InfluenzaA__ABO38054
augaaggccagacugcucgugcuucugugcgcuuuggcagccaccgacgcggauacaaucuguauuggcuaccacgcuaacaauagcacugacacggucgauaccguuuuagagaaaaacgugacaguaacucauuccgugaaucugcuagaagacucucacaacgggaagcucugcaggcugaaaggaauagcaccccuucagcuggguaaguguaauaucgccggcuggauuuuggggaacccugagugcgaaucacuccugagugagcggagcugguccuauaucgucgaaaccccaaauucugagaacggaacauguuacccgggcgauuucauugacuaugaggaacugcgcgagcaacucucgucagugagcaguuuugaacgauucgagaucuuuuccaaagagucuagcuggcccaagcauaauaccacucgugguguuacagccgcuugcucccacgcagggaagucaaguuucuacagaaacuuacuguggcuuaccgaaaaagauggaagcuauccuaauuugaacaauucuuacgugaacaagaaaggcaaggagguccuggugcuauggggcguacaucacccauccaauauaaaagaccagcagacgcucuaucagaaggaaaacgccuacguuucaguggucagcaguaacuacaauaggcgguuuacucccgagaucgcugaacgcccuaaggugagagggcaagccggaaggaugaacuauuacuggacccugcuuaaaccaggugauacaauuauguucgaggcgaauggcaaccugaucgcacccugguaugccuuugcuuugucucggggguucggauccggcauuaucacuagcaaugccucgaugcacgagugugacaccaagugccagacaccucagggugcaauaaacucuucccucccauuucagaauauucauccggugaccaucggggaaugucccaaauacguccgcucaacgaagcugcgaaugguuacuggauuaagaaacauuccuaguauccaaagcaggggccuguucggcgcuaucgccggguuuauugagggagguuggacaggcaugauagaugggugguauggauaccaccaucagaaugaacagggcuccgguuaugcggccgaccagaaaucuacccaaaacgcaaucaaugggauuacuaacaaggugaauagcguaaucgagaaaaugaacacacaguucaccgcugugggcaaggaauuuaauaaccucgagaagcggauggagaaccuuaauaaaaaggucgaugacggauuccuggacauauggacguacaacgccgaauugcuagugcugcucgagaaugaacguacccuggauuuccacgacucaaacguuaaaaaucuuuacgagaaggugaaaaaccagcugcgcaauaacgcuaaggaaauuggcaaugggugcuuugaguucuaucacaaguguaacaaugagugcauggaaagugucaaaaacggaacauacgauuauccaaaguacuccgaggaaagcaaauugaauagagagaagaucgacggugugaaacucgagucuaugggcguauaucaaauccuggccauuuacucaacuguugcaaguagcuuagugcugcuagucucccucggggccaucucuuuuuggaugugcucgaacggaagccugcaguguaggauuugcauauga

SEQ ID NO: 123619 - RNA, 1701 nt, Artificial Sequence
  derived and/or modified sequence opt3 from hemagglutinin__InfluenzaA__ABO38065
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcauaacaucacccgaggugugacugcuuccugcucacacaaagggaagaguagcuuuuaucguaaucucuuauggcugacagagaaaaacggaucuuacccaaaucuuuccaagucauauguuaacaauaaggaaaaagagguguugguccuguggggcgugcaucaccccagcaacauagaagaccagaagaccaucuacagaaaagagaaugcauacguaaguguugugucuuccaacuauaacaggcgguucacgccugaaauugccaagcgcccaaaagucagaggccaggaggggaggaucaauuacuauuggacucuacucgagcccggagauaccauuaucuuugaagcuaacgguaaucugauagccccuugguacgcguucgcacuuagccggggcuuugggucgggaauuaucacaucuaacgccuccauggacgagugugauacuaagugccagaccccacaaggcgcuauuaauucaagucugccguuccagaacgugcaccccgugacaaucggugaauguccuaaauauguccgcagcaccaaguugcgaaugguuacggggcucagaaauaucccauccauucagucuaggggacuguuuggcgccauagcaggcuucaucgaagggggauggacugguaugauugacggcugguacggguaucaucaccagaacgaacaaggaagcggcuacgcugccgaucagaagucaacacagaaugcgaucaacgguauaaccaauaaagugaacaguguaauugagaagaugaauacucaguuuacagccguggggaaagaguucaacaaguuagaaaaacggauggagaaucugaacaagaaggucgacgauggcuuccucgacaucuggaccuacaacgcagaacuucugguguugcuagagaaugaacguacgcuggacuuucaugauuccaacguuaaaaaucucuaugagaaggugaaaagccaacugaagaacaaugcuaaagagaucggaaacggcugcuucgaauuuuaccacaaguguaauaacgagugcauggaaucugucaagaaugggaccuaugacuaccccaaauauucagaggagaguaaacuuaaccgcgagaagauugauggagugaagcuggagagcauggguguauaccagaucuuggccauuuauuccacaguugcuucuucgcucgugcuguuagucagccugggcgccauauccuucuggaugugcucaaaugggagucuacaguguagaaucugcauuuga

SEQ ID NO: 123620 - RNA, 1701 nt, Artificial Sequence; identical to SEQ ID NO: 122259
  derived and/or modified sequence opt3 from hemagglutinin__InfluenzaA__ABO38076

SEQ ID NO: 123621 - RNA, 1701 nt, Artificial Sequence
  derived and/or modified sequence opt3 from hemagglutinin__InfluenzaA__ABO38087
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccgguccggcaagucaaguauuaugcgcagcaacgcaccgauagggaaguguaauuccgaaugcaucacgcccaacggaucuauuccuaaugacaaaccauuucagaacgucaaucgaaucacuuacggcgccugucccagauauguuaagcagaacacacuuaaacuggcuaccgguaugaggaaugugccugagaagcagacucgggggauauucggagccauugcaggcuuuaucgaaaacggcugggaggggaugguagacggaugguacgguuuccgucaucaaaauagcgagggcacagggcaggcugccgauuugaaaucaacccaggcggccaucaaccaaauuaauggaaagcucaaccgccugaucgagaaaacgaaugaaaaguuucaccagauugaaaaggaguucagugaaguggagggcagaauacaggacuuagagaaauaugucgaagauaccaagaucgaccugugguccuacaacgcagagcuccuuguggcucuggaaaaccagcauacaauugauuugacugacagcgagaugaauaaacuauucgaaaggacccggaagcaacugcgagagaacgccgaggauguugguaaugggugcuuuaaaaucuaucacaagugugacaacgcuugcaucggcucuauucgcaauggaacauacgaucacgacguguacagagaugaagcccucaacaauagguuccagauaaagggcgucgagcugaaaucaggguauaaggacuggauccuuuggauuaguuuugcaaucagcugcuuccuguugugugugguacuccugggauuuauuaugugggccugccagaaagguaacauccgguguaauauaugcaucuga

SEQ ID NO: 123622 - RNA, 1689 nt, Artificial Sequence
  derived and/or modified sequence opt3 from hemagglutinin__InfluenzaA__ABO38098
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcaacuauccuguggcaaaggggaguuacaauaacacauccggagagcagaugcuuaucauuugggguguccaccacccaaaugacgagaccgaacagaggacguuguaucagaacgugggcacuuacguaucuguugggaccagcacacugaauaagcgguccacucccgauaucgccacccgcccuaaagugaacggacaaggcgguagaauggaguuuucauggacacuacucgacaugugggauaccauaaacuucgaaaguacggggaaucugauugcuccagaguacggauuuaagaucagcaaaagggggucuuccggcauuaugaagacugaaggcacacuuggaaacugcgagaccaaaugucagacuccgcugggugcaaucaauacaaccuugcccuuccauaacguccacccucucacgaucggcgagugcccaaaguaugugaaaucagaaaagcugguguuagccaccgggcugcggaaugucccccagauugagagccgcggacucuuuggcgcuauagccgguuucaucgaagggggcuggcagggaaugguugacggcugguacggguaucaucacaguaacgaucaaggaucugguuacgcggcagacaaggaguccacacagaaagccuuugacggcauuacuaauaaggugaacagcguaaucgagaaaaugaauacccaguucgaggcuguggggaaggaguuuucgaaccuugaacgaagacuggagaauuugaacaaaaagauggaagauggauuccuagacgucuggacauauaaugccgagcugcucgugcugauggaaaacgagaggacucuugauuuccacgacucuaauguuaagaaccuguacgauaaagugcggaugcaguugcgugacaacgucaaggagcucggcaaugguuguuuugaguucuaucauaaaugcgaugacgaauguaugaacuccgugaagaaugggaccuacgauuacccuaaauaugaagaggagucaaagcugaaccgcaaugaaauaaagggcguaaaauuaaguagcaugggaguuuaccaaauucuggcaaucuaugcuacaguggccggcucccuaucucucgcgaucaugauggccgggauuagcuuuuggaugugcucaaacggaagucugcagugcagaaucuguauuuga

SEQ ID NO: 123623 - RNA, 1701 nt, Artificial Sequence
  derived and/or modified sequence opt3 from hemagglutinin__InfluenzaA__ABO38230
augaagaccaucauugcccugagcuacauauucugccagguguuugcucaaaaccuccccggcaaugacaacuccacagcaacucuuugucuggggcaccaugccgucccuaauggaacguugguuaaaaccaucacaaacgaucagauugaggugacuaaugcgaccgaauuaguacagucuucaaguacagguagaaucugcgacaacccacacaggauucuggauggcaagaauuguacccuaaucgacgcucuccugggggauccgcauugcgacggauuccagaacgagaaaugggaucuuuuuguggaacggagcaaggccuucuccaauuguuaucccuacgacgucccugauuaugcaucucugcgcucguugguggccucaagcggcacucucgaguuuuucaacgaagguuuuaauuggacagggguuacccaaaacggaggcaguuacgcuugcaaacgaggcccagacaauuccuucuuuucucgucugaacuggcuguauaagagcgaguccacguaccccgugcucaaugucacuaugccuaacaacgauaauuucgacaaguuauauauauggggagugcaccauccaucaaccgauaaagagcagacaaaccuguacguacaggcaagugggagaguuacugugagcaccaagaggucucagcaaacaaucauucccuccgucgguucacggccuugggugcgcggccuuagcaguagaaucucuauuuacuggaccaucgugaaaccaggggacgucuugcugauaaauuccaacggaaaucuaauugccccgaggggcuauuuuaagauccggacggguaaaagcucgauuaugcgcucugacgcucccaucgggacuuguuccucagaaugcaucacaccuaacggaaguauuccaaaugauaagcccuuccagaacguugacaagauaaccuacggcgccuguccuaaauaugugaagcagaauacucucaaacuggcgacaggcaugcgaaacguaccagagaagcagaccagagggaucuuuggagcaauugccgguuucaucgaaaauggcugggaggggaugauagauggaugguacggcuucaggcaccaaaacagcgaggguacggggcaggcugccgaccuuaaauccacccaggcagcuauugaucaaaucaauggcaagcugaaccgggugaucgagaaaacaaaugaaaaguuucaccagauugaaaaggaguucucugaagucgagggacguauccaggacuuggagaaauauguggaagauacuaagauugaccucuggagcuacaacgccgagcuguuaguugcgcuggaaaaccagcauaccauagaucucacagacucagagaugaauaaacuuuuugaaaagacucgcagacaacugagggagaacgccgaggauaugggcaaugggugcuucaaaaucuaucacaagugugacaacgcaugcauuggaaguauccggaaugguaccuacgaccaugauguguaccgagacgaggcuuugaacaaucgcuuucagaucaagggcgucgaacuaaaauccggguauaaggauuggauucuguggaucagcuucgccauaucuugcuuucuccugugugugguacuucugggauucauuaugugggcuugccagaaaggcaacaucagauguaauauuugcaucuga

SEQ ID NO: 123624 - RNA, 1701 nt, Artificial Sequence
  derived and/or modified sequence opt3 from hemagglutinin__InfluenzaA__ABO38241
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcaaaaauuguacccucaucgacgcucugcuuggggauccgcauugcgacggauuucagaacgagaagugggaucuguucguggaacggucuaaagccuuuucgaauuguuaucccuacgacgucccugauuaugcaucauugcgcagccucguggccaguuccggcacucuggaguucauaaacgaagguuuuaauuggacagggguuacccagucuggaggcagcuacacgugcaagcgaggcuccgugaacucauucuuuagucgucugaauuggcucuaugagagcgagucuaaguacccagcuuuaaacgucacuaugcccaauaacgggaaauucgacaagcuguauaucuggggagugcaccauccuuccaccgauaaagaacaaacaaaucuuuacguaagagcaucagguaggguuacugugagcaccaagcggagucagcagacagucauuccaaacaucggcccccgcccuugggugagaggguugucuuccaggauuagcaucuacuggaccauagugaaaccaggagacauucugcuaaucaacucgacgggcaaucucauugccccgcgggguuauuuuaagauccgcacugggaagucuuccaucaugcgaucagaugcucccauuggaacauguaguagcggcugcauaaccccuaacggcuccaucccaaaugacaaacccuuccagaacgucaauaagauuacuuacggggccuguccuagauauguuaaacaaaacacacugaaacuugcgaccggaaugaggaaugugccagagaaacagacgcgggguaucuuuggcgcaauagccggguucauugaaaacggaugggagggcaugguagacgguugguacggguuucgucaccagaauagcgagggcaccggacaggcugccgaucugaagucuacacaagcagcuaucgaccagaucaacggcaaauugaaucgccucauugaaaagacuaacgagaaguuccaccagaucgaaaaagaguucucagaaguggaggggaggauucaagaucuggagaaguaugucgaagacaccaaaauagauuuauggaguuacaaugccgagcugcucguggcgcuugaaaaccagcauacaaucgacaugacugauuccgagaugaauaagcuguuugaaaagaccagaaagcaguugcgggagaacgccgaggacaugggaaacgguugcuucaagauuuaucacaaaugugauaaugcaugcaucggcagcauccgaaacgggacauacgaccaugauguuuaccgcgacgaagcucuaaauaacagauuucagauuaagggaguggagcugaaaucuggcuauaaggacuggauacucuggaucucauucgccauuaguugcuuucugcuuugugucgugcuguuggguuucaucaugugggcuugccaaaaagggaauauuagguguaacaucugcauauga

SEQ ID NO: 123625 - RNA, 1701 nt, Artificial Sequence; identical to SEQ ID NO: 122298
  derived and/or modified sequence opt3 from hemagglutinin__InfluenzaA__ABO38252

SEQ ID NO: 123626 - RNA, 1689 nt, Artificial Sequence
  derived and/or modified sequence opt3 from hemagglutinin__InfluenzaA__ABO38296
auggugaucauuuaccugauacuccuuuucaccgccgucagaggcgaccagaucugcauuggguaucacgcuaacaauagcacagagaagguugauacuauccuggaaaggaacgugacgguaacccaugcaaaagacauuuuggagaagacacacaauggaaaauuauguaagcugaacgguauacccccucuagaacucggcgauugcuccaucgccggguggcugcuuggaaauccagagugugaccggcuguugucugugccggaauggucauacaucauggagaaagagaacccccgcgauggccucugcuauccugguaguuuuaaugacuacgaagaacugaagcauuuccugagcuccgucaagcacuuugaaaaagugaagauucucccaaaagaucgauggacucaacauaccacaaccgggggaucucgugcgugugcuguuucgggcaaccccucauucuuuagaaauauggugugguuaacuaagaaaggcagcaacuauccugucgccaaggggaguuacaauaacacauccggagagcagaugcugaucauuuggggugugcaccacccaaaugacgagaccgaacagaggacgcuuuaucagaacguaggcacuuacguuucuguggggaccagcacauugaauaagcgguccacucccgauaucgcaacccgcccuaaagucaacggacugggcgguagaauggaguucucauggacacuacucgacaugugggauaccauaaacuuugaaaguacggggaaucugauugccccagaguacggauucaagaucagcaaaagggggucuuccggcauuaugaagacugaaggcacacuuggaaacugcgagaccaaaugucaaacuccgcugggugcuaucaauacaaccuugcccuuucauaacgugcacccucucacgaucggcgagugcccaaaguaugugaaaucagaaaagcuggucuuagcaaccgggcugcggaauguuccccagauugagagccgcggacucuucggcgccauagcugguuuuaucgaagggggcuggcagggaaugguggacggcugguacggguaucaucacaguaacgaucagggaucugguuacgccgcggacaaggaguccacacaaaaagcauucgacggcauuacuaauaagguaaacagcgugaucgagaaaaugaauacccaguuugaggccgucgggaaggaguucucgaaccuugaacgaagacuggagaauuugaacaaaaagauggaagauggauuccuagacguguggacauauaaugcugagcugcucguucugauggaaaacgagaggacucuugauuuucacgacucuaaugugaagaaccuguacgauaaaguccggaugcaguugcgugacaacgccaaggagcucggcaaugguuguuucgaauuuuaucauaaaugcgaugacgaguguaugaacuccgugaagaaugggaccuacuacuauccuaaauacgaagaggagucaaagcugaaccgcaaugaaauaaagggcguaaaauuaaguagcaugggaguuuaucagauucuggcaaucuacgcuacaguggccggcucccuaucucucgcgaucaugauggccgggauuagcuucuggaugugcucaaacggaagucugcaaugcagaaucuguauuuga

SEQ ID NO: 123627 - RNA, 1698 nt, Artificial Sequence; identical to SEQ ID NO: 122886
  derived and/or modified sequence opt3 from hemagglutinin__InfluenzaA__ABO38318

SEQ ID NO: 123628 - RNA, 1698 nt, Artificial Sequence; identical to SEQ ID NO: 122816
  derived and/or modified sequence opt3 from hemagglutinin__InfluenzaA__ABO38329

SEQ ID NO: 123629 - RNA, 1701 nt, Artificial Sequence
  derived and/or modified sequence opt3 from hemagglutinin__InfluenzaA__ABO38351
augaaggccagacugcucgugcuucugugcgcuuuggcagccaccgacgcggauacaaucuguauuggcuaccacgcuaacaauagcacugacacggucgauaccguuuuagagaaaaacgugacaguaacucauuccgugaaucugcuagaagacucucacaacgggaagcucugcaggcugaaaggaauagcaccccuucagcuggguaaguguaauaucgccggcugguugcucgggaacccugagugcgauccacugcugccggcccggucauggaguuauauugucgaaacccccaauagcgagaacggaaucuguuacccuggcgcuuucauugacuaugaagaacuccgcgagcaauuauccucugugucgucauuugaacgauucgagaucuuuccaaaagaaagcaguuggcccaaucauaacacaaauauagguguuaccgcagccugcucccacgcugggaagucuagcuucuaccguaaccugcuuugguugacuaagaaaggaggcuccuauccuaagcugaaaaauucauacgugaacaagaaaggcaaggagguccuagugcucugggggauccaucacccaaguaauagcaaggaucagcagacacuguaucagaacgagaacgccuacguaucuguuguguccucaaauuacaacagaagguuuacccccgaaauugcggagcggccugaaguccgcgaccaagcaggaagaaugaauuauuacuggacgcuucuggagccaggugauacuaucauguucgaagccaacggcaauuugguggcuccgugguaugccuuugcacucagcaggggguucggaaguggcauuaucaccucuaacgcuuccaugcacgaguguaauacaaaaugccagacuccccagggugccauaaacagcucgcugccuuuucagaauauucauccagugaccaucggggagugucccaaguacguccggucugcgaaauuacgcaugguuacaggacugcgaaacauuccuuccauccaaucaagaggccucuucggcgccaucgcaggguuuauugaaggagguuggaccggcaugauagacgggugguauggauaccaccaucagaaugagcagggcagugguuaugcugccgaucagaaaagcacgcaaaacgcuaucaaugggauuacuaacaaaguaaauuccgugaucgaaaagaugaacacacaguucaccgccgugggcaaagaguuuaacaaucuugaaaagaggauggagaaccugaauaagaaagucgacgauggauucuuggacauauggacuuacaacgcagagcuacuggugcuccuggaaaaugagcggacacuugacuuccacgauucuaacguuaagaaucuguacgaaaaagucaagagccaguugaaaaacaaugccaaggagauuggcaacgggugcuuugaguucuaucacaagugugacaaugagugcauggagucagugcguaacggaaccuacgauuauccaaaauacagugaagaguccaagcucaaucgcgaaaagaucgacggugugaagcuggagagcaugggcguauaucaaaucuuagcuauuuacucuacgguugcgucaagucuggugcuacucgucagccugggggcaaucuccuuuuggaugugcucuaacggaucgcuucaguguagaauuugcauauga

SEQ ID NO: 123630 - RNA, 1701 nt, Artificial Sequence
  derived and/or modified sequence opt3 from hemagglutinin__InfluenzaA__ABO38362
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucgucuccaagaagucuuggucguauaucgcagagaccccaaacucagaaaauggaacauguuacccgggcuauuucgccgauuacgaggagcugagggaacaacugagcaguguguccucuuuugagcgguucgaaauuuuucccaaagagagcuccuggccuaagcauaacguuacccgcggugugacugcuucaugcagucacaaagggaaaagcucuuucuaucgaaaucucuuauggcugacagagaaaaacggauccuacccaaaucuuucaaagagcuaugucaacaauaaggaaaaagagguguugguacuguggggcguucaucaccccaguaacaucgaaaaucagaagaccauauaccguaaagagaacgcauacgugucugucguguccagccacuauaacagaagguuuacgccugaaaucgccaagcggccaaaagugcgcgaccaggagggcagaauuaauuacuauuggacucuacucgagcccggggauaccaucauuuucgaagcuaacggaaaucugaucgccccuugguacgcguuugcacuuucgagggguuucggcucugggauaauuacauccaacgccucaaucgacgagugugaugcuaagugccagacuccacaaggagccauuaauaguagccugccguuucagaacguccaucccguuaccaucggcgaauguccuaaauaugugcgguccacaaaguugcgcaugguaaccggucuccgaaauaucccaucuauucagagcagagggcuguucggagcaauagcuggcuuuaucgagggcggguggacgggaaugauugacgguugguacggcuaucaccaucagaacgaacaagggucaggauacgccgcggaucagaagaguacucagaaugccaucaacggcauaacaaauaaagugaacuccgucauugagaagaugaauacccaguucacugcaguggguaaagaguuuaacaaguuagaaaagaggauggagaaucugaacaagaagguugacgauggguuccucgacaucuggacauacaacgcugaacuucugguguugcuagagaaugaacggacccuggacuuccacgauagcaacgucaaaaaucucuaugagaaggugaaaucucaacugaagaacaaugccaaagagaucggcaacggaugcuuugaguucuaccacaaguguaauaacgaaugcauggaaucaguaaagaauggcacguaugacuaccccaaauauagugaggagagcaaacuuaaccgugaaaagauugaugggguuaagcuggaguccaugggaguguaccagaucuuggcuauuuauucuaccgucgccucgagccucgugcuguuagucucccugggugcaauaucauuuuggaugugcaguaauggcucucuacagugucgcaucugcauuuga

SEQ ID NO: 123631 - RNA, 1698 nt, Artificial Sequence
  derived and/or modified sequence opt3 from hemagglutinin__InfluenzaA__ABO38373
augaaggccagacugcucgugcuucugugcgcuuuggcagccaccgacgcggauacaaucuguauuggcuaccacgcuaacaauagcacugacacggucgauaccguuuuagagaaaaacgugacaguaacucauuccgugaaucugcuagaagacucucacaacgggaagcucugcaggcugaaaggaauagcaccccuucagcuggguaaguguaauaucgccggcuggauuuuggggaacccugagugcgaaucacuccugagugagcggagcugguccuauaucgucgaaaccccaaauucugagaacggaacauguuacccgggcgauuucauugacuaugaggaacugcgcgagcaacucucgucagugagcaguuuugaacgauucgagaucuuuuccaaagagucuagcuggcccaagcauaccacuggugggguuacagccgcuugcucccacgcaggaaagucaaguuucuaccguaauuuacuguggcuuaccgaaaaagauggcagcuauccuaacuugaauaacucuuacgugaauaagaaaggcaaggagguccuggugcuauggggaguacaucacccauccaacauaaaagaccagcagacgcucuaucagaaggaaaaugccuacguuucaguggucagcaguaacuacaacagaagguuuacucccgagaucgcugaacggccuaaggugcgcgggcaagccgguagaauuaauuauuacuggacccugcuuaaaccaggcgauacaaucauguucgaggcgaacgggaaucugauugcacccugguaugccuuugcuuugucuaggggauucggcuccgguaucauaacuagcaacgccucgaugcacgagugugacaccaagugccagacaccucagggggcaauuaauucuucccucccauuucagaacauccauccggugaccauuggagaaugucccaaauacguccggucaacgaagcugcgcaugguuacuggcuuacgaaauaucccuaguauccaaagcagaggccuguucggggcuauugccggauuuauagaggguggcuggacagggaugaucgauggaugguauggcuaccaccaucagaacgaacaggguuccggguaugcggccgaccagaaaucuacccaaaaugcaauuaacggcaucacuaauaaggugaacagcguaauagagaaaaugaauacacaguucaccgcugugggaaaggaauuuaacaaucucgagaagaggauggagaaccuuaacaaaaaggucgaugacggcuuccuggacauuuggacguacaaugccgaauugcuagugcugcucgagaacgaacggacccuggauuuccacgacucaaauguuaaaaaccuuuacgagaaggugaaaaaucagcugcguaacaaugcuaaggaaaucgggaacggaugcuuugaguucuaucacaaguguaauaacgagugcauggaaagugucaaaaaugguacauacgauuauccaaaguacuccgaggaaagcaaauugaaccgcgagaagaucgacggcgugaaacucgagucuauggggguauaucaaauucuggccaucuacucaacugcagccaguagcuuaguucugcuagugucccucggagcuauuucuuuuuggaugugcucgaauggcagccugcaguguagaauaugcaucuga

SEQ ID NO: 123632 - RNA, 1701 nt, Artificial Sequence
  derived and/or modified sequence opt3 from hemagglutinin__InfluenzaA__ABO38384
augaaggccagacugcucgugcuucugugcgcuuuggcagccgcggacgcugauaccaucuguauuggcuaccacgccaacaauagcacagacacugucgauacgguuuuagagaaaaacgugaccguaacacauuccgugaaucugcuagaagacucucacaacgggaagcucugcaggcugaaaggaauacccccucuucagcuggguaaguguaauaucgcaggcugguugcucgggaacccagagugcgauucacugcugccggcccggaguuggagcuauauugucgaaacucccaauuccgagaacggagcuuguuacccuggcgacuucaucaauuaugaggaacuccgcgagcaauuaucuucggugagcagcuuugaacgauucgagauuuuuccaaaagaaaguuccuggcccaagcauaacaccacaaaggguguuaccgcagccugcucucacgcugggaaaagcuccuucuaccguaaucugcuuugguugacuaagaaagaggauucauauccuaagcugaaaaacaguuacgugaauaagaagggaaaagagguccuagugcucuggggcguacaucacccaucaucuuccaaggaacagcagacacuguaucagaacgagaaugccuacguuucaguggucagcaguaacuacaacagaagguuuacccccgaaaucgcggagcggccuaaagugcgcgaccaaacgggcagaaugaauuauuacuggacucuucuggaaccaggggauaccauaaucuucgaggcaaacggaaauuugauugccccgugguaugcuuuugcccucucuagggguuucggcuccgggaucauuacaagcaacgcaucgaugcacgaguguaauacuaagugccagacaccccagggagcuaucaacucuucccugccuuuucagaauauacauccagugaccauuggcgaaugucccaaauacguccggucagccaaguuacgcaugguuaccggucugcgaaacaucccuaguauucaaagcagaggacucuucggggcgaucgccggcuuuaucgagggcggguggacgggaaugauugacgguugguauggcuaccaccaucagaaugaacagggguccggauaugcagcugaucagaaaucuacucaaaacgccauaaauggcaucacaaacaaggugaauagcguaauugagaagaugaacacccaguucacugcuguggguaaagaauuuaauaaccuugagaagaggauggagaaccugaauaaaaaggucgacgauggguucuuggacaucuggacauacaacgccgaacuacuggugcuccuggagaaugaacggacccuugacuuccacgauucaaacguuaaaaaucuguacgagaaggugaagagucaguugaaaaacaaugcaaaggaaauaggcaacggaugcuuugaguucuaucacaaaugugacaaugagugcauggaauccguccguaacggcacguacgauuauccaaaguacagcgaggaaucuaaacucaaucgcgagaagauugacggggugaagcuggagucaaugggaguauaucaaaucuuagccaucuacaguaccguugcuagcucccuggugcuacucgucucucugggugcgauuucguuuuggaugugcagcaacggcucccuucaguguagaaucugcauuuga

SEQ ID NO: 123633 - RNA, 1701 nt, Artificial Sequence
  derived and/or modified sequence opt3 from hemagglutinin__InfluenzaA__ABO38395
augaaggccaagcugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucaaucgccggcuggauucuggggaacccugagugcgaaaguuuguuuagcaaaaaguccuggucuuauaucgcagagacaccaaauucggaaaacggaaccuguuacccgggcuauuucgccgauuacgaggagcucagggaacaacugucaagcgucaguuccuuugagcgguucgaaauuuuucccaaggagucuagcuggccuaaucauacugugacaaaagguguuaccgcuuccugcucacacaaggggcgcaguagcuucuaucgaaaccugcucugguuaacgaaaaagaauggaucuuacccaaaccuguccaaaucauaugugaauaacaaggagaaggaaguccuuguguuguggggcguacaucaccccagcaauaucggcgaccagcgugcaauauaccacacugagaacgccuacguuaguguggucucuucccauuauaacagaagguuuaccccugaaaucgcuaaacggccaaaggugcgcgaucaggaggggagaauuaauuacuauuggacacugcuagaacccggagacacuaucauuuucgaggccaacgguaaucucaucgcgccuugguacgcauuugcccugagcaggggcuucgggucgggaauaauuaccucuaacgcuuccauggaugagugugacgccaaaugccagacaccacaaggcgcaaucaauucaagucuuccguuucagaacgugcaccccgucaccauuggugaauguccuaaguauguucggagcacgaaacugcgcauggugacuggguugcgaaauaucccauccauccagucuagaggacucuucggcgcuauugccggcuuuauagaagggggauggacagguaugaucgauggcugguacggguaucaucaccagaacgaacaaggaagcggcuacgcggccgaccagaagucaacccagaaugcaauuaacgguaucacuaauaaaguaaacagugugauagagaagaugaauacacaguucaccgcugucgggaaggaguucaacaaacuggagaggcggauggagaauuuaaacaagaaaguggaugacggcuuucuggacauuuggacguacaacgccgaacuccuuguucuguuggagaaugaacguacccuagauuuccacgacuccaacgugaagaaucuguaugagaaagucaagagccaacucaagaacaaugcuaaagaaaucggaaacggcugcuuugaguucuaccauaaguguaauaacgagugcauggaaucugugaaaaaugggacauaugauuaccccaaguauucagaggaaaguaaacugaaccgcgagaagaucgacggaguaaaacuugagagcauggguguuuaccagauucuggccaucuauuccacuguggcaucuucguugguccuccuggugagcuuaggcgccauuuccuuuuggaugugcucaaaugggagucugcaguguagaauaugcaucuga

SEQ ID NO: 123634 - RNA, 1701 nt, Artificial Sequence
  derived and/or modified sequence opt3 from hemagglutinin__InfluenzaA__ABO38406
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacaaccacaaugggaaacucugcaagcugaaaggaauagcuccccuucagcuggguaaguguucaaucgccggcuggauuuuggggaacccugagugcgaaagucucuucagcaagaaauccuggucuuauaucgcagagaccccaaauucggaaaacggaacauguuacccgggcuauuuugccgauuacgaggagcugagagaacaacugucaagcgucaguuccuucgagagguuugaaauuuuccccaaggagucuagcuggccuaaucauaacgugaccaaagguguuacugcuuccugcucacacaaggggaaaaguagcuuuuaucggaaucucuuauggcugacagagaagaagggaucuuacccaaaccuuuccaaaucauaugugaauaacaaggaaaaagaggucuuggugcuguggggcauccaucaccccagcaauauagaagaccagaagaccaucuaccgcaaagagaacgcauacguaaguguugugucuucccacuauaaccgacguuucacgccugaaauugccaagagaccaaaagucagggaucaggagggccggaucaauuacuauuggacucuacucgagcccggggacaccauuaucuuugaagcuaacggaaaucugauagccccuugguacgcguucgcacuuagccgcgguuuuggcucggggauuaucacaucuaacgccuccauggaugagugugacgcuaagugccagacuccaagaggagccauuaauucaagucugccguuccaaaacgugcaucccgugaccaucggcgaauguccuaaguaugucaggagcacaaaauugcggaugguuaccggucuccgcaauaucccauccauucagucucgagggcuguuuggagcaauagcuggcuucaucgagggcggguggacgggaaugauugaugguugguacggcuaucaccaucagaacgaacaggggagcggauacgccgcggaccaaaagucaacucagagugccaucaauggcauaacaaacaaaguaaauuccauuaucgagaagaugaacacccaguuuacugcaguggguaaagaguucaauaaguuagaaaagagaauggagaaccugaauaaaaagguggaugacggguuccucgacaucuggacauacaacgcugaacuucuggucuugcuagagaacgaaaggacccuggauuuucacgacagcaaugugaaaaaccucuaugagaagguuaaaucucagcugaagaauaacgccaaggagauuggcaauggaugcuucgaauuuuaccacaaauguaacaaugagugcauggaaucagugaagaacggcacguaugauuaccccaaauauagugaggagagcaaacuuaaucgggaaaagaucgacggggucaagcuggaguccaugggaguguaccaaauuuuggcuauauauucuaccguagccucgagccucguucuguuagugucccugggugcaaucucauucuggaugugcaguaacggcucucuacagugucguauuugcaucuga

SEQ ID NO: 123635 - RNA, 1701 nt, Artificial Sequence
  derived and/or modified sequence opt3 from hemagglutinin__InfluenzaA__ABO38417
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaccaacaggaagaaucugcgacaguccgcaucagauucucgauggugagaauuguacccugaucgacgcucuacugggcgauccccacugcgacggguuucagaacaaagaaugggauuuguucgucgagaggagcacugccuauuccaauuguuacccuuaugacgugccagauuacgcaucucuccggucgcugguugccucaagcggaacacuggaauuuaacaaugagaguuucaacuggaccggcguggcucagaaugguacguccucugcaugcaagcgccgaagcauaaaauccuuuuucucacgucucaacugguuacaucaacugaaguauaaguaccccgcccuuaaugucacuaugccuaacaaugagaaauuugacaaguuguauaucuggggagugcaccacccaaguaccgauagcgaccagauuucucuguacgcucaggccuccgggagaguaacaguuucaacuaaaaggagccagcaaaccgugauccccaacauuggcagucggccuuggguccgcggcgugucuuccagaaucagcauauacuggacaauugugaagccaggggauauccuacucauuaacucgaccggaaaucugaucgcgccgagggguuauuucaaaauccggucuggcaaguccucaauuaugcgcaguaacacgcccauagggaaguguaauagcgaaugcaucacuccuaacggauccauuccaaaugacaaacccuuucagaacgucaaucgaaucacauacggcgcauguccuagauauguuaagcagaacacccuuaaacuggccacugguaugaggaaugugccagagaagcagacacgggggauauucggagcuauugccggcuuuaucgaaaacggcugggaggggaugguagacggaugguacgguuuccgucaucaaaauucugagggcaccgggcaggcagcugauuugaaaagcacgcaggccgcgaucaaccaaauuaauggaaagcucaaccgccugaucgagaaaaccaaugaaaaguuucaccagauugaaaaggaguucucagaaguggagggcagaauacaggacuuagagaaauaugucgaagauacaaagaucgaccuguggaguuacaacgccgagcuccuuguggcacuggaaaaccagcauacuauugauuugaccgacuccgagaugaauaaacuauucgaaaggacacggaagcaacugcgagagaacgcugaggauauggguaaugggugcuuuaaaaucuaucacaagugugacaacgccugcaucggcagcauucgcaauggaacuuacgaucacgacguuuacagagaugaagcucucaacaauagguuccagauaaagggcguggagcugaaaucuggguauaaggacuggauccuuuggauuucauuugccaucaguugcuuccuguugugugucgugcuccugggauuuauuaugugggcaugccagaaagguaacauccgguguaauauaugcaucuga

SEQ ID NO: 123636 - RNA, 1689 nt, Artificial Sequence
  derived and/or modified sequence opt3 from hemagglutinin__InfluenzaA__ABO38712
auggccaucauuuacuucauacugcucuuuaccgcugugagaggcgaccagaucugcauuggguaucacgcaaacaauagcacagagaaggucgauacuauccuugaaaggaacguuacggugacccaugccaaagacauucuggagaagacacacaauggaaaauuguguaaguuaaacgguauacccccucuggaacuaggcgauugcuccaucgcgggguggcuccugggaaauccagagugugaccggcuucugcgcguaccggaauggucuuacaucauggagaaagagaacccccgauauucauugugcuacccuggcaguuucaaugauuaugaggaacucaagcaucugcugagcuccgugaagcacuuugaaaaaguccguauucucccaaaggacgguuggacucaacauaccacaucugggggaucgaaggcuugugccgugucaggcaaaagcaguuucuuuagaaacaugguuugguuaaccaaaaagggccccaauuacccuguggcaaagagguccuauaacaauacuucuggggagcagaugcugaucauuuggggaguccaccacccaaaagaugaggccgaacagcgggcucuuuaccagaagguggguacauacguaagcgcauccaccucaacguugaacaaacgcaguacucccgagaucgccgcuagaccugaaguuaauggccuggggagcaggauggaguucucuuggacccuacucgacgugugggauacaauaaacuuugaauccacuggaaaucuggucgccccagaguauggcuucaagauuucaaaacgggguagcagugggaucaugaagaccgagggaacacuuggcaacugcgaaaccaaaugucaaacgccgcugggcgcgauuaacacuacauugcccuuucauaaugugcacccucucaccaucggggagugcccaaaguacgugaagucugaaaaacuggucuuagcaacuggacugcgcaacguuccccagaucgagucccgaggucucuucggcgccauugcuggguuuauagaaggaggcuggcaggguaugguggacgggugguauggcuaccaucacagcaaugaucagggaucgggcuaugccgcagacaaggagucuacacaaaaggcuuucgauagaaucaccaacaaaguaaauuccgugauugagaaaaugaacacgcaguuugaagccgucgggaaggaguucucaaaucuugaaaagaggcuggagaacuugaauaaaaagauggaagacggauuccuagacguguggaccuacaacgcggagcugcucguucugauggagaaugaacggacacuugauuuucacgacaguaacgugaaaaaucuguauaacaagguccguaugcaguugcgcgauaaugugaaagagcucgguaacggcuguuucgaauuuuaccauaagugcgacgaugaguguaugagcuccguaaagaacgggacuuacgacuauccuaaauacgaggaagagucuaagcugaaaagaaaugaaaucaagggaguuaaauuaagcucaaugggcguguaucagauacuggccauuuacgcaaccgucgcugguagucuaucccucgccaucaugaucgcugggauuagccuguggaugugcucuaacggcucacuucaaugcaggaucuguauuuga

SEQ ID NO: 123637 - RNA, 1689 nt, Artificial Sequence
  derived and/or modified sequence opt3 from hemagglutinin__InfluenzaA__ABO38723
auggccaucauuuacuucauacugcucuuuaccgcugugagaggcgaccagaucugcauuggguaucacgcaaacaauagcacagagaaggucgauacuauccuugaaaggaacguuacggugacccaugccaaagacauucuggagaagacacacaauggaaaauuguguaaguuaaacgguauacccccucuggaacuaggcgauugcuccaucgcgggguggcuccugggaaauccagagugugaccggcuucugcgcguaccggaauggucuuacaucauggagaaagagaacccccgauauucauugugcuacccuggcaguuucaaugauuaugaggaacucaagcaucugcugagcuccgugaagcacuuugaaaaaguccguauucucccaaaggacgguuggacucaacauaccacaucugggggaucgaaggcuugugccgugucaggcaaaagcaguuucuuuagaaacaugguuugguuaaccaaaaagggccccaauuacccuguggcaaagagguccuauaacaauacuucuggggagcagaugcugaucauuuggggaguccaccacccaaacgaugaggccgaacagcgggcucuuuaccagaaaguggguacauacguaagcgcauccaccucaacguugaauaagcgcaguacucccgagaucgccgcuagaccugaaguuaacggccuggggagcaggauggaguucucuuggacccuacucgacgugugggauacaauaaauuuugaauccacuggaaaccuggucgccccagaguauggcuucaaaauuucaaagcgggguagcagugggaucaugaaaaccgagggaacacuuggcaacugcgaaaccaagugucaaacgccgcugggcgcgauuaauacuacauugcccuuucauaacgugcacccucucaccaucggggagugcccaaaauacgugaagucugaaaagcuggucuuagcaacuggacugcgcaauguuccccagaucgagucccgaggucucuucggcgccauugcuggguuuauagaaggaggcuggcaggguaugguggacgggugguauggcuaccaucacagcaacgaucagggaucgggcuaugccgcagacaaagagucuacacaaaaggcuuucgauagaaucaccaauaaaguaaacuccgugauugagaagaugaauacgcaguuugaagccgucgggaaagaguucucaaaccuugaaaagaggcugggaaauuugaacaagaaaauggaggacgguuuccuagacguguggaccuacaaugcggaacugcucguucugauggagaacgagcggacacuugauuuucacgacaguaaugugaagaaccuguauaauaaaguccguaugcaguugcgcgauaacgugaaggaacucggcaacggguguuucgaguuuuaccauaaaugcgacgaugaauguaugagcuccguaaagaauggaacuuacgacuauccuaaguacgaggaggaaucuaaacugaagagaaacgagaucaaaggcguuaaguuaagcucaauggguguguaucagauacuggccauuuacgcaaccgucgcugggagucuaucccucgccaucaugaucgcuggcauuagccuguggaugugcucuaauggaucacuucaaugcaggaucuguauuuga

SEQ ID NO: 123638 - RNA, 1698 nt, Artificial Sequence
  derived and/or modified sequence opt3 from hemagglutinin__InfluenzaA__ABO44046
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuaugccuucgcgcucucuagaggguuuggauccggcaucauaaccagcaacgcacccauggacgaaugugaugccaagugccagacaccucaaggugcuauuaauucgucucugccauuccagaacguucaccccgugaccaucggggaguguccuaaauacguaagguccgccaaguuacggauggugacgggacugcgcaauauuccaucaauccagagucgaggccucuuuggcgcaaucgcuggguucauugaaggagguuggacuggcauggucgacgggugguauggauaccaucaccagaacgagcaaggcagcgguuacgccgcggaucagaaauccacacagaaugccauaaacgggaucaccaauaagaugaacucugugauugaaaagaugaauacucaguuuacagcaguuggcaaagaguucaacaaacuugagagaaggauggaaaaucugaacaagaagguggacgauggauucuuggacaucuggaccuauaacgcugagcuacugguccuccuggaaaaugagcggacgcuugacuuucacgauagcaacgugaaaaaucuguacgaaaagguaaaaucacaauugaagaacaaugccaaagagauaggcaacgggugcuucgaguuuuaucauaaguguaauaacgaaugcauggagaguguuaagaauggaaccuacgacuaucccaaauacuccgaagagagcaagcucaaccgugagaaaauugauggugugaagcuggaaucuaugggcgucuaucagaucuuagcuaucuacucaacaguggccaguagccugguccuacucgugucccugggggcaauuucuuucuggaugugcucgaauggaagccuucagugucgcaucugcauuuga

SEQ ID NO: 123639 - RNA, 1689 nt, Artificial Sequence
  derived and/or modified sequence opt3 from hemagglutinin__InfluenzaA__ABO44057
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcaguuuuaaugauuaugaggagcugaagcaucugcucagcuccgugaagcacuucgaaaaagucaagauuuuaccaaaagacgguuggacucaacaugagaccgaugggggaucuaaggcuugugccgugucgggcaaagcaucauuuuuccguaacaugguuuggcugacaaagagaggccccaauuaccagguggccaagaggagcuauaacaauaccaguggggagcagaugcuuaucauuuggggaguccaccacccuaaagacgaagcugagcagcgggcauuguaccaaaagguggguacuuacguauccgccucuacaagcacccugaacaaacgcuccacgccagaaaucgcugccagacccgagguuaauggccuagaaucaaggauggaguuuaguuggacucuccuggaugugugggacaccauaaacuucgagagcacagggaaucuugucgcgccugaauauggauuuaagauuucuaaacggggcuccucagguaucaugaagacugaggggacccugggaaacugcgaaacaaaaugucagaccccauugggcgcaauuaacacgacucucccguuccauaaugugcacccccugacaaucggcgagugcccuaaguacgucaagagcgaaaaauuagugcuggccaccgggcuccgcaacguuccacagaucgagagucgaggacuuuuuggugcuauugccggcuucauagaagggggauggcagggcaugguggaugguugguauggguaccaucacucuaaugaccaaggcuccggauaugcagcugauaaggaaagcacucagaaagccuuugacagaaucacaaacaagguaaauucggugauugagaaaaugaacauccaguucgaagcggucggcaaggaguuuucuaaucuggaaaagagguuggagaaccuaaauaaaaagauggaggacggguuccuggauguguggaccuacaacgccgaacuccugguucuuauggagaaugaacggacgcuggacuuccacgauuccaacgugaaaaauuuguaugacaagguccguaugcagcuccgcgauaacgugaaagagcugggaaaugguuguuuugaguucuaccauaagugcgacgaugaauguaugaacucaguaaagaacggcaccuacgacuaucccaaauacgaggaagagaguaaguuaaaaagaaaugaaauaaaggggguuaaacugagcuccaugggaguguaucaaauucuagcaaucuacgcuacagucgccggcucucucagccuggcuaucaugauugccgguaucucauuuuggaugugcaguaacgggucccuucagugcaggguguguauuuga

SEQ ID NO: 123640 - RNA, 1701 nt, Artificial Sequence; identical to SEQ ID NO: 122272
  derived and/or modified sequence opt3 from hemagglutinin__InfluenzaA__ABO44079

SEQ ID NO: 123641 - RNA, 1689 nt, Artificial Sequence
  derived and/or modified sequence opt3 from hemagglutinin__InfluenzaA__ABO44090
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgagauggccucugcuauccugguucauuuaaugacuacgaggaacugaagcaucugcucaguagcgugaagcacuucgaaaaagucaagauuuuaccaaaagaucguuggacucaacauaccacaaccgggggauccagagcuugugccgugucuggcaaccccucguuuuucaggaauaugaucuggcugacuaagaaaggcucaaacuauccuguugcaaaggggagcuacaauaacacaaguggagagcagaugcuuauuaucuggggugugcaccacccaaaugacgagaccgaacagcggacguuguaucagaacgucggcacuuacguguccguaguuaccucuacacugaauaagcgcagcacucccaaaauagccaccagaccuaaggugaacgggcuaggaggcaggauggaguuuuccuggacacuccuggauaugugggacaccauuaacuucgaaucaacggguaaucuuaucgcuccagaguacggguuuaaaauuaguaagcggggaagcucuggcaucaugaaaacugaaggcacacuggagaacugcgagaccaagugucaaacuccguugggggcaaucaauacaacccuccccuuccauaacguccacccucugacgauuggagaaugcccaaaauaugugaaguccgagaaguuagugcuggccaccggucuccgcaaugucccccagauagaaucacgaggccuuuuuggggcuaucgccggauucauugagggcgguuggcaggggaugguugauggcugguacggauaucaucacagcaacgaccagggcaguggguacgcggcagauaaagaaucuacacaaagagccuuugacggaaucacuaauaaggugaacuccguaauagagaaaaugaauacccaguucgaggcuguggguaaggaauuuagcaaccuggagaggcgguuggaaaaucuaaacaaaaagauggaggacggccugcucgaugucuggacauauaaugccgaacugcuugugcugauggagaacgagcguauuuuggacuuccacgauucgaauguuaagaaccucuacgacaaagugcgcaugcagcugagagauaacgucaaggaauuagggaauggauguuucgaguuuuaucauaaaugcgacgaugaauguaugaacucugugaagaauggcacuuacgacuacccuaaauaugaggaggaauccaagcugaacaggaaugagaucaaggguguaaaacuaucaaguauggggguuuaccagauccucgcaauuuaugcuaccguggccggcagccugucccuugcgaucaugauggccggaauuucuuucuggaugugcagcaacggcucauugcaaugccggauauguaucuga

SEQ ID NO: 123642 - RNA, 1689 nt, Artificial Sequence
  derived and/or modified sequence opt3 from hemagglutinin__InfluenzaA__ABO44101
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcaguuuuaaugauuaugaagaacugaagcaucugcucagcuccgugaagcacuucgaaaaagucaagauuuuaccaaaagacgguuggacucaacauaagaccgaugggggaucuaaggcuugugccgugucgggcaaacccucauuuuuccguaacaugguuuggcugacaaagaaaggcccuaauuacccaguggcaaagagaagcuauaacaauaccaguggggagcagaugcuuaucauuuggggaguccaccaccccaacgacgaggccgaacagagggcuuuguaccagaaaguggguacuuacguauccgcaucuacaagcacccugaauaagcgguccacgccugagaucgccgcucgcccagaaguuucaggccuagggaguagaauggaguuuagcuggacucuccuggaugugugggacaccauaucuuucgaauccacaggaaaccuugucgccccggaguauggcuuuaaaauuucaaagagggguagcagugggaucaugaaaacugagggaacccugggcaauugcgaaacaaagugucaaacccccuugggcgcgauuaacacgacucucccuuuccauaacgugcacccacugacaaucggggagugccccaaguacgugaaaucugaaaaguuaguccuggcaaccggacuccggaauguuccucagaucgagucccgcggucuuuuuggcgccauugcuggguucauagaaggaggcuggcaggguaugguggaugggugguauggcuaccaucacagcaacgaccagggaucgggcuaugccgcagauaaagagucuacucaaaaggcuuuugaccgaaucacaaauaaaguaaacuccgugauugagaagaugaauacccaguucgaagccgucgggaaggaguuuucaaaccuggagaaaagauuggagaaucuaaacaagaaaauggaagacggauuccuggauguguggacguacaaugcggagcuccugguucuuauggagaacgaaaggacccuggacuuccacgauaguaaugugaagaacuuguaugacaaaguccggaugcagcuccgugauaaugugaaggagcuggguaacggcuguuuugaguucuaccauaagugcgacgaugaauguaugaauagcguuaaaaacgggacauacgacuauccaaaguacgaggaagaguccaaauuaaagcgcaacgaaaucaaaggaguaaagcugucuagcaugggcguguaucagauacuagccauuuacgcaacugucgcugguucacucagucuggccaucaugaucgcugggauuuccuuuuggaugugcagcaauggcucucuucaaugcagaaucuguauuuga

SEQ ID NO: 123643 - RNA, 1701 nt, Artificial Sequence
  derived and/or modified sequence opt3 from hemagglutinin__InfluenzaA__ABO44123
augaaggccaaacugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucaaucgccggcuggauucuggggaacccugagugcgaaaguuuguuuagcaaaaaguccuggucuuauaucgcagagacaccaaauucggaaaacggaaccuguuacccgggcuauuucgccgauuacgaggagcucagggaacaacugucaagcgucaguuccuuugagcgguucgaaauuuuucccaaggagucuagcuggccuaaucauacugugacaaaagguguuaccgcuuccugcucacacaaggggaaaaguagcuucuaucgcaaccugcucugguuaacgaagaaaaauggaucuuacccaaaccuguccaagucauaugugaauaacaaggagaaagaaguccuuguguuguggggcguacaucaccccagcaauaucggcgaccagcgagcaauauaccacacugagaacgccuacguuaguguggucucuucccauuauaaccguagauuuaccccugaaaucgcuaagaggccaaaagugcgggaucaggaggggcgcauuaauuacuauuggacacugcuagaacccggagacacuaucauuuucgaggccaacgguaaucucaucgcgccuugguacgcauuugcccugagcagaggcuucgggucgggaauaauuaccucuaacgcuuccauggaugagugugacgccaagugccagacaccacaaggcgcaaucaauucaagucuuccguuucagaacgugcaccccgucaccauuggugaauguccuaaauauguuaggagcacgaagcugcggauggugacuggguugcgcaauaucccauccauccagucucgaggacucuucggcgcuauugccggcuuuauagaagggggauggacagguaugaucgauggcugguacggguaucaucaccagaacgaacaaggaagcggcuacgcggccgaccagaaaucaacccagaaugcaauuaacgguaucacuaauaagguaaacagugugauagagaagaugaauacacaguucaccgcugucgggaaagaguucaacaagcuggagagaaggauggagaauuuaaacaaaaagguggaugacggcuuucuggacauuuggacguacaacgccgaacuccuuguucuguuggagaaugaacggacccuagauuuccacgacuccaacgugaaaaaucuguaugagaaggucaagagccaacucaaaaacaaugcuaaggaaaucggaaacggcugcuuugaguucuaccauaaauguaauaacgagugcauggaaucugugaagaaugggacauaugauuaccccaaauauucagaggaaaguaagcugaaccgugagaagaucgacggaguaaaacuugagagcauggguguuuaccagauucuggccaucuauuccacuguggcaucuucguugguccuccuggugagcuuaggcgccauuuccuuuuggaugugcucaaaugggagucugcagugucgcauaugcaucuga

SEQ ID NO: 123644 - RNA, 1701 nt, Artificial Sequence
  derived and/or modified sequence opt3 from hemagglutinin__InfluenzaA__ABO44134
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcauaacgugacccgagguguuacugcuuccugcucacacaaagggaagaguagcuuuuaucguaaucucuuauggcugacagagaaaaacggaucuuacccaaaucuuuccaagucauaugugaacaauaaggaaaaagaggucuuggugcuguggggcguacaucaccccagcaacaucgaagaccagaagaccauauacagaaaagagaaugcauacguuaguguggucucuuccaacuauaacaggcgguucacgccugaaaucgccgagcgcccaaaggugagaggccaggcugggaggauuaauuacuauuggacucuacucgagcccggagauaccaucauuuuugaagccaacgguaaucugaucgcgccuuggcacgcauucgcccuuagccggggcuuugggucgggaauaauuacaucuaacgcuuccauggacgagugugauacuaaaugccagaccccacaaggcgccaucaauucaagucugccguuccagaacauucaucccgugacaaucggugaauguccuaaguacguccgcagcaccaaauugcgaaugguuacggggcucagaaauaucccauccauucagucuaggggacuguuuggcgcaauagcuggcuucaucgaagggggauggacugguaugauugacggcugguauggguaccaccaucagaacgagcaaggaagcggcuaugccgcggaucagaagucaacacagaaugccaucaacgguauaaccaauaaggugaacaguguaauugagaaaaugaauacucaguuuacagcaguggggaaggaguucaacaaauuagaaaagcggauggagaaucugaacaaaaaggucgacgauggcuuccucgacaucuggaccuacaacgcugaacuucugguguugcuagagaaugaacguacgcuggacuuucacgauuccaacguuaagaaucucuacgagaaagucaagagccaacugaaaaacaaugccaaggagaucggaaacggcugcuucgaauuuuaucacaaauguaauaacgagugcauggaaucugugaagaaugggaccuacgacuaucccaaguacucagaggagaguaaacuuaaccgcgaaaagauugauggagugaaacuggagagcauggguguauaucagaucuuggcuauuuacuccacaguugccucuucgcucgugcuguuagucagccugggcgcaauauccuucuggaugugcucaaaugggagucuacaguguagaaucugcauuuga

SEQ ID NO: 123645 - RNA, 1701 nt, Artificial Sequence
  derived and/or modified sequence opt3 from hemagglutinin__InfluenzaA__ABO52071
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacagguggcauuugcgacaguccacaccagauccuagauggggagaacuguacccucauagacgcucugcuuggagauccgcagugcgacggcuuucagaauaaaaagugggaucuguucguggaaagaagcaaagccuauuccaacuguuaccccuaugacgucccugauuacgcaucuuugaggucgcucguggccucaagcgguacucuggaguuuaauaacgaaaguuucaauuggacagggguuacccagaacggaacguccucugcuugcaagcggcgcagcaauaacuccuuuuucucacgacugaauuggcucacucauuuaaaguuuaaauauccagcacugaacgugaccaugcccaacaaugagaaguucgacaaacuuuacaucuggggcguccaccauccuaguacagauaacgaccagauuagcuuguaugcccaggcuucuggccguaucacuguguccaccaagagaucacaacagacaguaauuccaaauaucgggagcaggccccggguucgcgauauaccuaguagaauuucuaucuacuggaccauugugaaaccaggagacauccugcuaaucaacuccacggguaaucucauugccccgaggggcuacuuuaagauacggagcgggaagucgucuaucaugcgcuccgacgcgcccauuggaaaauguaacucagagugcaucacuccuaauggcaguauaccaaacgauaagcccuuccagaaugucaaccgaauuacauauggugcauguccuagauacgugaaacagaauacccugaaacuugccacugggaugaggaacgugccagaaaagcaaacacggggaaucuuuggcgcuaucgccggcuucauugagaaugggugggaaggaauggucgacgguugguauggcuuucgucaccagaacagcgaggggaucggacaggcagcugaucugaaguccacccaagccgcgauuaaucagauaaacggcaaauugaaccgccucaucgguaagacgaaugagaaguuccaccagauugaaaaagaguucucugaaguugaggggagaauccaggaccuggaaaaguacguggaggauaccaaaaucgacuuauggagcuauaacgccgagcugcucguagcacuugaaaaucaacauacaauugaucugacugacucagagaugaacaaguuguuugaaaggaccaaaaagcagcuacgggagaaugcugaagauaugggcaacggaugcuucaagauauaccacaaaugugacaaugccugcaucggcaguauucgaaacgggacauaugaucaugacguguaccgcgacgaggcucugaauaacagauuucagaucaagggagucgagcucaaauccgguuacaaggauuggauucuguggaucagcuucgccauaucuugcuuucuucuguguguggcauugcucggcuucaucaugugggccugccagaaagggaauauuagguguaacaucugcauuuga

SEQ ID NO: 123646 - RNA, 1701 nt, Artificial Sequence
  derived and/or modified sequence opt3 from hemagglutinin__InfluenzaA__ABO52225
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucaaggagcaacugucgucagugagcaguuuugaaagguucgagauuuuuccuaaggaguccucuuggccaaaucauacaguuaccaaaggugugacggcuagcugcucccacaacgggaagucaaguuucuacaaaaaucugcucugguuaacugaaaagaacggacuguaucccaaucuuagcaaaucuuacgucaacaauaaggagaaggaaguguugguacuguggggcguucaucacccuuccaacaucggcgaucagcgggcaauuuaccacaccgagaacgccuaugugucagucgugagcagucauuacucucgccgauuuacaccagaaaucgcuaaacgucccaaggugagagaccaggaggggaggauaaauuauuacuggacucuacucgagccuggagauaccaucauuuucgaagccaacgguaaucugaucgcgccaugguaugcauuugcccuuucccggggcuucgggagcggaauuaucacaucgaacgcuucuaugggcgagugugacgccaaaugccagaccccgcaaggugcaauaaauuccucacugcccuuucagaacguccacccuguuacgauuggggaauguccaaaguacgugcgcaguacuaaauugagaaugguaacaggacucaggaauauccccagcauucagucccggggccuguucggcgcuaucgccggguuuaucgagggagguuggaccggcaugauugaugggugguauggauaccaucaccagaacgaacaaggcucugguuacgcggccgacaagaaaagcacucagaaugcaauagaugggaucacaaacaaggucaauucagugauugagaagaugaacacccaguucacggcugugggcaaagaguucaauaaguuagaacgccgaauggagaaccugaauaaaaagguugacgauggauuucucgacaucuggaccuauaacgccgaacuucugguguugcuagagaacgaaagaacacuggacuuccacgauaguaaugucaaaaaccucuacgagaaggugaagaaucagcugaaaaacaaugcuaaggagauaggcaacgggugcuuugaguucuaucauaaauguaaugacgaaugcauggaauccguaaagaacggaacuuacgauuauccuaaauacagcgaggagucuaaacuuaagagggaaaagauugacgguguuaagcuggagucaaugggcguguaucaaaucuuggccaucuacaguaccgucgcaagcucccucgugcuguuagucucucugggggccauuucguuuuggaugugcagcaauggaucccuacagugucggaucugcauuuga

SEQ ID NO: 123647 - RNA, 1689 nt, Artificial Sequence
  derived and/or modified sequence opt3 from hemagglutinin__InfluenzaA__ABO52236
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcauuuccugagcuccgugaagcacuuugaaaaagucaagauucucccaaaagaucgauggacucaacauaccacaaccgggggaucucgugcuugugccgugucgggcaaccccucauucuuuagaaauaugguuugguuaacuaagaaaggcagcaacuauccuguggcaaaggggaguuacaauaacacauccggagagcagaugcugaucauuugggguguccaccacccaaaugacgagaccgaacagaggacgcuuuaucagaacgugggcacuuacguaucuguugggaccagcacauugaauaagcgguccacucccgauaucgccacccgcccuaaagugaacggacugggcgguagaauggaguucucauggacacuacucgacaugugggauaccauaaacuuugaaaguacggggaaucugauugcuccagaguacggauucaagaucagcaaaagggggucuuccggcauuaugaagacugaaggcacacuuggaaacugcgagaccaaaugucaaacuccgcugggugcaaucaauacaaccuugcccuuucauaacguccacccucucacgaucggcgagugcccaaaguaugugaaaucagaaaagcugguguuagccaccgggcugcggaaugucccccagauugagagccgcggacucuucggcgcuauagccgguuuuaucgaagggggcuggcagggaaugguugacggcugguacggguaucaucacaguaacgaucagggaucugguuacgcggcagacaaggaguccacacaaaaagccuucgacggcauuacuaauaaggugaacagcguaaucgagaaaaugaauacccaguuugaggcuguggggaaggaguucucgaaccuugaacgaagacuggagaauuugaacaaaaagauggaagauggauuccuagacgucuggacauauaaugccgagcugcucgugcugauggaaaacgagaggacucuugauuuucacgacucuaauguuaagaaccuguacgauaaagugcggaugcaguugcgugacaacgcaaaggagcucggcaaugguuguuucgaauuuuaucauaaaugcgaugacgaguguaugaacuccgucaagaaugggaccuacuacuauccuaaauacgaagaggagucaaagcugaaccgcaaugaaauaaagggcgugaaauuaaguagcaugggaguauaucagauucuggcuaucuacgccacaguugcgggcucccuaucucucgccaucaugauggcagggauuagcuucuggaugugcucaaacggaagucugcaaugcagaaucuguauuuga

SEQ ID NO: 123648 - RNA, 1689 nt, Artificial Sequence
  derived and/or modified sequence opt3 from hemagglutinin__InfluenzaA__ABO52247
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcaguuuuaaugauuaugaagaacugaagcaucugcucagcuccgugaagcacuucgaaaaagucaagauuuuaccaaaagacgguuggacucaacauaagaccgaugggggaucuaaggcuugugccgugucgggcaaacccucauuuuuccguaacaugguuuggcugacaaagaaaggcccuaauuacccaguggcaaagagaagcuauaacaauaccaguggggagcagaugcuuaucauuuggggaguccaccaccccaacgacgaggccgaacagagggcuuuguaccagaaaguggguacuuacguauccgcaucuacaagcacccugaauaagcgguccacgccugagaucgccgcucgcccagaaguuucaggccuagggaguagaauggaguuuagcuggacucuccuggaugugugggacaccauaucuuucgaauccacaggaaaccuugucgccccggaguauggcuuuaaaauuucaaagagggguagcagugggaucaugaaaacugagggaacccugggcaauugcgaaacaaagugucaaacccccuugggcgcgauuaacacgacucucccuuuccauaacgugcacccacugacaaucggggagugccccaaguacgugaaaucugaaaaguuaguccuggcaaccggaccucggaauguuccacagaucgagucccgcggucucuuuggcgccauugcuggguucauagaaggaggcuggcaggguaugguggaugggugguauggcuaccaucacagcaacgaccagggaucgggcuaugccgcagauaaagagucuacucaaaaggcuuuugaccgaaucacaaauaaaguaaacuccgugauugagaagaugaauacccaguucgaagccgucgggaaggaguuuucaaaccuugagaaaagacuggagaauuugaacaagaaaauggaagacggauuccuagauguguggacguacaaugcggagcugcucguucugauggagaacgaaaggacccuugacuuccacgauaguaaugugaagaaccuguaugacaaaguccggaugcaguugcgugauaaugugaaggagcucgguaacggcuguuuugaguucuaccauaagugcgacgaugaauguaugaauagcguuaaaaacgggacauacgacuaucccaaguacgaggaagaguccaaacugaagcgcaacgaaaucaaaggaguaaaguuaucuagcaugggcguguaucagauacuggccauuuacgcaacugucgcugguucacuaagucucgccaucaugaucgcugggauuuccuuuuggaugugcagcaauggcucucugcaaugcagaaucuguauuuga

SEQ ID NO: 123649 - RNA, 1701 nt, Artificial Sequence
  derived and/or modified sequence opt3 from hemagglutinin__InfluenzaA__ABO52258
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagagcuccuggccuaagcauaacgugacccgcgguguuacugcuucaugcagucacaaagggaaguguagcuuuuaucgaaaucucuuauggcugacagagaaaaacggaucuuacccaaaucuuuccaagucauaugugaacaauaaggaaaaagaggucuuggugcuguggggcguacaucaccccagcaacaucgaagaccagaagaccauauaccguaaagagaaugcauacguuaguguggucucuucccacuauaacagaagguucacgccugaaaucgccaagcggccaaaagugcgcgaucaggagggcagaauuaacuacuauuggacucuacucgagcccggggacaccaucauuuuugaagcuaauggaaaccugaucgccccuugguacgcguucgcacuuagcagggguuuuggcucggggauaauuacaucuaaugccuccauggaugagugcgacgcuaagugucagacuccacaaggagccaucaacucaagucugccguuccagaaugugcaucccgucaccauuggcgaaugcccuaaauauguucggagcacaaaguugcgcauggugaccggucuccgaaacaucccauccauccagucuagagggcuguuuggagcaauugcuggcuucauagagggcggguggacgggaaugaucgaugguugguacggcuaucaccaucagaaugaacaagggagcggauacgccgcggaccagaagucaacucagaacgccauuaauggcaucacaaacaaaguaaauagugugauagagaagaugaacacccaguuuacugcagucgguaaagaguucaauaaguuagaaaagaggauggagaaccugaauaagaagguggaugacggguuccucgacauuuggacauacaacgcugaacuucugguuuugcuagagaacgaacggacccuggauuuucacgacuccaaugugaaaaaccucuaugagaaggucaaaagccaacugaagaauaacgccaaagagaucggcaauggauguuucgaauuuuaccacaagugcaacaaugagugcauggaaucugugaagaacggcacguaugauuaccccaaauauucagaggagaguaaacuuaaucgugagaaaaucgacgggguaaagcuggaaagcaugggaguuuaccagauuuuggcuaucuauuccaccguggccucuucgcucguccuguuagugagccugggugcaauuuccuucuggauguguucaaacggcagucuacagugccgcauauguaucuga

SEQ ID NO: 123650 - RNA, 1701 nt, Artificial Sequence
  derived and/or modified sequence opt3 from hemagglutinin__InfluenzaA__ABO52280
augaaggccagacugcucauccuucugugcgcuuugagcgcaaccgacgccgauacaauuuguauaggcuaccacgcgaacaauuccacugacacgguggauaccgucuuagagaaaaacguuacagugacucauucuguaaaucugcuagaagacucacacaacgggaagcucugcaggcugaaaggaaucgcuccccuucagcuggguaaguguaauauugccggcuggaucuuggggaacccugagugcgaaagucuccugagcaaucgguccuggucuuauauugcagagaccccaaacucggaaaauggaaucuguuacccgggcgauuucgccgacuaugaggagcugcgcgaacaacucucaagcgugaguuccuuugagcgauucgaaauauuucccaaagagucuagcuggccuaagcauaacaucacacguggugucaccguggcuugcucccacgcaaagaaaucaaguuucuacaagaauuuacuguggcuuacugaggccaacggguuguauccaagccugucuaaauccuacguuaaugauagagaaaaggaggugcuaguccucuggggagugcaucaccccucaaacauugaagaccagaggacacuguaucggaaagagaaugcuuacguaagcguugugaguucuaacuacaaccgcagauuuaccccugaaaucgccgagaggccaaagguccggggccagcccggccgcaugaauuauuacuggacgcuucuggagccuggggauaagauuaucuucgaagcgaacggaaauuugauagcaccaugguaugccuuugcucucucccgagguccgggcagcgggauuaucacuucgaacgccucuauggacgagugugauaccaaaugccagacaccccaaggagcaauuaauuccucacugccuuuccagaacauccacccagugacuaucggcgaaugucccaaguacgugagaaguaccaaauuaaggauggucacaggucugcggaauauuccuagcauacagucccgugggcucuuuggagcuaucgccggcuucauugagggcggguggaccggaaugguugacgguugguauggcuaccaucaccagaacgaacaagggucuggauaugcggccgaucaaaagagcacgcagaaugcaaucaacggcauaacuaauaaagugaacucaguaauugagaagaugaauacacaguuuaccgcuguggguaaagaguucaacaaacuugaaaagcgcauggagaaucugaacaagaaggucgacgacggguuuuuggauaucuggacuuacaacgccgaacuacuggugcuccuggagaaugaaagaacacuugacuuccaugauaguaacguuaaaaaucuguacgagaaggugaaaaaccaguugaggaauaacgcuaaggagaucggcaauggaugcuucgaauuuuaucacaagugugacaacgagugcauggaauccgucaaaaauggcaccuacgauuauccaaaguacagcgaggagucuaaacucaaccgggccaagauugacggggugaaacuggaaucaaugggaguauaucagaucuuagcaauuuacaguacgguugccagcucccuggugcuacucgucucucugggugcuauaucguucuggaugugcagcaauggcucccuucagugucgaaucugcauuuga

SEQ ID NO: 123651 - RNA, 1689 nt, Artificial Sequence
  derived and/or modified sequence opt3 from hemagglutinin__InfluenzaA__ABO52302
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcaauugcuccaucgcgggguggcugcuuggaaacccagagugugaucggcuguugucuguaccggaauggucauacaucauggagaaagagaauccccgcgacggccucugcuauccugguaguuuuaacgauuacgaagaacugaagcaucugcucagcuccgugaagcacuucgaaaaagucaagauuuuaccaaaagaccgauggacucaacauaccacaaccgggggaucucgugcuugugccgugucgggcaaucccucauuuuucagaaacaugguuuggcugacuaagaaaggcagcaauuauccuguggcaaaggggaguuacaacaauacauccggagagcagaugcuuaucauuugggguguccaccacccaaacgaugagaccgaacagaggacguuguaucagaaugugggcacuuacguaucuguugggaccagcacacugaacaagcgguccacucccgacaucgccacccgcccuaaagugaacggacuaggcgguagaauggaguuuucauggacacuccuggauaugugggacaccauaaauuucgaaaguacggggaaccuuauugcuccagaguacggauuuaagaucagcaaaagggggucuuccggcauuaugaagacugaaggcacacugggaaauugcgagaccaaaugucaaacuccguugggugcaaucaacacaacccuccccuuccauaauguccacccucugacgaucggcgagugcccaaaguaugugaaaucagaaaaguuagugcuggccaccgggcuccggaacgucccccagauugagagccgcggacuuuuuggcgcuauagccgguuucaucgaagggggcuggcagggaaugguugauggcugguacggguaucaucacaguaaugaccagggaucugguuacgcggcagauaaggaguccacacaaaaagccuuugacggcauuacuaacaaggugaauagcguaaucgagaaaaugaacacccaguucgaggcuguggggaaggaguuuucgaaucuggaacgaagauuggagaaccuaaauaaaaagauggaagacggauuccuggaugucuggacauauaacgccgagcuccuggugcuuauggaaaaugagaggacucuggacuuccacgauucuaacguuaagaacuuguacgacaaagugcggaugcagcuccgugauaaugucaaggagcugggcaacgguuguuuugaguucuaucauaaaugcgacgaugaauguaugaacuccgugaagaaugggaccuacgacuacccuaaauaugaagaggagucaaaguuaaaucgcaacgaaauaaagggcguaaaacugaguagcaugggaauuuaccagauccuagcaaucuaugcuacaguugccggcucccucucucuggcgauuaugauggccgggaucagcuuuuggaugugcucaaauggaagucuucaaugcagaauuuguauauga

SEQ ID NO: 123652 - RNA, 1701 nt, Artificial Sequence
  derived and/or modified sequence opt3 from hemagglutinin__InfluenzaA__ABO52313
augaagaccaucauugcccugagcuacauauucugccucguguuugcucagaaccuucccggcaaugacaacuccacagcaacucuguguuuggggcaccaugccgucccuaauggaacguuaguuaaaaccaucacaaacgaucaaauugaggugacuaaugcgaccgaacugguacagucuucaaguacagguaagaucugcaacaauccacacaggauucuagacggcaucaacuguacccucauagaugcucugcuuggggacccgcauugcgauggauuccagaaugagaaaugggaccuguuuguggaaagaagcaaggccuucuccaacuguuaucccuacgaugucccugacuaugcaucuuugcggucgcucguggccucaagcggcacucuggaguuuaucaaugaagguuucaacuggacagggguuacccagaauggaggcaguaacgcuugcaaacgcggcccagauuccggguuuuucucucgacugaauuggcucuacaagagcggauccacguaucccguguuaaacgucacuaugccuaacaaugacaacuuugauaagcuguacauuuggggugugcaccauccaucaaccgaccaagagcagacaaaucuuuauguacaggcaaguggccguguuacugugagcaccaaaagaucucagcaaacaaucauucccaacgucggguccaggccuugggugcggggauugucaagccgcaucaguauauacuggaccauugugaagccaggcgauauccuggucauuaauucuaacgguaaucuaaucgccccgagagggcacuucaaaaugaggacgggaaaguccagcaucaugcggucggacgcucccauuggcacuuguucuuccgagugcauaacaccuaacggcucaaucccaaaugacaaacccuuucagaacguuaauaagauuaccuacggggccuguccuaaguaugugaaacagaacacucucaagcuggcgacaggaaugcgcaauguaccagaaaaacagacccgagguaucuucggcgcaauagccggguuuauugagaacggaugggaaggcaugaucgaugguugguacggguucagacacaggaauagugagggcacgggacaagcugccgaccuuaagagcacccaggcagcuaucgaucagauuaacggcaaacugaaccgggugaucgagaagacaaaugaaaaauuccaucaaauugagaaggaauuuuccgaggucgaagggcguauacaggacuuggagaaguauguggaggauacuaaaaucgaccucuggucuuacaacgccgaacuguuaguugcgcuggagaaucagcacaccauugaucucacagacagcgaaaugaacaaacuuuucgagaagacucgcagacagcugagggaaaaugccgaggauaugggaaacgguugcuuuaagaucuaucauaaaugugacaaugcaugcaucggcucaauucggaacgggaccuacgaucacgacguguaucgagacgaggcuuugaauaaccgcuuccaaauaaagggagucgaacuaaagaguggcuacaaagauuggauccuguggauuuccuuugccaucagcugcuuccuccugugugugguacuucuggguuuuauuaugugggcuugccagaaggggaauaucagauguaacauaugcaucuga

SEQ ID NO: 123653 - RNA, 1701 nt, Artificial Sequence
  derived and/or modified sequence opt3 from hemagglutinin__InfluenzaA__ABO52335
augaagaccaucauugcccugagcuacauauucugccucgugcuuggccaggacuuucccagaaacgauaauuccacagcuacucuguguuuggggcaccaugcagucccuaacggaacguuaguuaaaaccaucacaaaugaccaaauugaggugacuaacgccaccgaacugguacagucuucaaguacagguaagaucugcaauaacccacacaggauucuagauggcaucgacuguacccucauagaugcgcugcuuggggacccgcauugcgauggauuccagaaugagacuugggaccuguuuguggaacggagcaaggcuuucuccaacuguuaucccuacgaugucccugacuaugccucuuugcgcucgcucguggcaucaagcggcacacuggaguuuaucaaugaagguuucaccuggacggggguuacucagaacggaggcaguaaugccugcaaacgaggcccagauuccggguuuuucucucgucugaacuggcucuacaaaagcggaaauaccuaucccguguuaaacgucacaaugccuaauaacgacaacuuugauaagcuguacauuuggggugugcaccauccauccacugaccaagaccagaccucacuuuauguacaggcuaguggcagaguuacagugagcaccaagaggucucagcaaacggucauccccaauauugggccucggccaugggugcgcggauuguccucaagaaucagcauauacuggacuauugugaaaccgggcgauauccugcuaauuaacaguaaugguaaccucaucgcacccaggggguacuucaagaugcggacaggaaaaucuuccaucaugcgcagcgacgccccuauuggcaccuguauaucggagugcaucacuccaaauggcucuauucccaacgauaagccuuuucagaaugucaacaaaaucacauauggggcuuguccaaaguacguuaagcagaauacccugaaacuugccacgggaaugcgaaacgugcccgagaagcagaccagagguauauucggcgcgauugcaggguuuaucgaaaauggaugggagggcaugaucgacgguugguauggguucaggcaccaaaacuccgaaggcacaggacaggccgcugaucugaaaucaacucaggccgcaauugaccaaaucaauggcaaguugaaccggguaauugagaaaaccaaugagaaguuccaccagauagaaaaagaguuuagugaaguggaggggcguauccaggaucucgaaaaguacgucgaggacacaaagauugaucuguggagcuauaacgcugaguuacugguggcccucgaaaaccagcauacuaucgaccuuaccgauuccgagaugaauaaacuguucgaaaagacacgcagacaauugagggagaacgcggaagacaugggaaaugguugcuuuaaaaucuaccaccggugugacaacgccugcauuggcucuauacgaaaugggaccuaugaucaugacguuuaccgcgaugaggcacuaaacaauagauuccagaucaagggaguggagcugaaaagcggcuacaaggacuggauucucuggaucucauuugcuauuaguugcuuccugcuuugugucgugcuguuggguuuuaucaugugggccugccagaaggggaacauaagguguaauaucugcauuuga

SEQ ID NO: 123654 - RNA, 1701 nt, Artificial Sequence
  derived and/or modified sequence opt3 from hemagglutinin__InfluenzaA__ABO52346
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacagaauacuagacggcaucaacuguacccucauagaugcucugcuuggggacccgcauugcgauggauuccagaaugagaaaugggaccuguuuguggaaaggagcaaggccuucuccgauuguuaucccuacgacgucccugauuaugcaucuuugcggucgcucguggccucaagcggcacucuggaguuuaucaacgaagguuucaauuggacagggguuacccagaacggaggcaguuccgcuugcaaacgcggcccagacaauggguuuuucucucgacugaacuggcucuacaagagcggauccacguaucccgugcaaaaugucacuaugccuaacaaugauaacucagacaaguuauacauuuggggugugcaccauccaaguaccgacaaagagcagacagaucuguauguacaggcaagcggcaagguuacugugucuaccaaacguucccagcaaacagucauccccaacguggggucaagaccuugggugaggggacuuagcagucgggucucuauuuacuggaccaucguuaagccaggcgacauauuggugauuaauuccaacgguaaucugaucgccccgcgcggguacuuuaaaaugagaacgggaaagagcucgauuaugaggucugaugcucccaucggcacuuguuccucagagugcaucacaccuaacggcaguauuccaaaugacaagcccuuccagaacguaaauaaaauaaccuauggggccuguccuaaguacgugaaacagaacacucuaaagcucgcgacaggaaugcggaaugucccagaaaaacagacccgcgguaucuuuggcgcaauugccggguucaucgagaacggaugggaaggcaugauagaugguugguauggguuucgacaccaaaauagcgagggcacgggacaggcugccgaccugaaguccacccaggcagcuauugaucaaaucaacggcaaacuuaauagagugaucgagaagacaaacgaaaaguuccaccagauugagaaagaguucucugaaguugaagggaggauccaggaccuggagaaguacguggaggauacuaaaauugacuuguggagcuauaaugccgaacuccuggucgcguuagagaaccagcauaccauagaucugacagacucagaaaugaacaagcucuuugagaaaacucggcgucaacuucgcgaaaaugccgaggacaugggaaacgguugcuucaagaucuaccacaagugugauaaugcaugcauuggcaguaucagaaacgggaccuaugaccaugauguguacagggacgaggcucugaauaaccgguuucagaucaaaggaguagaauugaaguccggcuacaaagauuggauucuauggauuagcuucgccaucucuugcuuucugcucuguguugugcugcuugguuucauuaugugggcuugccagaaggggaauauccgauguaacauuugcaucuga

SEQ ID NO: 123655 - RNA, 1701 nt, Artificial Sequence
  derived and/or modified sequence opt3 from hemagglutinin__InfluenzaA__ABO52357
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaacuuuauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaacuccaaugggaaccucaucgccccgaggggauacuuuaagaugcggacuggcaagagcucgaucaugcgcucugacgcucccauugauacauguauauucgagugcaucaccccuaauggcuccauuccaaacgacaaacccuuucagaauguuaacaagaucacguacggggccuguccuaaauaugugaagcagaauacccugaaacuugcgacaggaaugcgaaacguaccagaaaagcagacuagagguauauucggcgcaauugccggguuuaucgagaauggaugggaaggcaugaucgaugguugguacggguucaggcaccaaaacucagagggcaccggacaggcugccgaccugaagaguacacaggcagcuauugaucaaaucaauggcaaauugaaccgggugauugagaagacuaaugaaaaauuccaccagauagagaaggaauuuagcgaggucgaagggcguauccaggaccucgagaaauauguggaggauaccaagauugaccugugguccuacaacgccgaauuacugguugcgcucgagaaucagcauacaaucgaucuuaccgacucugaaaugaacaagcuguucgagaaaacucgcagacaauugagggaaaacgccgaggauaugggaaaugguugcuuuaagaucuaucacaaaugugacaacgcaugcauugagagcauacggaauggcacguacgaccaugauguguaucgagacgaagcucuaaacaaucgcuuccagaucaagggggucgagcugaaaucaggauacaaggauuggauucucuggaucaguuuugccauuuccugcuuccugcuuugugugguacuguugggcuuuaucaugugggcuugccagagagguaacauaagguguaauaucugcauuuga

SEQ ID NO: 123656 - RNA, 1701 nt, Artificial Sequence
  derived and/or modified sequence opt3 from hemagglutinin__InfluenzaA__ABO52368
augaagaccaucauugcccugagcuacauauucugccucgcucuuggccaggaccugcccgggaacgauaauuccacagcaacuuuguguuuaggacaccaugccgugccuaacgguacgcuggucaaaaccaucacaaaugaccaaauugagguuacuaacgcgaccgaacuugugcagucuucaaguacaggcaagaucugcaauaacccacacaggauucucgaugggaucaauuguacccugauagacgcucuacugggagauccgcauugcgacguauuucaggaugagacuugggacuuguucguggaaagaagcaaagccuuuuccaacuguuaucccuacgaugucccugacuaugcaucucuccggucgcugguggccucaagcggcacacuggaguucaucaccgaagguuuuacguggacugggguuacccagaauggaggcaguaacgcuugcaagcgcggcccaggguccggauucuuuucucgacucaauugguuaacaaaaagcgguuccacuuaccccgugcugaacgucaccaugccuaauaacgauaauuucgacaaguuguauauuuggggcgugcaccauccaucaacaaaccaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugaugugcuagucauuaauuccaacgggaaucucaucgccccgaggggauacuuuaaaaugcggacuggcaagagcucgaucaugcgcucugacgcucccauugacacauguauauccgagugcaucaccccuaacggcucaauuccaaaugauaaacccuuccagaacguuaauaagaucacguacggggccuguccuaaauaugugaagcagaacacccugaaacuugcgacaggaaugcgaaauguaccagaaaagcagacuagaggucuguuuggcgcaauagccggguucauugagaacggaugggaaggcaugaucgacgguugguacggguuuaggcaccaaaauagugagggcaccggacaggcugccgaucuuaagagcacacaggcagcuaucgaccaaauuaacggcaaacucaaucgggugaucgagaagacuaacgaaaaauuccaccagauugagaaggaguucuccgaagucgaagggcguauacaggaucuggagaaauauguggaggacaccaagaucgauuuauggucuuacaaugccgaacugcucguugcgcuugagaaccagcauacaauugaccugaccgauagcgaaaugaacaaguuguuugagaaaacucgcagacaacuaagggaaaaugccgaggacaugggaaacgguugcuucaagaucuaucacaaaugugauaaugcaugcaucgagucaauucggaacggcacguacgaccaugacguguaucgagaugaagcucugaauaaccgcuuucagauaaagggggucgagcucaaaaguggauacaaggacuggauccuguggauuuccuucgccaucagcugcuuucuucugugugugguauugcucggcuucauuaugugggcuugccagagagguaauaucagguguaacauaugcaucuga

SEQ ID NO: 123657 - RNA, 1701 nt, Artificial Sequence
  derived and/or modified sequence opt3 from hemagglutinin__InfluenzaA__ABO52797
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacaaccacaaugggaaacucugcaagcugaaaggaauagcuccccuucagcuggguaaguguucaaucgccggcuggauuuuggggaacccugagugcgaaagucucuucagcaagaaauccuggucuuauaucgcagagaccccaaauucggaaaacggaacauguuacccgggcuauuuugccgauuacgaggagcugagagaacaacugucaagcgucaguuccuucgagagguuugaaauuuuccccaaggagucuagcuggccuaaucauaacgugaccaaagguguuacugcuuccugcucacacaaggggaaaaguagcuuuuaucggaaucucuuauggcugacagagaagaacggaucuuacccaucccuuucaaagagcuaugugaauaacaaagaaaaggaggucuuggugcuguggggcguacaucaccccaguaauaucaaagaccagaagaccauauaccgcaaagaaaacgcauacguuucuguggucuccagccacuauaaccgacguuucacgccugagaucgccaagagaccaaaagugagggaucaggaaggccggauuaauuacuauuggacucuacucgagcccggggacaccaucauuuuugaggcuaacggaaaucugaucgccccuugguacgcguucgcacuuucgcgcgguuuuggcucugggauaauuacauccaacgccucaauggaugaaugugacgcuaagugccagacuccacaaggagccaucaauaguagccugccguuccagaacgugcaucccgucaccauuggcgaguguccuaaguauguuagauccacaaaauugaggauggugaccggucuccggaauaucccaucuauccagagccgcgggcuguuuggagcaauugcuggcuucauagaaggcggguggacgggaaugaucgaugguugguacggcuaucaccaucagaacgagcaagggucaggauacgccgcggaccagaagaguacucaguccgccauuaauggcaucacaaacaaaguaaauagcauaauugaaaagaugaacacccaguuuacugcaguggguaaagaguucaauaaguuagagaagcgaauggaaaaccugaauaaaaaggucgaugacggguuccucgacaucuggacauacaacgcugagcuucugguguugcuagaaaacgagagaacccuggauuuucacgacucuaauguuaaaaaccucuaugaaaaggugaaaucacaacugaagaauaacgccaaggagaucggcaauggaugcuucgaguuuuaccacaaauguaacaaugaaugcauggagagugucaagaacggcacguaugauuaccccaaauauagcgaagaguccaaacuuaauagggagaagauugacggggugaagcuggaaucuaugggaguauaccagaucuuggcuauuuauucgaccguugccagcucccucgugcuguuagucucacugggugcaauaaguuucuggaugugcucuaacggcagccuacagugucggaucugcauuuga

SEQ ID NO: 123658 - RNA, 1698 nt, Artificial Sequence; identical to SEQ ID NO: 122758
  derived and/or modified sequence opt3 from hemagglutinin__InfluenzaA__ABP49217

SEQ ID NO: 123659 - RNA, 1698 nt, Artificial Sequence
  derived and/or modified sequence opt3 from hemagglutinin__InfluenzaA__ABP49305
augaaggccaaacugauggugcuccuuugcaccuucacagcuacuuacgcagacacgaucuguauuggcuaucacgccaacaauagcaccgauacagucgacacuguucuggagaagaacgugaccguaacacauuccgugaauuuguuagaagauucucacaacgggaaacugugccuacucaagggaauagcgccccugcagcuugguaauuguucagucgcuggcuggauccuggggaacccugagugcgaauugcucauuaguaaagagagcugguccuacaucguggaaaccccaaauccggagaacggaacuuguuaucccggcuacuuugccgacuaugaggaacugagagagcaacugucuucgguuagcucauucgaaagguuugagauuuucccuaaggagaguuccuggccaaaucauacagugaccggugucucugcaagcugcucccacaacgggaagucaaguuuuuaccggaaucucuuauggcugacgggcaaaaacggacuuuaucccaauuugagcaagucuuacgccaacaauaaagaaaaggaggugcugguacuauggggcguucaucacccuccaaacaucggggaucagcgcgcucucuaccacacugaaaacgcauauguguccgucgugucaagccauuacagucgacguuucacccccgagauagccaaaagaccuaaggugagggaccaggaaggacggaucaauuauuacuggacacugcuugagccaggugauacuauuaucuuugaggcuaacggcaaucugauugccccgugguaugcguucgcauugucucgcggguuuggauccggcaucauaaccagcaacgcccccaugggugaaugugacgcuaagugccagacaccucaaggggccauuaauucgucucucccauuccagaacguccaccccguuaccaucggagaguguccuaaauacgugagauccgcaaagcugaggaugguaacgggcuuacggaauauuccaucaauccagagucgcggccuguuuggggcuaucgccggauucauugaagguggcuggacugggaugguggauggaugguauggcuaccaucaccagaacgagcaagguagcggguacgcggccgaccagaaauccacacagaaugcaauaaacggcaucaccaauaaggucaacucugugauugaaaagaugaauacucaguuuacagcuguuggaaaagaguucaacaaacucgagcgaagaauggaaaaucuuaacaagaagguggaugacggcuuccuggauaucuggaccuauaacgccgaguugcuaguccugcucgaaaaugagaggacgcuggacuuucacgacagcaacgugaaaaaucuuuacgaaaagguaaaaucacaacugaagaacaaugcuaaagagauagggaacggaugcuucgaguuuuaucauaaguguaauaacgaaugcauggagaguguuaagaaugguaccuacgauuaucccaaauacuccgaagagagcaaguugaaccgggagaaaauugacggcgugaagcucgaaucuaugggggucuaucagauccuggccaucuacucaacaguggcaaguagcuuaguccugcuagugucccucggagccauuucuuucuggaugugcucgaauggcagccugcagugucguaucugcauuuga

SEQ ID NO: 123660 - RNA, 1701 nt, Artificial Sequence
  derived and/or modified sequence opt3 from hemagglutinin__InfluenzaA__ABP49316
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaauaucgccggcuggauuuuggggaacccugagugcgaaagucucuucagcaagaaguccuggucuuauaucgcagagaccccaaauucggaaaacggaacauguuacccgggcuauuuugccgauuacgaggagcugagggaacaacugucaagcgucaguuccuucgagcgguuugaaauuuuccccaaagagcgcucuuggccuaagcauaauaucacccgaggugugacugcugcaugcagccacaaagggaaguccucauuuuaucguaaccucuuauggcugacagagaaaaauggaaguuacccaaaccuuaaaaagagcuauguuaauaacaaggaaaaggagguguugguccuguggggcgugcaucaccccucuaauauagaagaccagaaaacccuauacagaaaggagaacgccuacguauccguugugucaagcaacuauaauaaaagguucacgccugaaaucgcugagcggccaaagguccgcggccaggccgggagaauuaacuacuauuggacucuccuggagcccggagauaccaucauuuuugaagcgaaugguaaccuuaucgcaccuuggcacgccuucgcucugaguaggggcuuugggucuggaauaauuacauccaaugccagcauggacgagugugauacuaaaugccagaccccacaaggcgcaaucaacucgucuuugccguuccagaauauucaucccgugacaaucggugaauguccuaaguacgugcgguccaccaagcuccgcauggucacggggcugcgaaacaucccaucaauucagaguagaggauuauuuggcgcuauagccggcuucaucgaagggggauggacugguaugauugacggcugguauggguaccaccaucagaaugagcaaggaagcggcuaugcggccgaucagaaauccacacagaacgcaaucaaugguauaaccaacaagguuaauucugugauugagaaaaugaacacucaguuuacagcuguagggaaggaguucaauaaacuggaaaagaggauggagaaccucaacaagaaaguggacgauggcuuccuugacaucuggaccuacaaugccgaacuguugguccuacuggagaacgaacggacgcucgacuuucacgauagcaaugugaagaaccuguacgagaaaguuaagucacaacuuaaaaauaacgcuaaggagaucggaaauggcugcuucgaauuuuaucacaaguguaacaaugagugcauggaaagugugaaaaacgggaccuacgacuaucccaaguacuccgaggagagcaaacugaaucgugaaaagauugauggagucaaauuggagucuauggguguguaucagauccucgccauuuacucaacaguagcaaguagccugguuuuacuggugucccuaggcgccauaucuuucuggaugugcucgaacgggagccuccagugucgcaucugcauuuga

SEQ ID NO: 123661 - RNA, 1701 nt, Artificial Sequence
  derived and/or modified sequence opt3 from hemagglutinin__InfluenzaA__ABP49327
augaaggccagacugcucgugcuucugugcgcuuuggcagccaccgacgcggauacaaucuguauuggcuaccacgcuaacaauagcacugacacggucgauaccguuuuagagaaaaacgugacaguaacucauuccgugaaucugcuagaagacucucacaacgggaagcucugcaggcugaaaggaauagcaccccuucagcugcggaaguguaauaucgccgguuggauuuugggcaacccugagugcgaaucacuccugagugagcgcagcugguccuauaucgucgaaaccccaaauucugagaacgggacauguuacccgggagauuucaccaauuaugaggaacugcgagagcaacucucgucagugagcaguuuugaacguuucgagauuuuucccaaagaguccucuuggccuaagcauaacacuacaagaggcguuaccgccgcuugcagccacgcagguaaguccucauucuacaggaauuuacuguggcuuacggaaaaagacgggaguuauccaaacuugaauaacagcuacgugaauaagaaaggaaaggagguccuggugcuauggggcguacaucaccccucuaacaucaaagaucagcagacucucuaucagaaggaaaacgccuacguuuccguggucucaagcaauuacaaccggcgcuuuaccccugagauagcugaaagaccaaaggugaggggccaagccgggcggaugaauuauuacuggacacugcuuaaacccggagacacuaucauguucgaggcgaacgguaaucugauugcaccuugguaugccuuugcuuugagucgcggcuucgggucuggaaucauuaccuccaacgccagcaugcacgagugugauacaaagugccagaccccacagggcgcaaucaauucgucucucccguuucagaacauacaucccgugacgauuggugaauguccuaaauacguccgauccacuaagcugagaaugguuacaggguuaaggaauaucccaucaauucaaagucggggacuguucggcgcuaucgccggcuuuaucgaagggggauggaccgguaugauugacggcugguauggguaccaccaucagaacgagcagggaagcggcuaugcggccgaucagaaauccacucaaaaugcaauaaacgguaucacaaauaaggugaacucuguaauugagaaaaugaauacccaguucacggcuguggggaaggaauuuaacaaccucgagaagcguauggagaaucuuaacaaaaaggucgacgauggcuuccuggacaucuggaccuacaaugccgaauugcuaauacugcucgagaacgaacgcacacuggacuuccacgauagcaaugugaaaaaccuuuacgagaagguuaaaucacagcugagaaauaacgcuaaggaaauuggaaauggcugcuuugaguucuaucacaaguguaacaaugagugcauggaaagugugaaaaacgggacuuacgacuaucccaaguacuccgaggaaagcaaauugaauagggagaagaucgauggagucaaacucgagucuauggguguguaucaaauccuggccauuuacucaaccguagcaaguagcuuaguucugcuagugucccucggcgccaucucuuuuuggaugugcucgaacgggagccugcagugucggauuugcauauga

SEQ ID NO: 123662 - RNA, 1701 nt, Artificial Sequence
  derived and/or modified sequence opt3 from hemagglutinin__InfluenzaA__ABP49338
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcauaacgugacccgagguguuacugcuuccugcucacacaaagggaagaguagcuuuuaucguaaucucuuauggcugacagagaaaaacggaucuuacccaaaucuuuccaagucauaugugaacaauaaggaaaaagaggucuuggugcuguggggcguacaucaccccagcaacaucgaagaccagaagaccauauacagaaaagagaaugcauacguuaguguggucucuuccaacuauaacaggcgguucacgccugaaaucgccaagcgcccaaaagugagaggccaggaggggaggauuaauuacuauuggacucuacucgagcccggagauaccaucauuuuugaagcuaacgguaaucugaucgccccuugguacgcguucgcacuuagccggggcuuugggucgggaauaauuacaucuaacgccuccauggacgagugugauacuaagugccagaccccacaaggcgcuaucaauucaagucugccguuccagaacgugcaccccgucacaauuggugaauguccuaaauauguucgcagcaccaaguugcgaauggugacggggcucagaaauaucccauccauccagucuaggggacuguuuggcgccauugcaggcuucauagaagggggauggacugguaugaucgacggcugguacggguaucaucaccagaacgaacaaggaagcggcuacgcugccgaucagaagucaacacagaaugcgauuaacgguaucaccaauaaaguaaacagugugauagagaagaugaauacucaguuuacagccgucgggaaagaguucaacaaguuagaaaaacggauggagaaucugaacaagaagguggacgauggcuuccucgacauuuggaccuacaacgcagaacuucugguuuugcuagagaaugaacguacgcuggacuuucaugauuccaacgugaaaaaucucuaugagaaggucaaaagccaacugaagaacaaugcuaaagagaucggaaacggcugcuucgaauuuuaccacaaguguaauaacgagugcauggaaucugugaagaaugggaccuaugacuaccccaaauauucagaggagaguaaacuuaaccgcgagaagaucgauggaguaaagcuggagagcauggguguuuaccagauuuuggccaucuauuccacaguggcuucuucgcucguccuguuagugagccugggcgccauuuccuucuggaugugcucaaaugggagucuacaguguagaauaugcaucuga

SEQ ID NO: 123663 - RNA, 1701 nt, Artificial Sequence
  derived and/or modified sequence opt3 from hemagglutinin__InfluenzaA__ABP49349
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacaaccacaaugggaaacucugcaagcugaaaggaauagcuccccuucagcuggguaaguguucaaucgccggcuggauuuuggggaacccugagugcgaaagucucuucagcaagaaauccuggucuuauaucgcagagaccccaaauucggaaaacggaacauguuacccgggcuauuuugccgauuacgaggagcugagagaacaacugucaagcgucaguuccuucgagagguuugaaauuuuccccaaggagucuagcuggccuaaucauaacgugaccaaagguguuacugcuuccugcucacacaaggggaaaaguagcuuuuaucggaaucucuuauggcugacagagaagaacggaucuuacccaaaucuuuccaagucauaugugaacaauaaagaaaaggaggucuuggugcuguggggcauccaucaccccagcaacauagaagaccagaaaaccaucuaccgcaaggagaacgcauacguaaguguugugucuucccacuauaaucgacguuucacgccugaaauugccaaaagaccaaaggucagggaucaggagggccggaucaacuacuauuggacucuacucgagcccggggacaccauuaucuuugaagcuaauggaaaccugauagccccuugguacgcguucgcacuuagccgcgguuuuggcucggggauuaucacaucuaaugccuccauggaugagugugacgcuaaaugccagacuccacugggagccauuaacucaaguuugccguuccaaaaugugcaucccgugaccaucggcgaauguccuaaguaugucagaagcacaaagcucaggaugguuaccggucugcggaacaucccauccauucagucucgcggguuauuuggagcaauagcuggcuucaucgagggcggguggacgggaaugauugaugguugguacggcuaucaccaucagaaugaacaggggagcggauacgccgcggaccaaaaaucaacucagagugccaucaacggcauaacaaauaaggugaacuccauuaucgagaaaaugaauacccaguuuacugcaguagguaaggaguucaacaaacuggaaaagcgaauggagaaucucaacaagaaaguggaugacggguuccuugacaucuggacauacaacgcugaacuguugguccuacuggagaaugaaagaacccucgauuuucacgacagcaacgugaagaaucuguaugagaaaguuaagucucagcuuaaaaacaaugccaaggagauuggcaacggaugcuucgaauuuuaccacaaguguaauaacgagugcauggaaucagugaaaaauggcacguaugauuaccccaaguauagugaggagagcaaacugaacagggaaaagaucgacggggucaaauuggaguccaugggaguguaccaaauucucgcuauauauucuaccguagccucgagccugguuuuacuggugucccuaggugcaaucucauucuggaugugcaguaauggcucucuccagugucggauuugcaucuga

SEQ ID NO: 123664 - RNA, 1701 nt, Artificial Sequence
  derived and/or modified sequence opt3 from hemagglutinin__InfluenzaA__ABP49360
augaaggccaagcugcucauccuucugugcgcuuucaccgcaacagacgccgauacuauuuguauaggcuaccacgcgaacaauagcacggacaccguggauacagucuuggagaagaacguuacugugacccauuccguaaauuuacuggaagacucucacaacgggaaacuaugcagacucaagggaaucgcuccccugcagcuugguaauuguucaauugccggcuggauccuggggaacccugagugcgaaaguuuguuuagcaaaaaguccuggucuuauauugcagagacaccaaauucggaaaacggaaccuguuacccgggcuauuucgccgauuacgaggagcucagggaacaacugucaagcgugaguuccuuugagcgguucgaaaucuuucccaaggagucuagcuggccuaaucauacugucacaaaaggugugaccgcuuccugcucacacaacgggaagaguagcuucuaucgcaaucugcucugguuaacgaaaaagaacggaucuuacccaaaucuguccaaaucauauguuaacaauaaggagaaggaagugcuugucuuguggggcgugcaucaccccagcaacauaggcgaccagcgagcaaucuaccacacugagaacgccuacguaaguguugugucuucccauuauaaucguagauuuaccccugaaauugcuaaaaggccaaagguccgggaucaggaggggcgcaucaacuacuauuggacacugcuagaacccggagacacuauuaucuucgaggccaaugguaaccucauagcgccuugguacgcauuugcccugagcagaggcuucgggucgggaauuaucaccucuaaugcuuccauggaugagugugacgccaaaugccagacaccacaaggcgcaauuaacucaagucuuccguuucagaaugugcaccccgugaccaucggugaauguccuaaguaugucaggagcacgaaacugcggaugguuacuggguugcgcaacaucccauccauucagucucgaggacucuucggcgcuauagccggcuuuaucgaagggggauggacagguaugauugauggcugguacggguaucaucaccagaaugaacaaggaagcggcuacgcggccgaccagaagucaacccagaacgcaaucaaugguauaacuaacaaagugaauaguguaauugagaagaugaacacacaguucaccgcuguggggaaggaguucaauaaacuggagagaaggauggagaacuuaaacaagaaagucgaugacggcuuucuggacaucuggacguacaaugccgaacuccuugugcuguuggagaacgaacggacccuagauuuccacgacuccaauguuaagaaccuguaugagaaagucaagagccaacucaagaauaacgcuaaagaaaucggaaauggcugcuuugaguucuaccauaaguguaacaaugagugcauggaaucugugaaaaacgggacauaugauuaccccaaguauucagaggaaaguaaacugaaucgugagaagauugacggagugaaacuugagagcauggguguauaccagauccuggccauuuauuccacuguugcaucuucguuggugcuccuggucagcuuaggcgccauauccuuuuggaugugcucaaacgggagucugcagugucgcaucugcauuuga

SEQ ID NO: 123665 - RNA, 1701 nt, Artificial Sequence; identical to SEQ ID NO: 122666
  derived and/or modified sequence opt3 from hemagglutinin__InfluenzaA__ABP49371

SEQ ID NO: 123666 - RNA, 1701 nt, Artificial Sequence; identical to SEQ ID NO: 123403
  derived and/or modified sequence opt3 from hemagglutinin__InfluenzaA__ABP49382

SEQ ID NO: 123667 - RNA, 1698 nt, Artificial Sequence
  derived and/or modified sequence opt3 from hemagglutinin__InfluenzaA__ABP49393
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcauccaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccgccaaguuacggaugguaacgggacugcgcaauaucccaucaauccagagucgaggccucuucggcgcaauugcuggguuuauagaaggagguuggacuggcaugguggacgggugguacggauaucaucaccagaacgagcaaggcagcgguuacgccgcggaucagaaauccacacagaaugccaucaacgggauuaccaauaaggucaacucugugaucgaaaagaugaauacucaguucacagcaguuggcaaagaguucaacaaacuugagagaaggauggaaaaucugaacaagaagguggacgauggauuuuuggacauauggaccuacaacgcugagcuacugguccuccuggaaaaugagcggacgcuugacuuccacgauagcaacgugaaaaaucuguaugaaaagguaaaaucacaauugaagaacaaugccaaagagauuggcaacgggugcuuugaguucuaccauaaguguaaugacgaaugcauggagaguguuaagaacggaaccuaugauuaccccaaauauuccgaagagagcaagcucaaucgugagcgcaucgacggugugaaacuggaaucuaugggcgucuaccagaucuuagcuauuuauucaacaguggccaguagccugguccuacucgugucccugggggcaaucucuuuuuggaugugcucgaacggaagccuucaguguagaauuugcauauga

SEQ ID NO: 123668 - RNA, 1701 nt, Artificial Sequence
  derived and/or modified sequence opt3 from hemagglutinin__InfluenzaA__ABP49404
augaagaccaucauugcccugagcuacacacucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacagucuucaaguaccgguggcaucugcgacagcccacaccagauucuagauggggagaauuguacucucaucggagcucugcuuggcgacccgcagugcgaugguuuucaaaacaaaaagugggaccuguucguggaaagauccaaagccuauucuaauuguuaccccuaugaugucccugacuacgcaucguugaggucacucguggccagcagugggacacuggaguuuaacaaugaauccuucaacuggaccggaguuacgcagaauggcacuucuagcgcuugcaagcggcgcuccaacaauucauuuuucagucgacugaacuggcucacccauuuaaaguuuaaauauccagcacugaaugugacaaugcccaacaacgagaaguucgauaaacuuuacauauggggcguccaccauccugggacuuauaaugaccagaucagcuuguacgcccaggcuucuggacguauuaccguguccacaaagagaucacaacagaccguaaucccaaacauugguagcaggccccggguucgcgauaucccuaguagaauaucuauuuacuggacgaucgugaaaccaggcgacauucugcuaaucaauuccacugggaaccucaucgccccgaggggauauuuuaagauucggagcggcaagucgucuauaaugcgcuccgaugcgcccaucgguaaauguaauucagagugcauuacaccuaacgggaguaucccaaaugacaagcccuuccagaacgucaaucgaauaaccuacggagcauguccuagauaugugaaacagaacacucugaaacuugccacaggcaugaggaaugugccagaaaaacaaacccggggcauuuuuggggcuaucgccggauucaucgagaacgguugggaaggcauggucgacgggugguacggauuucgucaccagaauagcgagggcauuggucaggcagcugaucugaaguccacgcaagccgcgaucaaccagauuaaugggaaauugaaccgccucauaggcaagaccaacgagaaguuccaccagaucgaaaaagaguucucugaaguugagggaaggauucaggaccuggaaaaguauguggaggauacaaaaaucgacuuauggagcuacaaugccgagcugcucguagcacuugaaaaccaacauacuaucgaucugaccgacucagagaugaauaaguuguuugaaagaacaaagaagcagcuacgggagaacgcugaagauaugggcaaugggugcuucaagauuuaucacaaaugugacaacgccugcauaggaaguauccgaaaugguacuuacgaucaugacguguaccgcgaugaggcucugaacaauagauuucagauuaagggcgucgagcucaaauccggguauaaggacuggauccuguggauuagcuucgccaucucuugcuuucuucuguguguggcauugcucggauucauaaugugggccugccagaaaggcaacaucagguguaauauuugcaucuga

SEQ ID NO: 123669 - RNA, 1701 nt, Artificial Sequence; identical to SEQ ID NO: 122666
  derived and/or modified sequence opt3 from hemagglutinin__InfluenzaA__ABP49415

SEQ ID NO: 123670 - RNA, 1701 nt, Artificial Sequence; identical to SEQ ID NO: 122666
  derived and/or modified sequence opt3 from hemagglutinin__InfluenzaA__ABP49426

SEQ ID NO: 123671 - RNA, 1689 nt, Artificial Sequence
  derived and/or modified sequence opt3 from hemagglutinin__InfluenzaA__ABP49437
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcaacuauccuguggcaaaggggaguuacaauaacacauccggagagcagaugcuuaucauuugggguguccaccacccaaaugacgagaccgaacagaggacguuguaucagaacgugggcacuuacguaucuguugggaccagcacacugaauaagcgguccacucccgagaucgccacccgcccuaaagugaacggacuaggcgguagaauggaauuuucauggacacuccuggauaugugggacaccauaaacuucgagaguacggggaaucuuauugcuccagaauacggauuuaagaucagcaaaagggggucuuccggcauuaugaagacugagggcacacuggagaacugcgaaaccaaaugucaaacuccguugggagcaaucaauacaacccuccccuuccauaacguccacccucugacgaucggugagugcccaaaguaugugaaaucagaaaaguuagugcuggccaccggccuccggaaugucccccagauugagagccgcgggcuuuuuggagcuauagccggcuucaucgaagguggguggcagggcaugguugauggaugguacggcuaucaucacaguaacgaccaggggucuggauacgcggcagauaaggaguccacacaaaaagccuuugacgguauuacuaauaaggugaacagcguaaucgagaaaaugaauacccaguucgaagcugugggcaaggaguuuucgaaccuggaacgaagauuggagaaucuaaacaaaaagauggaagacggguuccuggaugucuggacauauaaugccgagcuccuggugcuuauggagaacgaaaggacucuggacuuccacgauucuaauguuaagaacuuguacgacaaagugcggaugcagcuccgugauaacgucaaggagcugggaaauggcuguuuugaguucuaucauaaaugcgacgaugaguguaugaacuccgugaagaaugguaccuacgacuacccuaaauaugaggaagagucaaaguuaaaccgcaaugaaauaaaggggguaaaacugaguagcaugggcguuuaccagauucuagcaaucuaugcuacaguggccggaucccucucucuggcgaucaugauggccggcauuagcuuuuggaugugcucaaacgggagucuucaaugcagaaucuguauuuga

SEQ ID NO: 123672 - RNA, 1701 nt, Artificial Sequence
  derived and/or modified sequence opt3 from hemagglutinin__InfluenzaA__ABP49448
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcauaacgugacccgagguguuacugcuuccugcucacacaaagggaagaguagcuuuuaucguaaucucuuauggcugacagagaaaaacggaucuuacccaaaucuuuccaagucauaugugaacaauaaggaaaaagaggucuuggugcuguggggcguacaucaccccagcaacaucgaagaccagaagaccauauacagaaaagagaaugcauacguuaguguggucucuuccaacuauaacaggcgguucacgccugaaaucagcgagcgcccaaaggugagaggccaggaggggaggauuaauuacuauuggacucuacucgaacccggagauaccaucauuuuugaggccaacgguaaucugaucgcuccuugguacgccuucgcgcuuucgcggggcuuugggucuggaauaauuacauccaacgcaucaauggacgaaugugauacuaaaugccagaccccacaaggcgccaucaauaguagccugccguuccagaacgugcaccccgucacaauuggugaguguccuaaguauguucgcuccaccaaauugcgaauggugacggggcucagaaauaucccaucuauccagagcaggggacuguuuggcgcuauugccggcuucauagaagggggauggacugguaugaucgacggcugguacggguaucaucaccagaacgagcaaggaucaggcuacgcagcugaucagaagaguacacagaaugccauuaacgguaucaccaauaagguaaacuccgugauagagaaaaugaauacucaguuuacagcggucgggaaggaguucaacaaauuagaaaagcggauggaaaaucugaacaaaaagguggacgauggcuuccucgacauuuggaccuacaacgccgagcuucugguuuugcuagaaaaugagcguacgcuggacuuucaugauagcaacgugaagaaucucuaugagaaagucaagucucaacugaaaaacaaugcaaaggaaaucggaaacggcugcuucgaguuuuaccacaaauguaauaacgaaugcauggagucagugaagaaugggaccuaugacuaccccaaguauagugaggaaagcaaacuuaaccgcgagaagaucgauggaguaaaacuggaauccauggguguuuaccagauuuuggcuaucuauucuacaguggccucgagccucguccuguuagugucccugggcgcuauuucauucuggaugugcaguaaugggucucuacaguguagaauaugcaucuga

SEQ ID NO: 123673 - RNA, 1689 nt, Artificial Sequence
  derived and/or modified sequence opt3 from hemagglutinin__InfluenzaA__ABP49459
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcaacuauccuguggcaaaggggaguuacaauaacacauccggagagcagaugcuuaucauuugggguguccaccacccaaaugacgagaccgaacagaggacguuguaucagaacgugggcacuuacguaucuguugggacccccacacugaauaagcggagcacuccugauaucgccacccgcccaaaagugaacggacaaggcgguagaauggaguuuuccuggacacuacucgacaugugggauaccauaaacuucgaaucaacggggaaucugauugcuccggaguacggauuuaagaucaguaaaaggggcagcucuggcauuaugaagacugaagggacacuuggaaacugcgagaccaaaugucagacuccccugggugcaaucaauacaaccuugccuuuccauaacguccacccacucacgaucggcgagugccccaaguaugugaaauccgaaaagcugguguuagccaccgggcugcggaaugucccucagauugagucacgcggacucuuuggcgcuauagccgguuucaucgaagggggcuggcagggaaugguugacggcugguacggguaucaucacagcaacgaucaaggaagugguuacgcggcagacaaggagucuacacagaaagccuuugacggcauuacuaauaaggugaacuccguaaucgagaaaaugaauacccaguucgaggcuguggggaaggaguuuagcaaccuugaacgaagacuggagaauuugaacaaaaagauggaagauggauuccuagacgucuggacauauaaugccgagcugcucgugcugauggaaaacgagaggacucuugauuuccacgacucgaauguuaagaaccuguacgauaaagugcggaugcaguugcgugacaacgucaaggagcucggcaaugguuguuuugaguucuaucauaaaugcgaugacgaauguaugaacucugugaagaaugggaccuacgauuacccaaaauaugaagaggaguccaagcugaaccgcaaugaaauaaagggcguaaaauuaucaaguaugggaguuuaccaaauucuggcaaucuaugcuacaguggccggcagccuaucccucgcgaucaugauggccgggauuucuuuuuggaugugcagcaacggaucacugcagugcagaaucuguauuuga

SEQ ID NO: 123674 - RNA, 1689 nt, Artificial Sequence
  derived and/or modified sequence opt3 from hemagglutinin__InfluenzaA__ABP49470
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcaacuauccuguggcaaaggggaguuacaauaacacauccggagagcagaugcuuaucauuugggguguccaccacccaaaugacgagaccgaacagaggacguuguaucagaacgugggcacuuacguaucuguuagcaccuccacacugaauaagcggucaacucccgauaucgccacccgcccuaaagugaacgggcuaggaggcagaauggaguuuaguuggacacuccuggacaugugggauaccauaaacuucgaaagcacggguaaucuuauugcuccagaguacggguuuaagaucucuaaaaggggauccucaggcauuaugaagacugaaggcacacuggggaacugcgagaccaaaugucaaacuccguugggagcaaucaauacaacccuccccuuccauaacguccacccucugacgaucggugagugcccaaaguaugugaaaagcgaaaaguuagugcuggccaccggccuccggaaugucccccagauugagagucgcgggcuuuuuggagcuauagccggcuucaucgaagguggguggcagggcaugguugacggaugguacggcuaucaucacucuaacgaucagggguccggauacgcggcagacaaggagagcacacaaaaagccuuugacgguauuacuaauaaggugaacucgguaaucgagaaaaugaauacccaguucgaggcugugggcaaggaguuuucuaaccuggaacgaagauuggagaaucuaaacaaaaagauggaagauggguuccuggacgucuggacauauaaugccgagcuccuggugcuuauggaaaacgagaggacucuggauuuccacgacuccaauguuaagaacuuguacgauaaagugcggaugcagcuccgugacaacgucaaggagcugggaaauggcuguuuugaguucuaucauaaaugcgaugacgaauguaugaacucagugaagaaugguaccuacgauuacccuaaauaugaagaggagaguaaguuaaaccgcaaugaaauaaaggggguaaaacugagcuccaugggcguuuaccagauucuagcaaucuaugcuacaguggccggaucucucagccuggcgaucaugauggccggcauuucauuuuggaugugcaguaacgggucccuucaaugcagaaucuguauuuga

SEQ ID NO: 123675 - RNA, 1701 nt, Artificial Sequence
  derived and/or modified sequence opt3 from hemagglutinin__InfluenzaA__ABP49492
augaagaccaucauugcccugagcuacauauucugccucguguuugcucagggccuucccgggaacgacaauuccacagcaacucuguguuugggacaccaugccgucccuaacgguacguuaguuaaaaccaucacaaaugaucaaauugaggugacuaacgcgaccgaacugguacagucuucaaguacaggcaagaucugcgacaauccacacagaauuuuggaugggaucaacuguacccucauagacgcucugcuuggagauccgcauugcgacggcuuccagaaugagaaaugggaucuguuuguggaaaggagcaaggccuucuccaacuguuaucccuacgacgucccugauuaugcaucuuugcggucgcucguggccucaagcgguacucuggaguuuaucaaugaaggguucaacuggacaggaguuacccagaauggcggcaguuccucuugcaaacgcgggccagacaacggauuuuucagccgacugaauuggcucuacaaguccgguucaacguaucccgugcaaaacgucacuaugccuaauaacgauaacagugacaaguuauacauuuggggcgugcaccauccaagcaccgauaaagagcagacagaccuguauguacaggcuucugggaagguuacuguguccaccaaacguucacagcaaacagucauccccaaugugggaagcagaccuugggugaggggccuuaguucucgggucuccauuuacuggaccaucguuaagccaggugacauauuggugauuaacagcaaugggaaccugaucgcaccgcgcggauacuuuaaaaugagaacgggcaagucgucuauuaugagguccgaugcccccaucggcacuuguucaagugagugcaucacaccuaaugggagcauuccaaacgacaagcccuuccagaauguaaacaaaauaaccuauggagcuuguccuaaguacgugaaacagaauacucuaaagcucgccacagguaugcggaacgucccagaaaaacagacccgcggcaucuuuggggcgauugcaggauucaucgagaauggcugggaagguaugauagaugggugguauggcuuucgacaccaaaacuccgagggaacgggccaggccgcugaccugaagucuacccaggccgcaauugaucaaaucaaugggaaacuuaacagagugaucgagaagacaaaugaaaaguuccaccagauugagaaagaguucagcgaaguugaaggaaggauccaggaccuggagaaguacguggaggauacuaaaauugacuuguggucauauaacgcugaacuccuggucgccuuagagaaccagcauaccauagaucugacagacagugaaaugaauaagcucuuugagaaaacucggcgucaacuucgcgaaaacgcggaggauauggguaauggcugcuucaagaucuaccacaagugugacaacgccugcauuggguccaucagaaauggaaccuaugaccaugauguguacagggacgaggcacugaacaaucgguuucagaucaaaggcguagaacuaaagagcgguuacaaagauuggauucuauggauaucuuucgcuaucucaugcuuucugcucuguguugugcugcuuggguucauuaugugggccugccagaagggcaacauccgauguaauauuugcaucuga

SEQ ID NO: 123676 - RNA, 1701 nt, Artificial Sequence; identical to SEQ ID NO: 123572
  derived and/or modified sequence opt3 from hemagglutinin__InfluenzaA__ABP49503

SEQ ID NO: 123677 - RNA, 1701 nt, Artificial Sequence
  derived and/or modified sequence opt3 from hemagglutinin__InfluenzaA__ABP49514
augaagaccaucauugcccugagcuacauauucuaucucgcucuuggccaggaccugcccgggaacgauaauuccacagcaacuuugugcuuaggacaccaugccgugccuaacgguacgcuggucaaaaccaucacaaaugaccaaauugagguuacuaacgcgaccgaacuugugcagucuucaaguacaggcaagaucuguaauaacccacacaggauucucgaugggaucgacugcacccugauagaugcucuacugggagacccgcauugugauguauuucagaaugagacuugggacuuguucguggaaagaagcaaagccuuuuccaacugcuaccccuaugaugucccugacuacgcaucucuccggucgcugguggccucaagcggcacacuggaguucaucaccgaagguuuuacguggacugggguuacccagaauggaggcaguaacgcuuguaagcgcggcccaggguccggauucuuuucucgacucaauugguuaacaaaaagcgguuccacuuaucccgugcugaacgucaccaugccuaauaacgauaauuucgacaaguuguacauuuggggcgugcaccauccaucaacaaaccaagagcagaccaguuuguauguacaggcaagcgggcguguuacggugucuacuagaaggucccagcaaacaaucauucccaacaucggaucacggccuuggguccgcggccugagcaguagaauaucuauuuacuggaccaucgugaagccaggugaugugcuagucauuaauuccaacgggaaucucaucgccccgaggggauacuuuaaaaugcggacuggcaagagcucgaucaugcgcucugacgcucccauugacacaugcauauccgaguguaucaccccuaacggcucaauuccaaaugauaaacccuuccagaacguuaauaagaucacguauggggccugcccuaaauacgugaagcagaacacccugaaacuugcgacaggaaugcgaaauguaccagaaaagcagacuagaggucuguuuggcgcaauagccggguucauugagaacggaugggaaggcaugaucgacgguugguauggguuuaggcaccaaaauagugagggcaccggacaggcugccgaucuuaagagcacacaggcagcuaucgaccaaauuaacggcaaacucaaucgggugaucgagaagacuaacgaaaaauuccaccagauugagaaggaguucuccgaagucgaagggcguauacaggaucuggagaaauacguggaggacaccaagaucgauuuauggucuuauaaugccgaacugcucguugcgcuugagaaccagcauacaauugaccugaccgauagcgaaaugaacaaguuguuugagaaaacucgcagacaacuaagggaaaaugccgaggacaugggaaacgguuguuucaagaucuaccacaaaugcgauaaugcauguaucgagucaauucggaacggcacguaugaccaugacguguaccgagaugaagcucugaauaaccgcuuucagauaaagggggucgagcucaaaaguggauacaaggacuggauccuguggauuuccuucgccaucagcugcuuucuucugugcgugguauugcucggcuucauuaugugggcuugucagagagguaauaucaggugcaacauauguaucuga

SEQ ID NO: 123678 - RNA, 1701 nt, Artificial Sequence
  derived and/or modified sequence opt3 from hemagglutinin__InfluenzaA__ABQ01311
augaaggccagacugcucauccuucugugcgcuuugagcgcaaccgacgccgauacaauuuguauaggcuaccacgcgaacaauuccacugacacgguggauaccgucuuagagaaaaacguuacagugacucauucuguaaaucugcuagaagacucacacaacgggaagcucugcaggcugaaaggaaucgcuccccuucagcuggguaaguguaauauugccggcuggaucuuggggaacccugagugcgaaagucuccugagcaaucgguccuggucuuauauugcagagaccccaaacucggaaaauggaacauguuacccgggcgauuucgccgacuaugaggagcugcgcgaacaacucucaagcgugaguuccuuugagcgauucgaaaucuuucccaaagagcguucuuggccuaagcauaacauaaccagaggugucacugcugcaugcagccacgccaagaaauccucauucuacaagaauuuacuguggcuuacagaggcuaacgggaguuauccaaauuugagcaaaucuuacgugaacaauaaggaaaaagagguucuggugcuauggggaguccaucaccccuccaagaucgaagaucagaggacccucuaucggaaggagaacgccuacgugucaguaguuagcaguaacuacaaucgcagauuuacgccugaaauugcggagaggccaaaagugcggggccaggcaggccgcaugaacuauuacuggacucugcuugagcccggggacaagaucauuuucgaagccaauggaaaccugaucgcuccuugguaugccuuugcauugucucgaggucucggcuccgggauaauuaccagcaaugcuucgauggaugagugugacacaaaaugccagacuccacaaggagccaucaacucuucccugccguuccagaauauucaccccgucaccaucggcgaauguccuaaguacgugagaucaacaaaauuaaggauggugaccggucugcggaacaucccaaguauucagagccgugggcucuuuggagcgauagccggcuucaucgagggcggguggacgggaauggucgaugguugguauggcuaccaucaccagaaugaacaaggguccggauaugcagcugaccagaagucuacucagaacgccauuaauggcaucacaaacaaaguuaauagcgugauagagaagaugaacacccaguuuacugcuguagguaaggaguucaauaaacuugaaaagcgcauggagaaccugaacaaaaagguggaugacggguuuuuggacauuuggacauacaaugccgaacuacugguccuccuggagaacgaaagaacccuugauuuccaugacucaaaugugaaaaaccuguacgagaagguuaagaaucaauugaggaacaaugcaaaagagaucggcaacggaugcuucgaauuuuaucacaagugugauaaugagugcauggaaagugugaaaaacggcacguacgacuaucccaaguacuccgaggagagcaaacucaaucgggaaaagaucgauggggucaagcuggagucuaugggaguguaucagauuuuagccaucuacucaaccguagcuaguagccugguucuacucgugucccugggugcgauuucuuucuggaugugcucgaacggcagccuucagugucgaauaugcaucuga

SEQ ID NO: 123679 - RNA, 1701 nt, Artificial Sequence
  derived and/or modified sequence opt3 from hemagglutinin__InfluenzaA__ABQ01322
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucaucuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacagcugagcagugucuccucuuucgagcgguuugaaauuuuccccaaagagcgcagcuggccuaagcacaacgugacccgagguguuacugcugcaugcucccauaaagggaagucaaguuuuuaucguaaucucuuauggcugacagagaaaaacggaagcuacccaaaucuuucuaaguccuaugugaacaauaaggaaaaagaggucuuggugcuguggggcguacaccaccccucaaacaucgaagaccaaaagaccauauacagaaaagagaaugccuacguuagcguggucaguucuaacuauaacaggcgguucacgccugaaaucgcuaagcgcccaaaagugagaggccaggaggggaggauuaauuacuauuggacucuacucgagcccggagauaccaucauuuuugaagccaacgguaaucugaucgcgccuugguacgcauucgcccuuucccggggcuuugggagcggaauaauuacaucgaacgcuucuauggacgagugugaugccaagugccagacuccacagggcgcaaucaauuccucacugccguuccaaaacgugcaucccgucaccauuggugaauguccuaaauauguucgcaguacaaaguugcgaauggugaccgggcucagaaauaucccaagcauccaguccaggggacuguuuggcgcuauugccggcuucauagaagggggauggacggguaugaucgacggcugguacggguaucaccaucagaacgaacagggaucuggcuacgcggccgaucaaaagagcacucagaaugcaauuaacgguaucacaaauaaaguaaacucagugauagagaagaugaauacccaguuuacugcugucgggaaagaguucaacaaguuagaaaaacggauggagaaucugaacaagaagguggacgauggcuuccucgacauuuggacauacaacgccgaacuucugguuuugcuagagaaugaacguacccuggacuuucacgauaguaacgugaaaaaucucuaugagaaggucaaaucccagcugaagaacaaugcuaaagagaucggaaacggcugcuucgaauuuuaccacaaguguaauaacgagugcauggaaagcgugaagaaugggacguaugacuaccccaaauauucugaggagucaaaacuuaaccgcgagaagaucgauggaguaaagcuggagaguauggguguuuaccaaauuuuggccaucuauagcaccguggcauccucucucguccuguuagugucgcugggcgccauuagcuucuggaugugcuccaaugggucacuacaguguagaauaugcaucuga

SEQ ID NO: 123680 - RNA, 1701 nt, Artificial Sequence; identical to SEQ ID NO: 122666
  derived and/or modified sequence opt3 from hemagglutinin__InfluenzaA__ABQ01333

SEQ ID NO: 123681 - RNA, 1701 nt, Artificial Sequence
  derived and/or modified sequence opt3 from hemagglutinin__InfluenzaA__ABQ01344
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucuacacaagcggccaucaaccagaucaaugguaaacucaaccgucugauugggaagaccaaugaaaaguuucaucagaucgagaaagaguucucagaaguagaaggccgcauucaggauuuagagaaguauguggaggacacgaaaauagaucuguggaguuacaacgcagaacuccuugucgcucuggagaaccaacacaccaucgacuugacagauuccgaaaugaauaagcuauucgagagaacuaaaaagcagcugagggaaaacgccgaggacaugggaaauggcuguuuuaagauuuaucauaaaugcgauaacgcuugcaucgggagcauccggaauggaaccuacgaccacgauguguaccgagacgaggcccucaacaaucgcuuccagauuaaggguguugaacugaaaucuggcuauaaggacuggauacuuuggaucucauuugcaauuaguuguuuccuguugugcgugguccuccugggguuuaucaugugggccugucagaaaggaaacauuagaugcaauaucuguauauga

SEQ ID NO: 123682 - RNA, 1689 nt, Artificial Sequence
  derived and/or modified sequence opt3 from hemagglutinin__InfluenzaA__ABQ01355
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgagauggccucugcuauccugguucauuuaaugacuacgaagaacugaagcaucugcucaguagcgugaagcacuucgaaaaaguccguauuuuaccaaaggauagauggacucaacauaccacaaccgggggauccagggcuugugccgugucuggcaaccccucguuuuuccggaauaugaucuggcugacuaaaaagggcucaaacuauccuguugcaaaagggagcuacaauaacacaaguggagagcagaugcuuauuaucuggggugugcaccacccaauagacgagaccgaacagcgcacguuguaucagaaugucgagacuuacguguccguaguuaccucuacacugaacaagagaagcacucccaagauugccaccaggccuaaagugaauggccuagggggacggauggaauuuuccuggacacuccuggauaugugggacaccaucaacuucgagucaacgggcaaccuuauugcuccagaauacgguuuuaagaucaguaaacgcgggagcucuggaaucaugaagacugagggcacacuggagaauugcgaaaccaaaugucaaacuccguugggcgcaauuaacacaacccuccccuuccauaauguccacccucugacgauaggggagugcccaaaguaugugaaauccgaaaaguuagugcuggccaccggacuccgaaacgucccccagaucgagucaagaggucuuuuuggcgcuauugccggguucaucgaaggaggcuggcaggguaugguugaugggugguacggcuaucaucacagcaaugaccagggaaguggcuacgcggcagauaaggagucuacacaaagggccuuugacgggauaacuaacaaaguaaauuccgugauugagaagaugaacacccaguucgaagcugugggaaaagaguuuagcaaucuggaacggcguuuggagaaccuaaauaagaaaauggaagacgguuuccuggaugucuggacauauaacgccgagcuccuggugcuuauggagaaugaacgcacucuggacuuccacgauucgaacguuaagaauuuguacgacaaggugagaaugcagcucagggauaacgucaaagagcugggcaacggguguuuugaguucuaucauaagugcgacgaugaguguaugaacucugugaaaaauggaaccuacgacuacccuaaguaugaggaagaguccaaauuaaaucggaacgaaaucaagggcguaaagcugucaaguauggguguuuaccagauccuagcaauuuaugcuacaguggccgggagccucucccuggcgaucaugauggccggcauuucuuuuuggaugugcagcaauggaucacuucaaugccgaauauguaucuga

SEQ ID NO: 123683 - RNA, 1701 nt, Artificial Sequence
  derived and/or modified sequence opt3 from hemagglutinin__InfluenzaA__ABQ01366
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacaggauucuagacggcaucaacuguacccucauagaugcucugcuuggggacccgcauugcgauggauuccagaaugagaaaugggaccuguuuguggaaagaagcaaggccuucuccaacuguuaucccuacgaugucccugacuaugcaucuuugcggucgcucguggccucaagcggcacucuggaguuuaucaaugaagguuucaacuggacagggguuacccagaauggaggcaguuccgcuugcaaacgcggcccagauaacggguuuuucucucgacugaauuggcucuacaagagcggauccacguaucccgugcaaaacgucacuaugaccaauaacgacaacucagauaaguuauacauuuggggugugcaccauccuaguacagacaaagagcagacugaccuguauguacaggcaagcggcaagguuaccgugucuacaaaacguucccagcaaaccaucauuccaaaugucgggucaagacccugggugaggggacuuagcagucgggugucuaucuacuggacgauagucaagccuggcgauauuuugguuaucaacuccaaugguaaccugauugccccacgcggguacuuuaaaaugagaacuggaaagagcucgaucaugaggucugacgcuccgaucggcacauguuccucagagugcauuacccccaauggcaguauaccuaacgauaagccauuccagaaugugaacaaaaucacuuauggggccugucccaaguacguaaaacagaauacacuaaagcucgcgaccggaaugcggaacgugccugaaaaacagacgcgcgguauuuuuggcgcaaucgccggguucauagagaauggaugggaaggcaugauugacgguugguauggguuucgacaccaaaacagcgagggcaccggacaggcugccgaucugaaguccacacaggcagcuaucgaccaaaucaauggcaaacuuaacagagucauugagaagacuaaugaaaaguuccaccagaucgagaaagaguucucugaaguggaagggaggauucaggaucuggagaaguacguugaggacaccaaaauagauuuguggagcuauaacgccgaacuccugguggcguuagagaaccagcauacaaucgaccugacugauucagaaaugaauaagcucuuugagaaaacccggcgucaacuucgcgaaaacgccgaggacaugggaaaugguugcuucaagauuuaccacaagugugacaacgcaugcaucggcaguaucagaaaugggacauaugaucaugacgucuacagggaugaggcucugaacaaucgguuucagauuaaaggaguggaauugaaguccggcuacaaagacuggauacuauggaucagcuucgccauuucuugcuuucugcucuguguaguucugcuugguuucaucaugugggcuugccagaaggggaacauucgauguaauaucugcauauga

SEQ ID NO: 123684 - RNA, 1701 nt, Artificial Sequence; identical to SEQ ID NO: 123449
  derived and/or modified sequence opt3 from hemagglutinin__InfluenzaA__ABQ44383

SEQ ID NO: 123685 - RNA, 1701 nt, Artificial Sequence; identical to SEQ ID NO: 122649
  derived and/or modified sequence opt3 from hemagglutinin__InfluenzaA__ABQ44405

SEQ ID NO: 123686 - RNA, 1701 nt, Artificial Sequence
  derived and/or modified sequence opt3 from hemagglutinin__InfluenzaA__ABQ44416
augaaggccaaacugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucaaucgccggcuggauucuggggaacccugagugcgaaaguuuguuuagcaaaaaguccuggucuuauaucgcagagacaccaaauucggaaaacggaaccuguuacccgggcuauuucgccgauuacgaggagcucagggaacaacugucaagcgucaguuccuuugagcgguucgaaauuuuucccaaggagucuagcuggccuaaucauacugugacaaaagguguuaccgcuuccugcucacacaaggggaaaaguagcuucuaucgcaaccugcucugguuaacggagaagaauggaucuuacccaaaccuguccaaaucauaugugaauaacaaggaaaaggagguccuuguguuguggggcguacaucaccccagcaauaucggcgaccagcgagcaauauaccacacugaaaacgccuacguuaguguggucucuucccauuauaaccguagauuuaccccugagaucgcuaaaaggccaaaggugcgggaucaggaagggcgcauuaauuacuauuggacacugcuagagcccgaggacacuaucauuuucgaagccaacggaaaucucaucgcgccuugguacgcauuugcccugagcagagguuucggcucggggauaauuaccucuaacgcuuccauggaugagugugacgccaaaugccagacaccacaaggagcaaucaauucaagucuuccguuucagaacgugcaccccgucaccauuggcgaauguccuaaguauguuaggagcacgaaacugcggauggugacugguuugcgcaauaucccauccauccagucucgagggcuuuucggagcuauugccggcuuuauagagggcggguggacaggaaugaucgaugguugguacggcuaucaucaccagaacgaacaagggagcggauacgcggccgaccagaagucaacccagaaugcaauuaacggcaucacuaauaaaguaaacagugugauagagaagaugaauacacaguucaccgcugucgguaaggaguucaacaaacuggaaagaaggauggagaauuuaaacaagaaaguggaugacggguuucuggacauuuggacguacaacgccgaacuccuuguucuguuggagaaugaacggacccuagauuuccacgacuccaacgugaagaaucuguaugagaaagucaagagccaacucaagaacaaugcuaaagagaucggcaacggaugcuuugaguucuaccauaaguguaauaacgaaugcauggaaucugugaaaaauggcacauaugauuaccccaaguauucagaggagaguaaacugaaccgugaaaagaucgacgggguaaagcucgagagcaugggaguuuaccagauucuggccaucuauuccacuguggcaucuucguugguccuccuggugagcuuaggugccauuuccuuuuggaugugcucaaauggcagucugcagugucgcauaugcaucuga

SEQ ID NO: 123687 - RNA, 1701 nt, Artificial Sequence; identical to SEQ ID NO: 122272
  derived and/or modified sequence opt3 from hemagglutinin__InfluenzaA__ABQ44427

SEQ ID NO: 123688 - RNA, 1689 nt, Artificial Sequence
  derived and/or modified sequence opt3 from hemagglutinin__InfluenzaA__ABQ44438
auggccaucauuuacuucauacugcucuuuaccgcugugagaggcgaccagaucugcauuggguaucacgcaaacaauagcacagagaaggucgauacuauccuugaaaggaacguuacggugacccaugccaaagacauucuggagaagacacacaauggaaaauuguguaaguuaaacgguauacccccucuggaacuaggcgauugcuccaucacuggguggcuccugggaaauccagagugugaccggcuucugcgcguaccggaauggucuuacaucauggagaaagagaacccccgauauucauugugcuacccuggcaguuucaaugauuaugaggaacucaagcaucugcugagcuccgugaagcacuuugaaaaaguccguauucucccaaaggacgguuggacccaacauacaaccucugggggaucgaaagcgugugcugugucaggcaagagcaguuucuuuagaaacaugguuugguuaacuaaaaagggccccaauuacccuguggccaagagguccuauaacaauacaucuggggagcagaugcugaucauuuggggaguccaccacccaaacgaugaggcagaacagagcgcccuuuaccagaaaguggguaccuacguauccgcuucaacgaguacuuugaauaagcggagcacccccgagaucgcagcccgcccugaaguuaacggccuggggucuagaauggaguucuccuggacacuacucgacgugugggauacuauaaauuuugaaucaaccggaaaccuggucgcuccagaguauggcuucaaaauuagcaagagggguaguucugggaucaugaaaacagagggaacccuuggcaacugcgaaacgaagugucaaacuccgcugggcgccauuaauacaaccuugcccuuucauaacgugcacccucucacuaucggggagugcccaaaauacgugaaguccgaaaagcuggucuuagcgacaggacugcggaauguuccccagaucgagagccgcggucucuucggcgcaauugccggguuuauagaaggaggcuggcaggguaugguggacgggugguauggcuaccaucacucgaacgaucagggaucuggcuaugcugccgacaaagaguccacccaaaaggcauucgaucgaaucacgaauaaaguaaacucagugauugagaagaugaauacccaguuugaagcugucgggaaagaguucaguaaccuugaaaagagacuggagaauuugaacaagaaaauggaagacggauuccuagacguguggacauacaaugccgagcugcucguucugauggagaacgaaaggacucuugauuuucacgacagcaaugugaagaaccuguauaauaaaguccggaugcaguugcgugauaacgugaaggagcucgguaacggcuguuucgaauuuuaccauaaaugcgacgaugaguguauguccucuguaaagaaugggaccuacgacuauccuaaguacgaggaagagagcaaacugaagcgcaacgaaaucaaaggaguuaaguuaucaaguaugggcguguaucagauacuggcgauuuacgccacagucgcagguucccuaagccucgcuaucaugaucgccgggauuucucuguggaugugcucaaauggcagucuucaaugcagaaucuguauuuga

SEQ ID NO: 123689 - RNA, 1689 nt, Artificial Sequence
  derived and/or modified sequence opt3 from hemagglutinin__InfluenzaA__ABQ44460
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugaucuggcugacuaagaaaggcagcaacuauccuguugcaaaggggaguuacaauaacacauccggagagcagaugcuuauuaucuggggugugcaccacccaaaugacgagaccgaacagaggacguuguaucagaacgucggcacuuacgugucuguagggaccagcacacugaauaagcgguccacucccgauauagccacccgcccuaaaguuaacggacuaggcucaagaauggaguuuaguuggacacuccuggacaugugggauaccauuaacuucgaaagcacggguaaucuuaucgcuccagaguacggguuuaagauuucuaaaaggggauccucaggcaucaugaagacugaaggcacacuggggaacugcgagaccaaaugucaaacuccguugggagcaaucaauacaacccuccccuuccauaacgugcacccucugacgauuggugagugcccaaaguaugucaaaagcgaaaaguuagugcuggccaccggccuccggaaugugccccagauagagagucgcgggcuuuuuggagcuaucgccggcuucauugaagguggguggcagggcauggucgacggaugguacggcuaucaucacucuaacgaucagggguccggauacgcggcagacaaggagagcacacaaaaagccuuugacgguaucacuaauaagguuaacucggugauagagaaaaugaauacccaguucgaggcuguaggcaaggaguuuucuaaccuggaacgaagauuggagaaucuaaacaaaaagauggaagauggguuccuggacguguggacauauaaugccgagcuccugguccuuauggaaaacgagaggacucuggauuuccacgacuccaaugugaagaacuuguacgauaaaguucggaugcagcuccgugacaacgugaaggagcugggaaauggcuguuuugaguucuaucauaaaugcgaugacgaauguaugaacucagucaagaaugguaccuacgauuacccuaaauaugaagaggagaguaaguuaaaccgcaaugaaauuaagggggugaaacugagcuccaugggcguauaccagauccuagcaaucuaugcuacaguugccggaucucucagccuggcgauuaugauggccggcaucucauuuuggaugugcaguaacgggucccuucaaugcagaauuuguauauga

SEQ ID NO: 123690 - RNA, 1701 nt, Artificial Sequence
  derived and/or modified sequence opt3 from hemagglutinin__InfluenzaA__ABQ44471
augaaggccagacugcucauccuucugugcgcuuugagcgcaaccgacgccgauacaauuuguauaggcuaccacgcgaacaauuccacugacacgguggauaccgucuuagagaaaaacguuacagugacucauucuguaaaucugcuagaagacucacacaacgggaagcucugcaggcugaaaggaaucgcuccccuucagcuggguaaguguaauauugccggcuggaucuuggggaacccugagugcgaaagucuccugagcaaucgguccuggucuuauauugcagagaccccaaacucggaaaauggaacauguuacccgggcgauuucgccgacuaugaggagcugcgcgaacaacucucaagcgugaguuccuuugagcgauucgaaaucuuucccaaagagcguucuuggccuaagcauaacauaaccagaggugucacugcugcaugcagccacgccaagaaauccucauucuacaagaauuuacuguggcuuacagaggcuaacgggaguuauccaaauuugagcaaaucuuacgugaacaauaaggaaaaagagguucuggugcuauggggaguccaucaccccuccaacaucgaagaucagaggacccucuaucggaaggagaacgccuacgugucaguaguuagcaguaauuacaaccgcagauuuacgccugaaauugcggagaggccaaaggugcggggccaggcaggccgcaugaauuauuacuggacucugcuugagcccggggacaaaaucauuuucgaagccaacggaaaucugaucgcuccuugguaugccuuugcauugucucgaggucucggcuccgggauaauuaccagcaacgcuucgauggaugagugugacacaaagugccagacuccacaaggagccaucaauaacucucugccguuccagaauauucaccccgucaccaucggcgaauguccuaaauacgugagauccacaaaguuaaggauggugaccggucugcggaacaucccaucaauucagagucgugggcucuuuggagcgauagccggcuucaucgagggcggguggacgggaauggucgaugguugguauggcuaccaucaccagaaugaacaagggagcggauaugcagcugaccagaaauccacucagaacgccauuaauggcaucacaaacaagguuaauucugugauagagaaaaugaacacccaguuuacugcuguagguaaggaguucaacaaacuugaaaaacgcauggagaaucugaacaagaaaguggaugacggguuuuuggacauuuggacauacaaugccgaacuacugguccuccuggagaacgaaagaacccuugauuuccaugacagcaaugugaagaaccuguacgagaaaguuaagaaucaauugaggaacaaugcaaaggagaucggcaacggaugcuucgaauuuuaucacaaaugugauaaugagugcauggaaucagugaagaacggcacguacgacuaucccaaauacagugaggaguccaagcucaaucgggaaaagaucgauggggucaagcuggagagcaugggaguguaucagauuuuagccaucuacucuaccguagcuucaagucugguucuacucgugagccugggugcgauuuccuucuggaugugcucuaacggcucgcuucagugucgaauaugcaucuga

SEQ ID NO: 123691 - RNA, 1701 nt, Artificial Sequence
  derived and/or modified sequence opt3 from hemagglutinin__InfluenzaA__ABR15797
augaagaccaucauugcccugagcuacauauucugccucgcucuuggccaggaccugcccgggaacgauaauuccacagcaacuuuguguuuaggacaccaugccgugccuaacgguacgcuggucaaaaccaucacaaaugaccaaauugagguuacuaacgcgaccgaacuugugcagucuucaaguacaggcaagaucugcaauaacccacacaggauucucgaugggaucgacuguacccugauagaugcucuacugggagacccgcauugcgauguauuucagaaugagacuugggacuuguucguggaaagaagcaaagccuuuuccaacuguuaucccuacgaugucccugacuaugcaucucuccggucgcugguggccucaagcggcacacuggaguucaucaccgaagguuuuacguggacugggguuacccagaauggaggcaguaacgcuugcaagcgcggcccaggguccggauucuuuucucgacucaauugguuaacaaaaagcgguuccacuuaccccgugcugaacgucaccaugccuaauaacgauaauuucgacaaguuguauauuuggggcgugcaccauccaucaacaaaccaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugaugugcuagucauuaauuccaacgggaaucucaucgccccgaggggauacuuuaaaaugcggacuggcaagagcucgaucaugcgcucugacgcucccauugacacauguauauccgagugcaucaccccuaacggcucaauuccaaaugauaaacccuuccagaacguuaauaagaucacguacggggccuguccuaaauaugugaagcagaacacccugaaacuugcgacaggaaugcgaaauguaccagaaaagcagacuagaggucuguuuggcgcaauagccggguucauugagaacggaugggaaggcaugaucgacgguugguacggguuuaggcaccaaaauagugagggcaccggacaggcugccgaucuuaagagcacacaggcagcuaucgaccaaauuaacggcaaacucaaucgggugaucgagaagacuaacgaaaaauuccaccagauugagaaggaguucuccgaagucgaagggcguauacaggaucuggagaaauauguggaggacaccaagaucgauuuauggucuuacaaugccgaacugcucguugcgcuugagaaccagcauacaauugaccugaccgauagcgaaaugaacaaguuguuugagaaaacucgcagacaacuaagggaaaaugccgaggacaugggaaacgguugcuucaagaucuaucacaaaugugauaaugcaugcaucgagucaauucggaacggcacguacgaccaugacguguaucgagaugaagcucugaauaaccgcuuucagauaaagggggucgagcucaaaaguggauacaaggacuggauccuguggauuuccuucgccaucagcugcuuucuucugugugugguauugcucggcuucauuaugugggcuugccagagagguaauaucagguguaacauaugcaucuga

SEQ ID NO: 123692 - RNA, 1701 nt, Artificial Sequence
  derived and/or modified sequence opt3 from hemagglutinin__InfluenzaA__ABR15808
augaaggccagacugcucauccuucugugcgcuuugagcgcaaccgacgccgauacaauuuguauaggcuaccacgcgaacaauuccacugacacgguggauaccgucuuagagaaaaacguuacagugacucauucuguaaaucugcuagaagacucacacaacgggaagcucugcaggcugaaaggaaucgcuccccuucagcuggguaaguguaauauugccggcuggaucuuggggaacccugagugcgaaagucuccugagcaaucgguccuggucuuauauugcagagaccccaaacucggaaaauggaacauguuacccgggcgauuucgccgacuaugaggagcugcgcgaacaacucucaagcgugaguuccuuugagcgauucgaaaucuuucccaaagagcguucuuggccuaagcauaacauaaccagaggugucacugcugcaugcagccacgccaagaaauccucauucuacaagaauuuacuguggcuuacagaggcuaacgggaguuauccaaauuugagcaaaucuuacgugaacaauaaggaaaaagagguucuggugcuauggggaguccaucaccccuccaacaucgaagaucagaggacccucuaucggaaggagaacgccuacgugucaguaguuagcaguaauuacaaccgcagauuuacgccugaaauugcggagaggccaaaggugcggggccaggcaggccgcaugaauuauuacuggacucugcuugagcccggggacaaaaucauuuucgaagccaacggaaaucugaucgcuccuugguaugccuuugcauugucucgaggucucggcuccgggauaauuaccagcaacgcuucgauggaugagugugacacaaagugccagacuccacaaggagccaucaauucuucccugccguuccagaacauucaccccgucaccaucggcgaauguccuaaauacgugagaucaacaaaguuaaggauggugaccggucugcggaauaucccaaguauucagagccgugggcucuuuggagcgauagccggcuucaucgagggcggguggacgggaauggucgaugguugguauggcuaccaucaccagaacgaacaaggguccggauaugcagcugaccagaaaucuacucagaaugccauuaacggcaucacaaauaagguuaacagcgugauagagaaaaugaauacccaguuuacugcuguagguaaggaguucaacaaacuugaaaaacgcauggagaaccugaauaagaaaguggaugacggguuuuuggacauuuggacauacaacgccgaacuacugguccuccuggagaaugaaagaacccuugauuuccaugacucaaacgugaagaaucuguacgagaaaguuaagaaccaauugaggaauaacgcaaaggagaucggcaauggaugcuucgaauuuuaucacaaaugugauaacgagugcauggaaagugugaagaauggcacguacgacuaucccaaauacuccgaggagagcaagcucaaccgggaaaagaucgauggggucaagcuggagucuaugggaguguaucagauuuuagccaucuacucaaccguagcuaguagccugguucuacucgugucccugggugcgauuucuuucuggaugugcucgaauggcagccuucagugucgaauaugcaucuga

SEQ ID NO: 123693 - RNA, 1698 nt, Artificial Sequence; identical to SEQ ID NO: 122758
  derived and/or modified sequence opt3 from hemagglutinin__InfluenzaA__ABR15885

SEQ ID NO: 123694 - RNA, 1698 nt, Artificial Sequence
  derived and/or modified sequence opt3 from hemagglutinin__InfluenzaA__ABR15896
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaagccccaaauccggagaacggaaccuguuaucccggcuacuuugcagacuaugaggaacugagagagcaacucucuucgguuagcucauucgaaagguuugagauuuucccuaaggagaguuccuggccaaaucauacugugacaggugucucugccagcugcucccacaacgggaagucaaguuuuuaccggaauuuacuguggcuuaccggaaagaacggcuuguaucccaaucugagcaugucuuacgugaacaauaaggaaaaagagguucuaguacucuggggcgugcaucacccuccaaacaucggggaucagcgcgcucuguaccacacggaaaacgcauaugucuccguggugucaagccauuacagucgacguuucacucccgagauagccaagagaccuaaagucagggaccaggaaggacggaucaauuauuacuggacccuucuggagccaggugauacaauuaucuuugaggcuaacggcaauuugauugccccgugguaugcguucgcacucucucgcggguuuggauccggcaucauaacuagcaacgcccccauggacgaaugugaugcuaagugccagaccccucaaggugccauuaauucgucucugccauuccagaacguucaccccgugacaaucggggaguguccuaaguacguaagauccgcaaaauuaaggauggugaccggacugcggaauauuccaucaauccagagucgcggccucuuuggcgcuaucgccggguucauugaaggagguuggacgggcauggucgacgggugguauggauaccaucaccagaacgagcaaggcagcgguuacgcggccgaucagaaguccacucagaaugcaauaaacgggaucacaaauaaagugaacucuguuauugaaaagaugaauacccaguuuacugcugugggcaaagaguucaacaaacuugagcgaagaauggaaaaucugaacaaaaaggucgacgauggauucuuggacaucuggacauauaacgccgagcuacuggugcuccuggaaaaugagaggacccuugacuuucacgauagcaacguaaagaaucuguacgaaaaaguuaagucacaauugaaaaacaaugcuaaggagauaggcaacgggugcuucgaguuuuaucauaaauguaauaacgaaugcauggagagugugaagaauggaacguacgacuaucccaaguacuccgaagagagcaaacucaaccgggagaagauugauggugucaaacuggaaucuaugggcguguaucagaucuuagccaucuacucaaccgucgcaaguagccuggugcuacucguuucccugggggccauuucuuucuggaugugcucgaauggaagccuucagugucguaucugcauuuga

SEQ ID NO: 123695 - RNA, 1698 nt, Artificial Sequence; identical to SEQ ID NO: 122757
  derived and/or modified sequence opt3 from hemagglutinin__InfluenzaA__ABR15907

SEQ ID NO: 123696 - RNA, 1698 nt, Artificial Sequence; identical to SEQ ID NO: 122758
  derived and/or modified sequence opt3 from hemagglutinin__InfluenzaA__ABR15918

SEQ ID NO: 123697 - RNA, 1701 nt, Artificial Sequence
  derived and/or modified sequence opt3 from hemagglutinin__InfluenzaA__ABR15929
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggaauuucuuccagaaucagcauauacuggaccauugugaaaccuggugacauccuacucauuaacucgacaggcaaucugaucgccccaaggggguauuucaagauccggucuggaaaguccucaauuaugcgcagugacgcgccgauaggcaaauguaacagcgaaugcaucacccccaaugguuccauuccuaacgauaagccauuucagaaugugaaccgaaucacguacgggcccuguccuagauaugucaaacagaauacucuuaagcuggcaacaggaaugaggaacguuccagagaaacaaacccggggcauauucggcgccauugcuggguuuaucgaaaauggaugggaggguaugauggacggcugguacggguuccgucaccagaacucugagggaacuggccaggccgcagaucuaaagagcacacaagcugccaucaaucagauuaacgguaaacucaaucgccugaucgaaaagaccaacgagaaguuucaucagauugaaaaagaguucucagaaguggaggggagaauacaggacuuagagaaguauguagaagauacgaaaaucgaccuguggaguuacaaugcggagcuccuuguggcccuggaaaaccaacacaccauugauuugacagacuccgagaugaacaagcuauucgaaaggacuaaaaagcagcugcgggagaaugcagaggauaugggcaacggaugcuuuaagaucuaucauaaauguaauaacgcuugcaucggcagcauucgaaaugggaccuacgaccacgaugucuaccgcgacgaagcccucaacaauagauuccagauaaagggaguggagcugaaaucugguuauaaggacuggauccuuuggauuucauuugcuaucaguugcuuccuguuguguauuguucuccugggcuuuaucaugugggccugccagaaagggaacauaagguguaauaucugcauuuga

SEQ ID NO: 123698 - RNA, 1701 nt, Artificial Sequence
  derived and/or modified sequence opt3 from hemagglutinin__InfluenzaA__ABR15940
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucucuaacgauaagccuuuucagaaugucaaccgaauuacguacggggcauguccaagauauguuaaacagaauacucuuaagcuggccacaggaaugaggaacgugcccgagaaacaaacccggggcaucuucggcgcuauagccggguuuauugaaaauggaugggaggguaugauggacggcugguacggguuccgucaccagaacagcgagggaacuggccaggcagcugauuugaagucaacacaagccgcgaucaaucagaucaacgguaaacucaaucgccugauugaaaagaccaacgagaaguuucaucagaucgaaaaagaguucagugaaguagaggggaggauucaggacuuagagaaguauguggaagauacgaaaauagaccugugguccuacaaugccgagcuccuugucgcacuggaaaaccaacacaccaucgauuugacagacagcgagaugaacaagcuauucgaaagaacuaaaaagcagcugcgggagaaugcugaggauaugggcaacggaugcuuuaagauuuaucauaaaugugacaaugccugcaucggcucuauccgaaacgggaccuacgaucacgacguguaccgcgacgaagcucucaauaacagauuccagauuaagggaguugagcugaaaucagguuauaaggauugggugcuuuggauaaguuuugccaucagcugcuuccuguuguguauuguccuccugggcuuuaucaugugggcaugccagaaagggaauauuagguguaacaucugcauauga

SEQ ID NO: 123699 - RNA, 1701 nt, Artificial Sequence; identical to SEQ ID NO: 122578
  derived and/or modified sequence opt3 from hemagglutinin__InfluenzaA__ABR15951

SEQ ID NO: 123700 - RNA, 1701 nt, Artificial Sequence
  derived and/or modified sequence opt3 from hemagglutinin__InfluenzaA__ABR15962
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagaggucccgggccuauucuaauuguuaccccuaugacgucccugauuacgugucgcuccgcucacugguugcaagcaguggcacucuggaauuuaacaaugaguccuucaacuggacagguguggcccaaaaugggaccucuagcgcuugcaagcgacguuccgacaaaucauuuuucaguagacucaacugguuacaccagcugaaguauaaguacccagcacuuaaugucacgaugcccaacaaugagaaauuugauaaguuguauauauggggagugcaucacccuggcacugacagcgaucagaucucucuguacgcccaggcuuccggcaggguaaccguuucaacaaaacggagccaacagacugugauuccaaacaucgggagucgccccugggucagaggagugucuuccauuaucagcauauacuggaccauugugaagccuggugacauccuacucauuaacucgacaggcaaucugaucgccccaaggggguauuucaaaauccggucuggaaaguccucaauuaugcgcagugacgcgccgauaggcaaguguaacagcgaaugcaucacccccaaugguuccauuccuaacgauaaaccauuucagaaugucaaccgaaucacguacgggcccuguccuagauauguuaagcagaauacucuuaaacuggcaacaggaaugaggaacgugccagagaagcaaacccggggcauauucggcgccauugcuggguuuaucgaaaauggaugggaggguaugauggacggcugguacggguuccgucaccagaacucugagggaacuggccaggccgcagauuugaaaagcacacaagcugccaucaaucagauuaacgguaagcucaaucgccugaucgagaaaaccaacgaaaaguuucaucagauugaaaaggaguucucagaaguagaggggagaauacaggacuuagagaaauauguggaagauacgaagaucgaccuguggaguuacaaugcggagcuccuugucgcccuggaaaaccaacacaccauugauuugacagacuccgagaugaacaaacuauucgaaaggacuaagaaacagcugcgggagaaugcagaggauaugggcaacggaugcuuuaagaucuaucauaagugugacaaugcuugcaucggcagcauucgaaacgggaccuacgaucacgacguguaccgcgacgaagcccucaauaacagauuccagauaaaaggaguugagcugaagucugguuauaaagauuggauccuuuggauuucauuugcuaucaguugcuuccuguuguguauugugcuccugggcuuuaucaugugggccugccagaaggggaauauaagguguaacaucugcauuuga

SEQ ID NO: 123701 - RNA, 1701 nt, Artificial Sequence
  derived and/or modified sequence opt3 from hemagglutinin__InfluenzaA__ABR22241
augaagaccaucauugcccugagcuacauacucugccuugcuuucgcacagaaacugcccggcaacgacaauuccacagccacuuuguguuuagggcaccaugcggugccuaacggaacgcuggucaagaccaucacaaaugaucaaauugagguuacuaacgcuaccgagcuagugcagucuucaaguacagguagaaucugcgacagcccacaccagauucucgauggcgaaaauuguacccugaucgacgcccuucugggggauccgcauugcgacggauuucagaacaaagaaugggauuuguucguagagagguccaaggcauauucuaauuguuaccccuaugacgugccugauuacgccucgcuccggucacuggucgcuagcaguggcacucuggaauuuaacaaugaguccuucaacuggacagguguggcacaaaaugggaccucuagcgccugcaaacgccgauccauaaagucauuuuucagucgucucaacugguuacaccagcuggaguauagauacccagcucuuaauguuacgaugcccaacaaugacaaguuugauaaauuguauaucuggggagugcaucacccuagcacugacucugaucagauuuccgucuacgcccaggcgucaggcagggugaccguaagcacaaagcggagucaacagacuguuaucccaaacauuggcucucgccccugggugagagggaucuccagcaggauaucgauuuacuggaccaucgucaaaccuggagacauucugcuaaucaacucuacagguaaucucaucgcaccacggggcuauuucaagauucgcuccgggaaaucaaguauaaugcgaagcgacgccccgaucggaaaguguaacuccgaaugcauuacccccaauggcucuaucccuaacgauaagccauuucagaaugugaacagaauaacguacggugcuugucccagguaugugaaacagaauacucugaaacuugccacagggaugcggaacgucccugagaaacaaacccguggaauuuucggcgcaaucgcuggcuuuaucgaaaaugggugggagggaaugauggacgguugguacggcuuccgccaccagaacagcgaggggacuggacaggccgcggaucugaagucaacacaagccgcaauuaaucagaucaacggcaaauugaauaagcucauugaaaagaccaacgagaaguuucaucagauagaaaaggaguucagugaaguugaggguagaauccaggaccuggagaaauauguggaagauacgaagauugacuuaugguccuacaaugcugagcugcucguagcccuugaaaaccaaaacaccaucgaucugacagacagcgagaugaauaaauuguucgaaaggacucggaagcagcuacgagagaacgcugaggauauggggaauggcugcuuuaaaaucuaucacaagugugacaacgccugcauuggaucuauacgcaauggcaccuacgaucaugacguguacagagacgaagcacugaacaauagguuccagaucaagggggucgagcucaaaucaggauauaaggauuggauucuguggaucaguuuugccauuagcugcuuccuucugugugugguuuugcucgguuuuaucaugugggcuugccagaaaggcaacauacgguguaauaucugcauuuga

SEQ ID NO: 123702 - RNA, 1701 nt, Artificial Sequence; identical to SEQ ID NO: 122666
  derived and/or modified sequence opt3 from hemagglutinin__InfluenzaA__ABR28515

SEQ ID NO: 123703 - RNA, 1701 nt, Artificial Sequence
  derived and/or modified sequence opt3 from hemagglutinin__InfluenzaA__ABR28592
augaagaccaucauugcccugagcuacguguucugccucgucuuugcucaggaccuucccggcaacgauaauuccacagcaacucuguguuuggggcaccaugccguuccuaacggaacguuagugaaaaccauaacaaaugaccaaaucgagguaacuaacgcgaccgaacuggugcagucuucaaguacagguaagauuugcgauaauccacacagaauccuagacggcauuaacuguacccucaucgaugcucugcuuggggacccgcauugcgauggauuccagaaugagaaaugggaccuguuugucgaaaggagcaaggccuucuccaacuguuaucccuacgaugugccugacuaugcaucuuugcggucgcucguugccucaagcggcacucuggaguuuauaaaugaagguuucaacuggacaggggugacccagaauggaggcaguuccgcuugcaaacgcggcccagauaacggguuuuucucucgacugaauuggcucuacaagagcggauccacguaucccguccaaaacgugacuaugccuaauaacgacaacucagauaaguuauacaucugggguguacaccauccaaguaccgacaaagagcagacagaccuguauguucaggcaagcggcaaggugacugucucuaccaaacguucccagcaaacagugauucccaauguggggucaagaccuugggucaggggacuuagcagucggguuucuaucuacuggaccauugugaagccaggcgauaucuugguaauaaacuccaaugguaaccugauugccccgcgcggguacuuuaaaaugagaacgggaaagagcucgaucaugaggucugacgcucccauuggcacuuguuccucagagugcaucacaccuaauggcaguaucccaaacgauaagcccuuccagaaugugaacaaaauuaccuauggggccuguccuaaguacgucaaacagaauacucuaaagcucgcgacaggaaugcggaacgugccagaaaaacagacccgcgguauauuuggcgcaaucgccggguucauugagaauggaugggaaggcaugaucgacgguugguauggguuucgacaccaaaacagcgagggcacgggacaggcugccgaucugaaguccacccaggcagcuauagaccaaauuaauggcaaacuuaacagaguuaucgagaagacaaaugaaaaguuccaccagaucgagaaagaguucucugaaguggaagggaggauucaggaucuggagaaguacgucgaggacacuaaaaucgauuuguggagcuauaacgccgaacuccugguggcguuagagaaccagcauaccauugaccugacagauucagaaaugaauaagcucuuugagaaaacucggcgucaacuucgcgaaaacgccgaggacaugggaaaugguugcuucaagauauaccacaagugugacaacgcaugcaucggcaguauuagaaaugggaccuaugaucaugacguauacagggaugaggcucugaacaaucgguuucagaucaaaggaguugaauugaaguccggcuacaaagacuggauccuauggauuagcuucgccauaucuugcuuucugcucugugugguccugcuugguuucaucaugugggcuugccagaaggggaacauucgauguaauaucugcauuuga

SEQ ID NO: 123704 - RNA, 1698 nt, Artificial Sequence; identical to SEQ ID NO: 122758
  derived and/or modified sequence opt3 from hemagglutinin__InfluenzaA__ABR28768

SEQ ID NO: 123705 - RNA, 1698 nt, Artificial Sequence; identical to SEQ ID NO: 122758
  derived and/or modified sequence opt3 from hemagglutinin__InfluenzaA__ABR28779

SEQ ID NO: 123706 - RNA, 1701 nt, Artificial Sequence; identical to SEQ ID NO: 123449
  derived and/or modified sequence opt3 from hemagglutinin__InfluenzaA__ABR28790

SEQ ID NO: 123707 - RNA, 1698 nt, Artificial Sequence; identical to SEQ ID NO: 122758
  derived and/or modified sequence opt3 from hemagglutinin__InfluenzaA__ABR28801

SEQ ID NO: 123708 - RNA, 1701 nt, Artificial Sequence; identical to SEQ ID NO: 122666
  derived and/or modified sequence opt3 from hemagglutinin__InfluenzaA__ABR28812

SEQ ID NO: 123709 - RNA, 1701 nt, Artificial Sequence
  derived and/or modified sequence opt3 from hemagglutinin__InfluenzaA__ABR28823
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggaauuucuuccagaaucagcauauacuggaccauugugaaaccuggugacauccuacucauuaacucgacaggcaaucugaucgccccaaggggguauuucaagauccggucuggaaaguccucaauuaugcgcagugacgcgccgauaggcaaauguaacagcgaaugcaucacccccaaugguuccauuccuaacgauaagccauuucagaaugugaaccgaaucacguacgggcccuguccuagauaugucaaacagaauacucuuaagcuggcaacaggaaugaggaacguuccagagaaacaaacccggggcauauucggcgccauugcuggguuuaucgaaaauggaugggaggguaugauggacggcugguacggguuccgucaccagaacucugagggaacuggccaggccgcagaucuaaagagcacacaagcugccaucaaucagauuaacgguaaacucaaucgccugaucgaaaagaccaacgagaaguuucaucagauugaaaaagaguucucagaaguggaggggagaauacaggacuuagagaaguauguagaagauacgaaaaucgaccuguggaguuacaaugcggagcuccuuguggcccuggaaaaccaacacaccauugauuugacagacuccgagaugaacaagcuauucgaaaggacuaaaaagcagcugcgggagaaugcagaggauaugggcaacggaugcuuuaagaucuaucauaaaugugacaaugcuugcaucggcagcauucgaaacgggaccuacgaucacgacgucuaccgcgacgaagcccucaauaacagauuccagauaaagggaguggagcugaaaucugguuauaaggauuggauccuuuggauuucauuugcuaucaguugcuuccuguuguguauuguucuccugggcuuuaucaugugggccugccagaaagggaauauaagguguaacaucugcauuuga

SEQ ID NO: 123710 - RNA, 1698 nt, Artificial Sequence; identical to SEQ ID NO: 122886
  derived and/or modified sequence opt3 from hemagglutinin__InfluenzaA__ABR28834

SEQ ID NO: 123711 - RNA, 1698 nt, Artificial Sequence; identical to SEQ ID NO: 122857
  derived and/or modified sequence opt3 from hemagglutinin__InfluenzaA__ABR28845

SEQ ID NO: 123712 - RNA, 1701 nt, Artificial Sequence
  derived and/or modified sequence opt3 from hemagglutinin__InfluenzaA__ABR28856
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucauaaugcccaacaaugagaaguuugauaaauuguauaucuggggagugcaucacccuggcacggacagcgaucagauuucucuguacgcccaggcuuccggcagaguaacuguuucaaccaagaggagccaacagacagugaucccaaacauugggagucggcccuggguccgcggagugucuuccagaaucagcauauacuggacuauugugaaaccuggugacauccuacucauuaacucgaccggcaaucugaucgccccaaggggguauuucaagauccggucuggaaaguccucaauuaugcgcagugacgcgccgauaggcaaauguaacagcgaaugcaucacacccaaugguuccauuccuaacgauaagccauuucagaaugucaaccgaaucaccuacggggcaugucccagauauguuaaacagaagacgcuuaaacuggccacuggaaugaggaaugugccugagaagcaaacacggggcauauucggcgcuauugccggguuuaucgaaaacggaugggaggguaugauggacggcugguacggguuccgucaccaaaauucugagggaaccggccaggcagcugauuugaaaagcacucaggccgcgaucaaccagauuaaugguaagcucaaccgccugaucgaaaagacaaaugagaaauuucaucagauugaaaaggaguucucagaaguagaggggagaauacaggacuuagagaaauauguggaagauaccaagaucgaccuguggaguuacaacgccgagcuccuugucgcacuggaaaaucaacacacgauugauuugaccgacuccgagaugaacaaacuauucgaaaggacaaagaagcagcugcgggagaacgcugaggauaugggcaauggaugcuuuaaaaucuaucauaagugugacaacgccugcaucggcagcauucgaaaugggacuuacgaucacgacguguaccgcgacgaagcucucaacaauagauuccagauaaaaggaguugagcugaagucugguuauaaagauuggauccuuuggauuucauuugccaucaguugcuuccuguuguguauugugcuccugggcuuuaucaugugggcaugccagaaggggaacauaagguguaauaucugcauuuga

SEQ ID NO: 123713 - RNA, 1701 nt, Artificial Sequence; identical to SEQ ID NO: 122623
  derived and/or modified sequence opt3 from hemagglutinin__InfluenzaA__ABR28867

SEQ ID NO: 123714 - RNA, 1701 nt, Artificial Sequence; identical to SEQ ID NO: 122578
  derived and/or modified sequence opt3 from hemagglutinin__InfluenzaA__ABR28878

SEQ ID NO: 123715 - RNA, 1698 nt, Artificial Sequence; identical to SEQ ID NO: 123220
  derived and/or modified sequence opt3 from hemagglutinin__InfluenzaA__ABR28900

SEQ ID NO: 123716 - RNA, 1701 nt, Artificial Sequence
  derived and/or modified sequence opt3 from hemagglutinin__InfluenzaA__ABR28922
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagagugucuauuuacuggaccaucgucaaaccaggugacauucugcuaaucaauuccacgggcaaccucaucgccccgaggggguacuuuaagauucggagcggaaagucgucuauaaugcgcuccgacgcgcccaucggcaaauguaauucagagugcauuacuccuaacgguaguaucccaaaugauaagcccuuccagaacgugaaucgaauaacauauggggcauguccuagauacgugaaacagaacacccugaaacuugccacuggaaugaggaaugucccagaaaagcaaacacggggcauuuuuggcgcuaucgccggguucaucgagaacggaugggaagguaugguugacggcugguauggguuucgucaccagaauagcgagggaauuggccaggcagcugaucugaaguccacccaagccgcgaucaaccagauuaaugguaaauugaaccgccucauagggaagacgaacgagaaguuccaccagaucgaaaaagaguucucugaaguggagggcaggauucaggaccuggaaaaguacguagaggauaccaaaaucgacuuauggagcuauaaugccgagcugcucguggcacuugaaaaccaacauacaaucgaucugacugacucagagaugaauaaguuguuugaaagaaccaaaaagcagcuacgggagaacgcugaagauaugggaaauggcugcuucaagauuuaccacaaaugugacaacgccugcauagggaguauccgaaauggaacauaugaucaugacgucuaccgcgacgaggcucugaacaauagauuucagauuaaggguguggagcucaaauccggcuacaaggauuggauccuguggauuagcuucgccaucucuugcuuucuucuguguguugcauugcucggguucauaaugugggccugccagaaaggaaacaucagguguaauauuugcaucuga

SEQ ID NO: 123717 - RNA, 1701 nt, Artificial Sequence; identical to SEQ ID NO: 123597
  derived and/or modified sequence opt3 from hemagglutinin__InfluenzaA__ABR88080

SEQ ID NO: 123718 - RNA, 1701 nt, Artificial Sequence
  derived and/or modified sequence opt3 from hemagglutinin__InfluenzaA__ABS00315
augaaggccaaacugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucagucgccggcuggauccuggggaacccugagugcgaaaguuuguuuagcaaaaaguccuggucuuauauugcagagacaccaaauucggaaaacggaaccuguuacccgggcuauuucgccgauuacgaggagcucagggaacaacugucaagcgugaguuccuuugagcgguucgaaaucuuucccaaggagucuagcuggccuaaucauacuguuacaaaagguguguccgcuucaugcagucacaaggggcgcagcucuuucuaucgaaaccugcucugguuaaccgagaaaaauggauccuacccaaaccugucaaagagcuaugucaauaacaaagaacgugaggugcuuguauuguggggcguucaucaccccaguaauauuggcgaacagagagcaaucuaccacacggagaacgccuacgugucugucguguccagccauuauaacaggcgguuuacuccugaaauagcuaagcgcccaaaggugagagggcaggagggaaggaucaauuacuauuggacccugcuagagcccggugacacaauuaucuucgaagccaacggcaaucucauugcgccuugguacgcauuugcccugucgcggggguucggaucuggcaucauaacuuccaacgcuucaauggaugagugugacgccaaaugccagaccccacaaggugcaauuaauaguagccuuccguuucagaacguccaccccguuacaaucggggaauguccuaaguaugugcgcuccaccaaacugcgaaugguaacgggauugagaaauauuccaucuauccagagcaggggccucuucggcgcuaucgccggguuuauugagggagguuggacuggcaugauagaugggugguacggauaucaucaccagaacgaacaaggcucagguuacgcggccgaccagaagaguacacagaaugcaaucaacgggauuaccaauaaagugaacuccgucaucgagaagaugaauacucaguucacagcugugggcaaagaguucaacaagcuggaacggcguauggagaauuuaaacaagaaaguugaugacggauuucuggauauauggaccuacaacgccgaacuccuugugcuguuggagaaugaacgcacgcuagacuuccacgacagcaacgucaagaaucuguaugagaaagugaagucucaacucaaaaacaaugcuaaggagauuggcaacgggugcuuugaguucuaccauaaguguaauaacgaaugcauggaaucaguuaaaaauggaaccuaugauuaccccaaguauagugaggagagcaaacugaacagagaaaagaucgacgguguaaaacuugaguccaugggcguguaccagauccuggccauuuauucuacagucgcaucgagcuuggugcuccuggucuccuuaggggccaucucauuuuggaugugcaguaauggaucucugcaguguaggauuugcauauga

SEQ ID NO: 123719 - RNA, 1701 nt, Artificial Sequence
  derived and/or modified sequence opt3 from hemagglutinin__InfluenzaA__ABS00326
augaaggccaaacugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucagucgccggcuggauccuggggaacccugagugcgaaaguuuguuuagcaaaaaguccuggucuuauauugcagagacaccaaauucggaaaacggaaccuguuacccgggcuauuucgccgauuacgaggagcucagggaacaacugucaagcgugaguuccuuugagcgguucgaaaucuuucccaaggagucuagcuggccuaaucauacuguuacaaaagguguguccgcuucaugcagucacaaggggcgcagcucuuucuaucgaaaccugcucugguuaaccgagaaaaauggauccuacccaaaccugucaaagagcuaugucaauaacaaagaaaaggaggugcuuguauuguggggcguucaucaccccaguaauauuggcgaacagcgugcaaucuaccacacggagaacgccuacgugucugucguguccagccauuauaacagaagguuuacuccugaaauagcuaagcggccaaaagugcgcgggcaggagggaagaaucaauuacuauuggacccugcuagagcccggugacacaauuaucuucgaagccaacggcaaucucauugcgccuugguacgcauuugcccugucgaggggguucggaucuggcaucauaacuuccaacgcuucaauggaugagugugacgccaagugccagaccccacaaggugcaauuaauaguagccuuccguuucagaacguccaccccguuacaaucggggaauguccuaaauaugugcgguccaccaagcugcgcaugguaacgggauugcgaaauauuccaucuauccagagcagaggccucuucggcgcuaucgccggguuuauugagggagguuggacuggcaugauagaugggugguacggauaucaucaccagaacgaacaaggcucagguuacgcggccgaccagaaaaguacacagaaugcaaucaacgggauuaccaauaaggugaacuccgucaucgagaaaaugaauacucaguucacagcugugggcaaggaguucaacaagcuggaaaggcggauggagaauuuaaacaaaaagguugaugacggauuucuggauauauggaccuacaacgccgaacuccuugugcuguuggagaaugaacguacgcuagacuuccacgacagcaacgucaaaaaucuguaugagaaggugaaaucucaacucaagaacaaugcuaaggagauuggcaacgggugcuuugaguucuaccauaaauguaauaacgaaugcauggaaucaguaaagaauggaaccuaugauuaccccaaauauagugaggagagcaagcugaaccgcgaaaagaucgacgguguuaaacuugaguccaugggcguguaccagauccuggccauuuauucuacagucgcaucgagcuuggugcuccuggucuccuuaggggccaucucauuuuggaugugcaguaauggaucucugcaguguagaauuugcauauga

SEQ ID NO: 123720 - RNA, 1701 nt, Artificial Sequence; identical to SEQ ID NO: 123656
  derived and/or modified sequence opt3 from hemagglutinin__InfluenzaA__ABS49899

SEQ ID NO: 123721 - RNA, 1701 nt, Artificial Sequence
  derived and/or modified sequence opt3 from hemagglutinin__InfluenzaA__ABS49910
augaagaccaucauugcccugagcuacauauucugccucgcucuuggccaggaccugcccgggaacgauaauuccacagcaacuuuguguuuaggacaccaugccgugccuaacgguacgcuggucaaaaccaucacaaaugaccaaauugagguuacuaacgcgaccgaacuugugcagucuucaaguacaggcaagaucugcaauaacccacacaggauucucgaugggaucaauuguacccugauagacgcucuacugggagauccgcauugcgacguauuucaggaugagacuugggacuuguucguggaaagaagcaaagccuuuuccaacuguuaucccuacgaugucccugacuaugcaucucuccggucgcugguggccucaagcggcacacuggaguucaucaccgaagguuuuacguggacugggguuacccagaauggaggcaguaacgcuugcaagcgcggcccaggguccggauucuuuucucgacucaauugguuaacaaaaagcgguuccacuuaccccgugcugaacgucaccaugccuaauaacgauaauuucgacaaguuguauauuuggggcgugcaccauccaucaacaaaccaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugaugugcuagucauuaauuccaacgggaaucucaucgccccgaggggauacuuuaaaaugcggacuggcaagagcucgaucaugcgcucugacgcucccauugacacauguauauccgagugcaucaccccuaacggcucaauuccaaaugauaaacccuuccagaacguuaauaagaucacguacggggccuguccuaaauaugugaagcagaacacccugaaacuugcgacaggaaugcgaaauguaccagaaaagcagacuagaggucuguuuggcgcaauagccggguucauugagaacggaugggaaggcaugaucgacgguugguacggguuuaggcaccaaaauagugagggcaccggacaggcugccgaucuuaagagcacacaggcagcuaucgaccaaauuaacggcaaacucaaucgggugaucgagaagacuaacgaaaaauuccaccagauugagaaggaguucuccgaagucgaagggcguauacaggaucuggagaaauauguggaggacaccaagaucgauuuauggucuuacaaugccgaacugcucguugcgcuugagaaccagcauacaauugaccugaccgauagcgaaaugaacaaguuguuugagaaaacucgcagacaaaugagggaaaaugccgaggacaugggaaacgguugcuucaagaucuaucacaaaugugauaaugcaugcaucgagucaauucggaacggcacguacgaccaugacguguaucgagaugaagcucuaaauaaccgcuuucagauaaagggggucgagcugaaaaguggauacaaggacuggauccucuggauuuccuucgccaucagcugcuuucugcuuugugugguacuguugggcuucauuaugugggcuugccagagagguaauaucagguguaacauaugcaucuga

SEQ ID NO: 123722 - RNA, 1701 nt, Artificial Sequence; identical to SEQ ID NO: 122666
  derived and/or modified sequence opt3 from hemagglutinin__InfluenzaA__ABS49965

SEQ ID NO: 123723 - RNA, 1698 nt, Artificial Sequence
  derived and/or modified sequence opt3 from hemagglutinin__InfluenzaA__ABS49976
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggaggugcuaguucucuggggcgugcaucacccuccaaacaucgggaaccagcgcgcccuguaccacacugaaaaugcuuaugucuccguggugucaagccauuacagucgacguuucacccccgagauagcaaaaagaccuaaggucagggaucaggaaggacggaucaacuauuacuggacacuucuggagccaggugacacuauuaucuuugaggccaauggcaacuugauugcuccgcgcuaugccuucgcgcucucuagaggguuuggauccggcaucauaaccagcaaugcacccauggaugaaugugacgccaagugccagacaccucaaggugcuauuaacucgucucugccauuccagaauguucaccccgugaccaucggggaguguccuaaauacguaagguccgccaaguuacggauggugacgggacugcgcaacauuccaucaauccagagucgaggccucuuuggcgcaaucgcuggguucauugaaggagguuggacuggcauggucgaugggugguauggauaccaucaccagaaugagcaaggcagcgguuacgccgcggaccagaaauccacacagaacgccauaaaugggaucaccaacaagguaaauucuguuauugaaaagaugaacacucaguuuacagcagugggcaaagaguucaauaaacuugagagaaggauggaaaaccugaacaagaaggucgaugacggauucuuggauaucuggaccuauaaugcugagcuacuggugcuccuggaaaacgagcggacgcuugacuuucacaauagcaacguuaaaaaucuguacgaaaagguaaaaucacaauugaagaacaaugccaaagagauaggcaacgggugcuucgaguuuuaucauaaguguaauaacgaaugcauggagagugugaagaauggaaccuacgacuaucccaaauacuccgaagagagcaagcucaaccgugagaaaauugauggugucaagcuggaaucuaugggcguguaucagaucuuagcuaucuacucaacagucgccaguagccuggugcuacucguuucccugggggcaauuucuuucuggaugugcucgaauggaagccuucagugucgcaucugcauuuga

SEQ ID NO: 123724 - RNA, 1698 nt, Artificial Sequence
  derived and/or modified sequence opt3 from hemagglutinin__InfluenzaA__ABS49987
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuaugccuucgcgcucucuagaggguuuggauccggcaucauaaccagcaacgcacccauggacgaaugugaugccaagugccagacaccucaaggugcuauuaauucgucucugccauuccagaacguucaccccgugaccaucggggaguguccuaaauacguaagguccgccaaguuacggauggugacgggacugcgcaauauuccaucaauccagagucgaggccucuuuggcgcaaucgcuggguucauugaaggagguuggacuggcauggucgacgggugguauggauaccaucaccagaacgagcaaggcagcgguuacgccgcggaucagaaauccacacagaaugccauaaacgggaucaccaauaaggugaacucuguuauugaaaagaugaauacucaguuuacagcagugggcaaagaguucaacaaacuugagagaaggauggaaaaucugaacaagaaggucgacgauggauucuuggacaucuggaccuauaacgcugagcuacuggugcuccuggaaaaugagcggacgcuugacuuucacgauagcaacaugaaaaaucuguacgaaaagguaaaaucacaauugaagaacaaugccaaagagauaggcaacgggugcuucgaguuuuaucauaaguguaauaacgaaugcauggagaguguuaagaauggaaccuacgacuaucccaaauacuccgaagagagcaagcucaaccgugagaaaauugauggugugaagcuggaaucuaugggcgucuaucagaucuuagcuaucuacucaacaguggccaguagccugguccuacucgugucccugggggcaauuucuuucuggaugugcucgaauggaagccuucagugucgcaucugcauuuga

SEQ ID NO: 123725 - RNA, 1701 nt, Artificial Sequence
  derived and/or modified sequence opt3 from hemagglutinin__InfluenzaA__ABS49998
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugauaaugcccaauaacgagaaguuugacaaauuguauaucuggggcguccaucacccuagcacggauucugaccagauuucccuguacgcucaggccccaggccgugugacuguaucaaccaagagaagccaacagacaguuauccccaacauugggaguaggccuugggugcggggagucucuucccgcaucagcauauacuggacuauugugaaaccaggugauauccuacucauuaauuguaccggcaaccugaucgcgccgagaggguauuucaagaucaggucgggaaagucuuccauuaugcggucagacgcaaguauaggcaaaugcaauagcgaauguaucacacccaacgguuccauuccuaaugacaagccauuucagaacgugaaucgcaucaccuacggggccugcccccgauaugucaaacagaacacgcuuaagcuggcuacuggaaugagaaauguuccugagaaacaaacaaggggcauauucggcgccauugcaggguuuaucgaaaacggaugggaggguaugguggauggcugguacggguuccggcaccaaaauucugagggaaccggccaggcugccgacuugaaaagcacucaggcggccaucaaccagauuaaugguaaacucaaccgucugaucgaaaagacaaaugagaaguuucaucagauugaaaaagaguucucagaaguagaggggcgcauacaggauuuagagaaguauguggaagacaccaaaaucgaucuguggaguuacaacgcagagcuccuugucgcucuggaaaaccaacacacgauugacuugaccgauuccgagaugaauaagcuauucgaaagaacaaagaagcagcugagggagaacgccgaggacaugggcaauggauguuuuaagaucuaucauaaaugcgauaacgcuugcaucggcagcauucggaaugggacuuacgaccacgauguguaccgagacgaagcccucaacaaucgcuuccagauaaagggaguugagcugaaaucugguuauaaggacuggauccuuuggauuucauuugcaaucaguuguuuccuguugugcgugguccuccugggcuuuauuaugugggccugucagaaagggaacaucagaugcaauauauguaucuga

SEQ ID NO: 123726 - RNA, 1701 nt, Artificial Sequence
  derived and/or modified sequence opt3 from hemagglutinin__InfluenzaA__ABS50009
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuuccaaaauuagcaucuacuggaccauagugaagccaggugauauucuacucaucaauuguacaggcaaccugauugcgccgcgcggguauuucaagaucagaucgggaaaaucuuccaucaugaggucagacgcaaguauuggcaagugcaauagcgaauguauaacccccaacgguuccaucccuaaugacaaaccauuucagaacgugaaucggauuacguacggggccugcccccgcuaugucaagcagaacacucuuaaacuggcuacaggaaugcgaaauguuccugagaagcaaaccagaggcaucuucggcgccauagcaggguuuauugaaaacggaugggaggguaugguggauggcugguacggguucaggcaccaaaauucugagggaacuggccaggcugccgacuugaaaagcacacaggcggccaucaaccagaucaaugguaagcucaaccggcugauugaaaagaccaaugagaaauuucaucagaucgaaaaggaguucucagaaguagaggggcguauucaggauuuagagaaauauguggaagacacgaagauagaucuguggaguuacaacgcagagcuccuugucgcucuggaaaaccaacacaccaucgacuugacagauuccgagaugaauaaacuauucgaacgcacuaagaagcagcugagagagaacgccgaggacaugggcaauggauguuuuaaaauuuaucauaagugcgauaacgcuugcaucggcagcaucaggaaugggaccuacgaccacgauguguaccgggacgaagcccucaacaaucgauuccagauuaaaggaguugagcugaagucugguuauaaagacuggauacuuuggaucucauuugcaauuaguuguuuccuguugugcgugguccuccugggcuuuaucaugugggccugucagaaggggaacauucgcugcaauaucuguauauga

SEQ ID NO: 123727 - RNA, 1701 nt, Artificial Sequence; identical to SEQ ID NO: 122726
  derived and/or modified sequence opt3 from hemagglutinin__InfluenzaA__ABS50020

SEQ ID NO: 123728 - RNA, 1701 nt, Artificial Sequence
  derived and/or modified sequence opt3 from hemagglutinin__InfluenzaA__ABS50031
augaagaccaucauugcccugagcuacaugcucugccuuguguucgcucagaaacugcccggcaacgacaauuccacagcaauguuguguuuagggcaccaugccgucccuaacggaacucugguuaagacgauaaccaaugaucaaaucgaggugacaaacgcgacugaacuuguacagucuucaaguaccgguggcauuugcgacagcccacaccagauccucgauggggagaauuguacacugauugacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacccuggaauuuaacaaugaguccuucaacuggacugggguugcucaaaauggaacaucuagcgcaugcaaacggcgcuccaacaagucauuuuucagucgacucaauugguuacaccagcugaaguauaaauacccagcccuuaacgugaccaugcccaauaacgagaaguuugacaaauuguauaucuggggcguccaucacccuagcacggauucugaccagauaucccuguacgcucaggccccaggccgugugacuguaucaaccaagagaagccaacagacaguuauccccaacauugggaguggaccuugggugaggggugucucuucccggaucagcauuuacuggacuaucgugaaaccaggcgauauacuacucauuaauuguaccgggaaccugaucgcgccgcgcggauauuucaagauuagaucgggcaagucuuccaucaugaggucagacgcaaguaucgguaaaugcaauagcgaauguauuacacccaacggguccauaccuaaugacaagccauuucagaacgugaaucggaucaccuacggagccugcccccgcuaugucaaacagaacacgcuuaagcuggcuacuggcaugcgaaauguuccugagaaacaaacaagaggcauuuucggggccaucgcaggauuuauagaaaacgguugggagggcaugguggaugggugguacggauucaggcaccaaaauucugagggcaccggucaggcugccgacuugaaaagcacucaggcggccauuaaccagaucaaugggaaacucaaccggcugaucgaaaagacaaaugagaaguuucaucagauugaaaaagaguucucagaaguagagggccguauccaggauuuagagaaguauguggaagacaccaaaauugaucuguggaguuacaacgcagagcuccuugucgcucuggaaaaccaacacacgauagacuugaccgauuccgagaugaauaagcuauucgaacgcacaaagaagcagcugagagagaacgccgaggacaugggaaauggcuguuuuaagaucuaucauaaaugcgauaacgcuugcauugggagcaucaggaauggaacuuacgaccacgauguguaccgggacgaagcccucaacaaucgauuccagaucaaggguguugagcugaaaucuggcuauaaggacuggauucuuuggauaucauuugcaaucaguuguuuccuguugugcgugguccuccugggguuuauuaugugggccugucagaaaggaaacauccgcugcaauauuuguaucuga

SEQ ID NO: 123729 - RNA, 1701 nt, Artificial Sequence; identical to SEQ ID NO: 122067
  derived and/or modified sequence opt3 from hemagglutinin__InfluenzaA__ABS50042

SEQ ID NO: 123730 - RNA, 1701 nt, Artificial Sequence; identical to SEQ ID NO: 123709
  derived and/or modified sequence opt3 from hemagglutinin__InfluenzaA__ABS50053

SEQ ID NO: 123731 - RNA, 1701 nt, Artificial Sequence
  derived and/or modified sequence opt3 from hemagglutinin__InfluenzaA__ABS50064
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacgggcccuguccuagauauguuaaacagacuacacuuaagcuggcaaccggaaugaggaaugugccagagaaacaaacucggggcaucuucggcgccauagcuggguuuauugaaaacggaugggaggguaugauggacggcugguacggguuccgucaccagaauagcgagggaacaggccaggccgcagauuugaagucuacccaagcugccaucaaccagaucaaugguaaacucaaccgccugauugaaaagacgaaugagaaguuucaucagaucgaaaaagaguucucagaaguagaggggaggauucaggacuuagagaaguauguggaagauaccaaaauagaccuguggaguuacaacgcggagcuccuugucucccuggaaaaucaacacacaaucgauuugacugacagcgagaugaacaagcuauucgaaagaaccaaaaagcagcugcgggagaacgccgaggauaugggcaauggaugcuuuaagauuuaucauaaaugugacaacgcaugcaucggcucuauccgaaaugggacauacgaucacgacguguaccgcgacgaagcucucaacaauagauuccagauuaagggaguugagcugaaaucagguuauaaggauuggauacuuuggaucaguuuugccauuagcugcuuccuguuguguaucgugcuccugggcuuuauuaugugggcuugccagaaagggaacaucagguguaauauaugcaucuga

SEQ ID NO: 123732 - RNA, 1701 nt, Artificial Sequence
  derived and/or modified sequence opt3 from hemagglutinin__InfluenzaA__ABS50075
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacacaaaauccuagauggggagaauuguacccucauagacgcucugcuuggagauccgcagugcgacggcuuucagaacaagaaaugggaucuguucguggaaagauccaaggccuauucuaauuguuaccccuaugacgucccugauuacgcaucguugaggucacucaucgccagcagugguacucuggaguuuaacaaugaauccuucaacuggacaggggugacccaaaauggaacgucuagcgcuugcaagcggcgcuccaacucaaguuucuucagccgacugaauuggcucacucauuuaaaauuuaaguauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccagcaaacagugaucccaaauauaggaaguaggccccggguacgcgacauuccuucuagaaucuccauuuacuggaccaucguuaaaccaggugauauccugcuaauuaacagcacgggcaaucucauagccccgaggggguauuuuaagauccggucgggaaagucuuccauuaugcgcucagacgcgcccaucggcaaauguaacagugaaugcauaacuccuaaugguagcauuccaaacgacaagcccuuccagaaugugaaccgaaucacauacggggcauguccuagauaugucaaacagaauacccugaaacuugccacuggaaugaggaacgugccagagaagcagacacggggcaucuuuggcgcuauugccggguucaucgaaaauggaugggaggguaugguggauggcugguacggguuucgucaccaaaacuccgagggaauuggccaggcagcugaccugaagucuacccaggccgcgauagaucaaaucaaugguaaauugaaccgccucauugggaagacgaaugaaaaguuccaccagaucgagaaagaauuuagcgaggucgaaggcagaauccaggaccuggagaaguauguugaggauaccaaaauugacuuauggucauacaacgccgaacugcucguggcacuugagaaccagcauacaauagaucugacugacagugaaaugaauaaguuguuugagaggaccaaaaagcaacuacgggaaaacgcugaggauaugggaaauggcugcuucaagaucuaucacaaaugugacaacgccugcauuggguccauccgaaauggaacauacgaucaugacguauaccgcgacgaggcucugaacaauagauuucagauuaaggguguggaacucaaaagcggcuauaaggauuggauccuguggauaucuuucgccaucucaugcuuucuucugugugucgcauugcucggguucauuaugugggccugccagaaaggaaacaucagguguaauauuugcaucuga

SEQ ID NO: 123733 - RNA, 1698 nt, Artificial Sequence
  derived and/or modified sequence opt3 from hemagglutinin__InfluenzaA__ABS71665
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaaagucucauuagcagagaguccuggucuuacaucguugaaaaaccaucgccggagaauggaaccuguuaucccggccauuuugcugacuacgaggaacugagggagcaacugucaagcgugaguuccuucgaacgguuugagauuuucccuaaggagucuagcuggccaaaccacacugccacaggugucuccgcaucaugcagucauaauggggaaagcucuuuuuauaagaaccucuuauggcugaccggcaaaaauggacuuuaccccaacuuguccaagucauaugccaauaacaaagagaaggaagugcugguacuauggggcguucaccacccuccaaauaucggggaucagcgcgcucucuaccauacggagaacgcauacgugagcgucgugaguucucacuauucccgaaaauucacucccgaaauagccaagcguccuaaggugagagaccaggagggaaggaucagcuacuauuggacccugcuugagccaggugauacaauuaucuuugaagcuaacggcaaucugauugccccgcgguacgcguucgcauugucgcgcggguuuggaucuggcaucauaaacuccaaugcccccauggacgagugugaugcuaaaugccagacuccucaaggugccauuaacucaagucucccauuccagaauguccaucccguuaccaucggggaauguccuaaguaugugagaagcgcaaaacugaggaugguaacaggauuacggaacauuccauccauccagucucgcggccuguuuggcgcuaucgccggguucauugagggagguuggaccggcaugguggacgggugguacggauaucaccaccagaaugaacaaggcagcgguuacgcggccgaucagaagucaacgcagaacgcaauaaaugggaucacuaacaaagucaauagugugauugagaagaugaacacacaguuuaccgcuguuggcaaagaguucaauaagcucgaacgaagaauggagaaccuuaauaagaaaguggacgauggauucaucgacauauggacuuacaacgccgaacuguugguccuacuggagaacgaaaggacacucgacuuucaugauuccaaugugaagaaccuguaugagaaaguaaagagccaacuuaaaaauaacgcuaaggagauuggcaaugggugcuucgaauuuuaccacaaguguaacgacgagugcauggaaucuguuaaaaauggaaccuaugauuaccccaaguauucagaggagaguaaacugaaccgggaaaagaucgacggugugaaauuggagagcaugggcgucuaccagauccucgccauuuauuccacgguggcaucuucgcuggucuuacuggugagccuaggggccaucuccuucuggaugugcucaaauggaagucuccagugucguauuugcauauga

SEQ ID NO: 123734 - RNA, 1698 nt, Artificial Sequence
  derived and/or modified sequence opt3 from hemagglutinin__InfluenzaA__ABS71666
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaaagucucauuagcagagaguccuggucuuacaucguugaaaaaccaucgccggagaauggaaccuguuaucccggccauuuugcugacuacgaggaacugagggagcaacugucaagcgugaguuccuucgaacgguuugagauuuucccuaaggagucuagcuggccaaaccacacugccacaggugucuccgcaucaugcagucauaaugggaaaagcucuuuuuauaaaaaccucuuauggcugaccggaaagaauggccuuuaccccaacuuguccaaaucauaugccaauaacaaggaaaaagaggugcugguacuauggggcguucaccacccuccaaauaucggggaucagcgcgcucucuaccauacggaaaacgcauacgugagcgucgugaguucucacuauucccgaaaguucacucccgagauagccaagcguccuaaagugagagaccaggaaggaaggaucagcuacuauuggacccugcuugagccaggugauacaauuaucuuugaggcuaacggcaaucugauugccccgcgguacgcguucgcauugucgcgcggguuuggaucuggcaucauaaacuccaaugcccccauggacgaaugugaugcuaagugccagacuccucaaggugccauuaacucaagucucccauuccagaauguccaucccguuaccaucggggaguguccuaaauaugugagaagcgcaaagcugaggaugguaacaggauuacggaacauuccauccauccagucucgcggccuguuuggcgcuaucgccggguucauugaaggagguuggaccggcaugguggacgggugguacggauaucaccaccagaaugagcaaggcagcgguuacgcggccgaucagaaaucaacgcagaacgcaauaaaugggaucacuaacaaggucaauagugugauugaaaagaugaacacacaguuuaccgcuguuggcaaggaguucaauaagcucgagcgaagaauggaaaaccuuaauaaaaagguggacgauggauucaucgacauauggacuuacaacgccgagcuguugguccuacuggaaaacgagaggacacucgacuuucaugauuccaaugugaaaaaccuguaugaaaagguaaaaagccaacuuaagaauaacgcuaaggagauuggcaaugggugcuucgaguuuuaccacaaauguaacgacgaaugcauggagucuguuaagaauggaaccuaugauuaccccaaauauucagaagagaguaagcugaaccgggagaaaaucgacggugugaaguuggaaagcaugggcgucuaccagauccucgccauuuauuccacgguggcaucuucgcuggucuuacuggugagccuaggggccaucuccuucuggaugugcucaaauggaagucuccagugucguauuugcauauga

SEQ ID NO: 123735 - RNA, 1698 nt, Artificial Sequence
  derived and/or modified sequence opt3 from hemagglutinin__InfluenzaA__ABS71667
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaaagucucauuagcagagaguccuggucuuacaucguugaaaaaccaucgccggagaauggaaccuguuaucccggccauuuugcugacuacgaggaacugagggagcaacugucaagcgugaguuccuucgaacgguuugagauuuucccuaaggagucuagcuggccaaaccacacugccacaggugucuccgcaucaugcagucauaaugggaaaagcucuuuuuauaaaaaccucuuauggcugaccggaaagaauggccuuuaccccaacuuguccaaaucauaugccaauaacaaggaaaaagaggugcugguacuauggggcguucaccacccuccaaauaucggggaucagcgcgcucucuaccauacggaaaacgcauacauaagcguggucaguucucacuauucccgaaaguucacucccgagaucgccaagcguccuaaagugagagaccaggaaggaaggauuagcuacuauuggacccugcuugagccaggugauacaaucauuuuugaggcuaacggcaaucugaucgccccgcgguacgcguucgcauugucgcgcggguuuggaucuggcauaauuaacuccaaugcccccauggacgaaugugaugcuaagugccagacuccucaaggugccaucaacucaagucucccauuccagaaugugcaucccgucaccauuggggaguguccuaaauauguuagaagcgcaaagcugaggauggugacaggauuacggaacaucccauccauccagucucgcggccuguuuggcgcuauugccggguucauagaaggagguuggaccggcaugguagacgggugguacggauaucaccaccagaaugagcaaggcagcgguuacgcggccgaucagaaaucaacgcagaacgcaaucaaugggauuacuaacaaggugaauagugucaucgaaaagaugaacacacaguuuaccgcugugggcaaggaguucaauaagcucgagcgaagaauggaaaaccuuaauaaaaagguugacgauggauucauagacauuuggacuuacaacgccgagcuguuggugcuacuggaaaacgagaggacacucgacuuucaugauuccaaugucaaaaaccuguaugaaaaggugaaaagccaacuuaagaauaacgcuaaggagaucggcaaugggugcuucgaguuuuaccacaaauguaacgacgaaugcauggagucuguaaagaauggaaccuaugauuaccccaaauauucagaagagaguaagcugaaccgggagaaaaucgacgguguuaaguuggaaagcaugggcguguaccagauucucgccaucuauuccacggucgcaucuucgcugguguuacuggucagccuaggggccauuuccuucuggaugugcucaaauggaagucuccagugucguauaugcaucuga

SEQ ID NO: 123736 - RNA, 1698 nt, Artificial Sequence
  derived and/or modified sequence opt3 from hemagglutinin__InfluenzaA__ABS71668
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaaagucucauuagcagagaguccuggucuuacaucguugaaaaaccaucgccggagaauggaaccuguuaucccggccauuuugcugacuacgaggaacugagggagcaacugucaagcgugaguuccuucgaacgguuugagauuuucccuaaggagucuagcuggccaaaccacacugccuccggugucucagcaaguugcagccauaaugggaagucuuccuuuuauaaaaaccucuuauggcugacaggaaagaauggccuuuaccccaacuugucaaaaagcuaugccaauaacaaggaaaaagaggugcugguacuauggggcguucaccacccuccaaauaucggggaucagcgcgcucucuaccauaccgaaaacgcauacgugagugucgugucuucccacuauagccgaaaguucacgcccgagauagccaagcguccuaaagugagagaccaggaaggaaggaucaacuacuauuggacucugcuugagccaggugauaccauuaucuuugaggcuaauggcaaccugauugccccgcgguacgcguucgcauugucgcgcggguuuggaucuggcaucauaaauuccaacgcccccauggacgaaugugaugcuaagugccagacaccucaaggugccauuaauucaagucucccauuccagaacguccaucccguuacuaucggggaguguccuaaauaugugagaagcgcaaagcugaggaugguaaccggauuacggaauauuccauccauccagucucgcggccuguuuggcgcuaucgccggguucauugaaggagguuggacaggcaugguggacgggugguacggauaucaccaccagaacgagcaaggcagcgguuacgcggccgaucagaaaucaacccagaaugcaauaaacgggaucacgaauaaggucaacagugugauugaaaagaugaauacucaguuuacagcuguuggcaaagaguucaacaagcucgagcgaagaauggaaaaucuuaacaaaaagguggacgauggauucaucgacauauggaccuacaacgccgagcuguugguccuacuggaaaaugagaggacucucgacuuucaugauuccaacgugaaaaaucuguaugaaaagguaaaaagccaacuuaagaacaaugcuaaggagauuggcaacgggugcuucgaguuuuaccacaaauguaaugacgaaugcauggagucuguuaagaacggaacauaugauuaccccaaauauucagaagagaguaagcugaaucgggagaaaaucgacggugugaaguuggaaagcaugggcgucuaccagauccucgccauuuauuccaccguggcaucuucgcuggucuuacuggugagccuaggggccaucuccuucuggaugugcucaaacggaagucuccagugucguauuugcauauga

SEQ ID NO: 123737 - RNA, 1698 nt, Artificial Sequence
  derived and/or modified sequence opt3 from hemagglutinin__InfluenzaA__ABS71669
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacggggaaucaaguuuuuauaaaaauuuacuguggcuuaccggaaagaacggcuuguaccccaaucugagcaaaucuuaugcaaacaauaaggagaaagaagugcuaguucucuggggcgugcaccacccuccaaacaucggggaucagaaggcccuguaccauacggagaacgcuuacgucuccguggugucaagccacuauagucggaaguucacucccgaaauagcaaaacgcccuaagguccgagaccaggagggacguaucaauuacuauuggacccuucuggagccaggugauacaauuaucuuugaagccaacggcaauuugauugcuccgagauacgccuucgcgcucucuaggggguuuggauccggcaucauaaacagcaaugcacccauggacaaaugugaugccaagugccagacuccucaaggugcuauuaacucgucucugccauuccagaauguucaucccgugaccaucggggaguguccuaaauauguacgguccgccaaguuacgcauggugacaggacugagaaacauuccaucaauccagaguaggggccucuuuggcgcaaucgcuggguucauugaaggagguuggaccggcauggucgacgggugguacggauaucaccaccagaaugagcaaggcagcgguuacgccgcggaucagaaauccacgcagaacgccauaaaugggaucacuaacaagguaaauucuguuauugaaaagaugaacacacaguuuaccgcagugggcaaagaguucaauaaacuugagcggcgcauggaaaaccugaacaaaaaggucgacgauggauucaucgacauauggacuuacaaugcugaguugcuagugcugcucgaaaacgagcgaacacuggacuuucaugauagcaauguaaagaaccuuuaugaaaagguuaagucacaacugaaaaauaacgccaaggagauuggcaaugggugcuucgaguuuuaccacaaauguaacgacgaaugcauggagagugugaagaauggaaccuaugauuaccccaaauauuccgaagagagcaaguugaacagagagaagaucgacggugucaaacucgaaucuaugggcguguaccagauccuggcuauuuauucaacggucgccaguagcuuagugcugcuaguuucccucggggcaaucucuuucuggaugugcucgaauggaagccugcaguguaggauuugcauauga

SEQ ID NO: 123738 - RNA, 1698 nt, Artificial Sequence
  derived and/or modified sequence opt3 from hemagglutinin__InfluenzaA__ABS71671
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauguucccuaaggagaguuccuggccaaaucacacugucacaggugugucugccagcugcucccauaacgggaaaucaaguuuuuauaagaauuuacuguggcuuaccggcaaaaacggauuguaccccaaucugagcaagucuuaugcaaacaauaaagaaaaggaggugcuaguucucuggggcgugcaccacccuccaaacauuggggaucagcgggcccuguaccauacggaaaacgcuuacgucuccguggugucaagccacuauagucgcaaguucacucccgagaucgcaaaacgaccuaagguccgugaccaggaaggaagaauaaauuacuauuggacccuucuggagccaggugauacaaucauuuuugaggccaacggcaauuugaucgcuccgagguacgccuucgcgcucucucggggguuuggauccggcauuaucaacagcaaugcacccauggacgaaugugaugccaaaugccagacuccucaaggugcuauaaacucgucucugccauuccagaauguucaucccgugaccauuggggaguguccuaaguauguacgcuccgccaaauuaagaauggugacaggacugaggaacaucccaucaauucagagucggggccucuuuggcgcaaucgcuggguucaucgaaggagguuggaccggcauggucgacgggugguacggauaucaccaccagaaugagcaaggcagcgguuacgccgcggaucagaaguccacgcagaacgccauuaaugggauaacuaacaaaguaaauucuguuaucgaaaagaugaacacacaguuuaccgcagugggcaaggaguucaauaaacuugagcgccgaauggaaaaccugaacaagaaagucgacgauggauucauugacaucuggacuuacaaugcugaguugcuagugcugcucgaaaacgagagaacacuggacuuucaugauagcaauguaaagaaccuuuaugaaaaaguuaagucacaacugaagaauaacgccaaagagauaggcaaugggugcuucgaguuuuaccacaaguguaacgacgaaugcauggagagugugaaaaauggaaccuaugauuaccccaaguauuccgaagagagcaaauugaacagggagaagauugacggugucaagcucgaaucuaugggcguguaccagauccuggcuaucuauucaacggucgccaguagcuuagugcugcuaguuucccucggggcaauuucuuucuggaugugcucgaauggaagccugcagugucggaucugcauuuga

SEQ ID NO: 123739 - RNA, 1698 nt, Artificial Sequence
  derived and/or modified sequence opt3 from hemagglutinin__InfluenzaA__ABS71672
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagaggcucucuucggugagcucauucgaacgguuugagauguucccuaaggagaguuccuggccaaaucacacugucacaggugugucugccagcugcucccauaacgggaaaucaaguuuuuauaagaauuuacuguggcuuaccggcaaaaacggauuguaccccaaucugagcaagucuuaugcaaacaauaaagaaaaggaggugcuaguucucuggggcgugcaccacccuccaaacauuggggcccaacgcgcucuguaccauacggaaaacgcauacgucuccguggugucaagccacuauagucgaaaguucacucccgagaucgccaaacguccuaaggucagagaucaggaaggaaggauaaauuacuauuggacccuucuggagccaggugacacaaucauuuuugaggcuaacggcaauuugaucgccccgcgguacgcguucgcacucucucgcggguuuggauccggcauuaucaacagcaaugcccccauggaugaaugugacgcuaaaugccagacuccucagggugccauaaacucgucucugccauuccaaaauguucaucccgugaccauuggggaguguccuaaguauguaagauccgcaaaauuaaggauggugacaggacugcggaacaucccaucaauucagagucgcggccucuuuggcgcuaucgccggguucaucgaaggagguuggaccggcauggucgaugggugguacggauaucaccaccagaaugagcagggcagcgguuacgcggccgaccaaaaguccacgcagaacgcaauuaaugggauaacuaacaaaguaaauucuguuaucgaaaagaugaacacacaguuuaccgcugugggcaaggaguucaauaaacuugagcgaagaauggaaaaccugaacaagaaagucgaugacggauucauugauaucuggacuuacaaugccgaguugcuagugcugcucgaaaacgagaggacacuggacuuucaugacagcaauguaaagaaccuuuaugaaaaaguuaagucacagcugaagaauaacgcuaaagagauaggcaaugggugcuucgaguuuuaccacaaguguaacgaugaaugcauggagagugugaaaaauggaaccuaugacuaccccaaguauuccgaagagagcaaauugucucgggagaagauugauggugucaagcucgaaucaaugggcguguaccaaauccuggccaucuauaguacggucgcaagcuccuuagugcugcuaguuucucucggggccauuucguucuggaugugcagcaacggaucccugcagugucguaucugcauuuga

SEQ ID NO: 123740 - RNA, 1698 nt, Artificial Sequence
  derived and/or modified sequence opt3 from hemagglutinin__InfluenzaA__ABS71673
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggcggucaaguuuuuaccgcaauuuacuguggcuuacgggaaagaacggcuuguaucccaaucugagcaaaucuuacgcaaacaauaaggaaaaagagguacuuguucucuggggcgugcaucacccuccaaacaucggggaucagcgagcccuguaccacacugaaaacaccuaugucuccguggugucaagccauuacagucguagauucacacccgagauagcuaagaggccuaaaguccgggaccaggaaggacgcaucaauuauuacuggacucuucuggagccaggugauaccauuaucuuugaggcaaacggcaauuugauugccccgagauucgcuuuugcccucucuaggggguucggauccggcaucauaacaagcaacgcgcccauggacgaaugugaugcaaagugccagaccccucaaggugccauuaauucgucucugccauuucagaacguucaccccgugacgaucggggaguguccuaaguauguacgguccgcuaaauuacgcauggccacuggacugcgaaauauuccaucaauccagaguagaggccucuucggcgcaaucgcuggguuuauugaaggagguuggacaggcaugguggacgggugguacggauaucaucaccagaacgagcaaggcagcgguuacgccgcggaucagaaguccacccagaaugccauaaacgggaucacuaauaaagucaacucugugauugaaaagaugaauacacaguucaccgcaguuggcaaagaguucagcaagcuagagaggcggauggaaaaccugaauaaaaagguggacgauggauuuuuggacaucuggacguacaacgcugagcuacugguccuccuggaaaacgagcguacccuugacuuccacgauucaaaugugaagaaccuguaugaaaaaguaaagagucaauugaaaaauaacgccaaggagauaggcaaugggugcuuugaguucuaccauaaauguaacgacgaaugcauggaguccguuaagaauggaacauaugauuaccccaaguauagcgaagagucuaaacucaaccgcgagaagauugacggugugaaacuggaaucaaugggcgucuaccagaucuuagcuaucuauaguacuguggccagcucccugguccuacucgugucucugggggcaauuucguuuuggaugugcagcaauggaucccuucaguguagaaucugcauuuga

SEQ ID NO: 123741 - RNA, 1701 nt, Artificial Sequence; identical to SEQ ID NO: 122646
  derived and/or modified sequence opt3 from hemagglutinin__InfluenzaA__ABS71674

SEQ ID NO: 123742 - RNA, 1701 nt, Artificial Sequence
  derived and/or modified sequence opt3 from hemagglutinin__InfluenzaA__ABS71675
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagcccauucuaauuguuaucccuacgacgucccugauuaugcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucacuuaaaguuuaaauacccagcacugaaugugaccaugcccaacaacgagaaguucgacaaacuuuauaucuggggcguccaucacccuggcacagauaaugaccagaucuuuuuguacgcccaggcuagcgggcguauuacugugucuaccaagagaucccaacagacaguaauuccaaacaucggaucaaggccccggguucgcaauauaccuagcagaauuaguaucuauuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauacggggcauguccuagauaugugaaacagaauacccugaagcuggccacuggaaugaggaacgugccagaaaaacaaacacggggcaucuucggcgcuaucgccggguuuauugagaauggaugggaagguauggucgauggcugguacggguuccgucaccagaacagugagggaaucggccaggcagcugaccuuaagagcacccaagccgcgauuaaucagauaaacgguaaauugaaccgccucaucgggaagacgaaugagaaguuccaucagauugaaaaagaguuuuccgaaguugagggcagaauccaggaucuggaaaaguauguggaggacaccaaaaucgauuuauggucuuacaacgccgagcugcucguagcacuugaaaaucaacacacaauugaccugacugauagcgagaugaacaaguuguucgaaaggaccaaaaagcagcuacgggagaaugcugaagacaugggaaacggcugcuuuaagauauaucauaaaugugauaaugccugcaucgggucaauucgaaacggaacauacgaccacgauguguaucgcgacgaggcucugaauaacagauuccagaucaagggugucgagcucaaaaguggcuacaaggacuggauucuguggaucuccuuugccauaagcugcuuccuucuguguguggcauugcucggguuuaucaugugggccugccagaaaggaaauauuagguguaacaucugcauuuga

SEQ ID NO: 123743 - RNA, 1701 nt, Artificial Sequence
  derived and/or modified sequence opt3 from hemagglutinin__InfluenzaA__ABS71676
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcaacaauuccuuuuucucacgccugaacuggcucacucauaguaaguuuaaauauccagcauuaaaugugaccaugcccaacaacgaggaguucgacaagcuguacauuuggggcguccaccauccugggacagauaaugaccagaucuuucuuuaugcccaggcuagcggacgaauuacugugucuaccaaacguucccaacagacaguaaucccaaacauagguucaagacccaggguucggaauauuccuagccgcaucaguauuuacuggaccaucgugaagccaggcgauaucuugcugauuaacucuacggggaaucuaauagccccgagaggauacuucaucauuagguccggcaaaagcucgaucaugcggucugacgcgcccauagguaaguguaacuccgaaugcauuacuccuaaugggucaaucccaaacgacaagcccuuucagaaugucaaccgcaucacauauggagcauguccucgauacgugaaacagaauacccucaagcuggccacuggcaugagaaacgugccagagaaacaaacaaggggcauuuucggggcuaucgccggauuuauugaaaaugguugggagggcauggucgaugggugguauggauuccggcaccagaacagugagggcauaggucaggcagcugaccuuaagagcacccaagccgcgaucgaucagauuaaugggaaacugaaccguuugaucggcaagacgaacgaaaaauuccaccagaucgagaaggaauuuuccgagguugaaggacgcauucaggaccucgagaaguacguggaggauaccaaaauagaccuguggucuuauaaugccgaauuacugguagcacucgagaaccaacauacaaucgaucuuacugacagcgaaaugaauaagcuguucgagaaaaccaagaaacaguugagagaaaacgcugaggauaugggcaaugggugcuuuaagauuuaccacaagugugacaacgccugcaucggaucaauuaggaaugguacauaugaucaugacguguaccgggacgaggcucuaaacaaucgauuccagaucaaaggcgucgaacugaagaguggguacaaagauuggauacucuggaucuccuuugccauuagcugcuuccugcuuuguguggcacuguugggauuuaucaugugggccugccagaagggcaacauucgcuguaauaucugcauauga

SEQ ID NO: 123744 - RNA, 1701 nt, Artificial Sequence
  derived and/or modified sequence opt3 from hemagglutinin__InfluenzaA__ABS71677
augaagaccaucauugcccugagcuacauacucugccuuguguucgcucagaaacugcccggcaucgacaacuccacagcaacuuuguguuuagggcaccaugccgucccuaauggaacgauuguuaagaccaucacagaugaccaaauugaggugacuaacgcgaccgaacugguacaaaauucuucaacagguggcaucugcgauaguccacaccagauacuagacggggagaacuguacccucaucgaugcucugcuuggagacccgcagugcgauggcuuucagaauaaaaagugggaccuguucguggaaagaagcaaagccuauuccaacuguuaccccuaugaugucccugacuacgcaucuuugaggucgcucguggccucaagcgguacucuggaguuuaauaacgaaaguuucaauuggacagggguuacccagaacggaacguccucugcuugcaagcggggcagcaauaacuccuuuuucucacgccugaauuggcucacucauaguaaguuuaaauauccagcauuaaacgugaccaugcccaauaacgaggaguucgauaagcuguacauuuggggcguccaccauccugggacagacaacgaucagaucuuucuuuaugcccaggcuagcggacgaauuacugugucuaccaaacguucccaacagacaguaaucccaaauauagguucaagacccaggguucggaacauuccuagccgcaucaguauuuacuggaccaucgugaagccaggcgacaucuugcugauuaauucuacggggaaccuaauagccccgagaggauacuucaaaaucagguccggcaagagcucgauuaugcggucugacgcgcccaucgauaaguguaauuccgaaugcauaacuccuaacgguucaauuccaaaugacaaacccuuucagaacgucaaucgcaucacauauggggcauguccucgauacgugaagcagaacacccucaaacuggccacuggaaugagaaaugugccagagaagcaaacaaggggcaucuucggcgcuauugccggguuuaucgaaaacggaugggaggguauggucgauggcugguauggguuccggcaccagaauagugagggaauuggccaggcagcugaccuuaaaagcacccaagccgcgauagaucagaucaacgguaagcugaaucguuugauugggaaaacgaacgaaaaguuccaccagaucgagaaggaauuuuccgagguugaaggccgcauccaggaccucgagaaauacguggaggauaccaagauugaccuguggucuuauaacgccgaauuacugguagcacucgagaaucaacauacaauagaucuuacugacagcgaaaugaacaaacuguucgagaagaccaaaaagcaguugagagaaaaugcugaggauaugggaaacggcugcuuuaagaucuaccacaaaugugacaaugccugcauugggucaaucaggaacggaacauaugaccaugauguguaccgggacgaggcucuaaauaaccgauuccagauuaagggugucgaacugaaaaguggcuacaaggauuggauccucuggauauccuuugccaucagcugcuuccugcuuuguguggcacuguugggguuuauuaugugggccugccagaaaggaaauauccgcuguaacauuugcaucuga

SEQ ID NO: 123745 - RNA, 1701 nt, Artificial Sequence
  derived and/or modified sequence opt3 from hemagglutinin__InfluenzaA__ABS71679
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacagguggcaucugcgacagcccacaccagauacuagauggggagaacuguacccucaucgacgcucugcuuggagauccgcagugcgacggcuuucaaaauaaaaagugggaucuguucguggaaagauccaaagccuauucuaacuguuaccccuaugacgucccugauuacgcaucguugaggucacucguggccagcagugguacucuggaguuuaauaacgaauccuucaauuggacagggguuacccagaacggaacgucuagcgcuugcaagcggggcuccaauaacucauuuuucagucgccugaauuggcucacucauagcaaguuuaaauauccagcauuaaacgugaccaugcccaauaacgaggaguucgacaagcuguacauuuggggcguccaccauccugggacagauaacgaccagaucuuucuuuaugcccaggcuucuggacgaauuacuguguccaccaaacguucacaacagacaguaaucccaaauauagguagcagacccaggguucggaacauuccuagucgcaucucuauuuacuggaccaucgugaagccaggcgauaucuugcugauuaauuccacggggaaccuaauagccccgagaggauacuucaaaaucaggagcggcaagucgucuauuaugcgguccgacgcgcccaucgguaaguguaauucagaaugcauaacuccuaacgggaguauuccaaaugacaaacccuuucagaacgucaaucgcaucacauauggagcauguccucgauacgugaagcagaacacccucaaacuggccacuggcaugagaaaugugccagagaagcaaacaaggggcaucuucggggcuauugccggauuuaucgaaaacgguugggagggcauggucgaugggugguauggauuccggcaccagaauagcgagggcauuggucaggcagcugaccuuaaauccacccaagccgcgauagaucagaucaacgggaagcugaaucguuugauuggcaaaacgaacgaaaaguuccaccagaucgagaaggaauuuucugagguugaaggacgcauccaggaccucgagaaauacguggaggauaccaagauugaccuguggagcuauaacgccgaauuacugguagcacucgagaaucaacauacaauagaucuuacugacucagaaaugaacaaacuguucgagaagaccaaaaagcaguugagagaaaaugcugaggauaugggcaacgggugcuuuaagaucuaccacaaaugugacaaugccugcauuggaaguaucaggaacgguacauaugaucaugacguguaccgggacgaggcucuaaauaaccgauuccagauuaagggcgucgaacugaaauccggguacaaggauuggauccucuggaucagcuuugccauaucuugcuuccugcuuuguguggcacuguugggauuuauuaugugggccugccagaaaggcaauauccgcuguaacauuugcaucuga

SEQ ID NO: 123746 - RNA, 1701 nt, Artificial Sequence; identical to SEQ ID NO: 123745
  derived and/or modified sequence opt3 from hemagglutinin__InfluenzaA__ABS71680

SEQ ID NO: 123747 - RNA, 1701 nt, Artificial Sequence
  derived and/or modified sequence opt3 from hemagglutinin__InfluenzaA__ABS71682
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagauaaugaccagaucuuuuuguaugcccaggcuagcgggcguauuacugucucuaccaagagaucccaacagacagugaucccaaacauaggaucaaggccccggguacgcaauauuccuagcagaaucaguauuuacuggaccaucguuaaaccaggugauauccugcuaauuaacucuacgggcaaucucauagccccgaggggguacuucaagauccgguccggaaagagcucgauuaugcgcucugacgcgcccaucggcaaauguaacuccgagugcauaacuccuaaugguucaauuccaaacgacaagcccuuucagaaugugaaccgaaucacauauggggcauguccuagauacgucaaacagaauacccugaagcuggccacuggaaugaggaacgugccagaaaaacaaacacggggcaucuucggcgcuauugccggguuuaucgagaauggaugggaagguaugguggauggcugguauggguuccgucaccagaacagugagggaauuggccaggcagcugaccuuaagagcacccaagccgcgauagaucagaucaaugguaaauugaaccgccucauugggaagacgaacgagaaguuccaccagaucgaaaaagaguuuuccgaagucgagggcagaauccaggaccuggaaaaguacguugaggauaccaaaauugacuuauggucuuauaaugccgagcugcucguggcacuugaaaaccaacauacaauagaucugacugacagcgagaugaauaaguuguucgagaaaaccaagaagcagcuaagggaaaacgcugaagauaugggaaauggcugcuuuaaaaucuaccacaagugugacaacgccugcauugggucaauccggaauggaacauaugaucaugacguauaccgagacgaggcucugaacaaucgcuuccagauuaaagguguggagcucaagaguggcuacaaagauuggauccuguggauauccuuugccaucagcugcuuccuucugugugucguguugcucggguuuauuaugugggcaugccagaagggaaacaucagauguaauauuugcaucuga

SEQ ID NO: 123748 - RNA, 1701 nt, Artificial Sequence
  derived and/or modified sequence opt3 from hemagglutinin__InfluenzaA__ABU80177
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcuccugcaagcgccgaucaauaaaaaguuucuuuagccgucucaacugguuacaucaacugaaguauaaguacccagcacuuaaugucacuaugcccaacaaugagaaauuugacaaguuguauaucuggggagugcaccacccuucuaccgauuccgaccagauuucacuguacgcccaggcuagcgggagaguaacaguuaguacuaaaaggucucagcaaaccgugaucccaaacauuggcucccggcccuggguccgcggcgugagcucgagaaucucuauauacuggacaauugugaagccuggggauauccuacucauuaacuccaccggaaaucugaucgccccaagggguuauuucaaaauccggucaggcaagaguagcauuaugcgcuccaacgcgccgauagggaaguguaauucugaaugcaucacgcccaacggaagcauuccuaaugacaaaccauuucagaacgucaaucgaaucacuuacggcgcaugucccagauauguuaagcagaacacacuuaaacuggccaccgguaugaggaaugugccugagaagcagacucgggggauauucggagcuauugccggcuuuaucgaaaacggcugggaggggaugguagacggaugguacgguuuccgucaucaaaauucagagggcacagggcaggcagcugauuugaaaaguacccaggccgcgaucaaccaaauuaauggaaagcucaaccgccugaucgagaaaacgaaugaaaaguuucaccagauugaaaaggaguucuccgaaguggagggcagaauacaggacuuagagaaauaugucgaagauaccaagaucgaccuguggagcuacaacgccgagcuccuuguggcacuggaaaaccagcauacaauugauuugacugacucugagaugaauaaacuauucgaaaggacccggaagcaacugcgagagaacgcugaggauauggguaaugggugcuuuaaaaucuaucacaagugugacaacgccugcaucggcucaauucgcaauggaacauacgaucacgacguuuacagagaugaagcucucaacaauagguuccagauaaagggcguggagcugaaaaguggguauaaggacuggauccuuuggauuagcuuugccaucuccugcuuccuguugugugucgugcuccugggauuuauuaugugggcaugccagaaagguaacauccgguguaauauaugcaucuga

SEQ ID NO: 123749 - RNA, 1698 nt, Artificial Sequence
  derived and/or modified sequence opt3 from hemagglutinin__InfluenzaA__ABU80298
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuaugccuucgcgcucucuagaggguuuggauccggcaucauaaccagcaacgcacccauggacgaaugugaugccaagugccagacaccucaaggugcuauuaauucgucucugccauuccagaacguucaccccgugaccaucggggaguguccuaaauacguaagguccgccaaguuacggauggcaacgggacugcgcaauauuccaucaauccagagucgaggccucuuuggcgcuaucgccggguucauugaaggagguuggacuggcaugguggacgggugguauggauaccaucaccagaacgagcaaggcagcgguuacgcggccgaucagaaauccacacagaaugcaauaaacgggaucaccaauaaggucaacucugugauugaaaagaugaauacucaguuuacagcuguuggcaaagaguucaacaaacuugagagaaggauggaaaaucugaacaagaagguggacgauggauucuuggacaucuggaccuauaacgccgagcuacugguccuccuggaaaaugagcggacgcuugacuuucacgauagcaacgugaaaaaucuguacaagaaaguaaagucacaauugaaaaacaaugcuaaggaaauaggcaacgggugcuucgaguuuuaucauaaguguaauaacgagugcauggaaaguguuaaaaauggaaccuacgacuaucccaaguacuccgaggaaagcaaacucaaccgugagaagauugauggugugaaacuggagucuaugggcgucuaucagaucuuagccaucuacucaacaguggcaaguagccugguccuacucgugucccugggggccauuucuuucuggaugugcucgaauggaagccuucagugucgcaucugcauuuga

SEQ ID NO: 123750 - RNA, 1701 nt, Artificial Sequence
  derived and/or modified sequence opt3 from hemagglutinin__InfluenzaA__ABU80320
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacuccuuucagaacaaagaaugggauuuguucguggagagaucuaaggccuauucgaauuguuaccccuaugacgucccugauuacgcaucacucaggagccugguggccaguuccggcacucuggaauuuaacaaugagucuuucaacuggacagguguugcucaaaaugggaccagcuccgcaugcaaacggcgcucaaacaagagcuuuuucagucgacucaauugguuacaccagcugaaguauaaauacccagcccuuaacgugacgaugcccaauaacgagaaguuugacaaauuguauauauggggaguccaucacccuucuacugauuccgaccagaucucacuguacgcucaggccccaggccgugugaccguaagcacaaagagaagucaacagacuguuauucccaacaucggcucuaggccuugggugcgcggggucuccagcauuaucucgauauacuggaccauugugaaaccaggagauauccuacucauuaauuguacagguaaccugaucgcgccgcggggcuauuucaagaucagaucugggaaguccucaauuaugaggagugacgcaagcauaggaaaaugcaauuccgaauguaucacccccaacggcucuauuccuaaugacaagccauuucagaacgugaaucggaucacguacggugccugcccccgcuaugucaaacagaacacucuuaagcuggcuacagggaugcgaaauguuccugagaaacaaaccagaggaauauucggcgccauugcaggcuuuaucgaaaacgggugggagggaaugguggaugguugguacggcuucaggcaccagaauagcgaggggacuggacaggcugccgacuugaagucaacacaagcggccaucaaccagauuaauggcaaacucaaccggcugaucgaaaagaccaaugagaaguuucaucagauugaaaaagaguucagugaaguagagggucguauacaggauuuagagaaguauguggaagacacgaaaaucgaucugugguccuacaacgcagagcuccuugucgcucuggaaaaccaacacaccauugacuugacagauagcgagaugaauaagcuauucgaacgcacuaaaaagcagcugagagagaacgccgaggacauggggaauggcuguuuuaagaucuaucauaaaugcgauaacgcuugcaucggaucuauuaggaauggcaccuacgaccacgauguguaccgggacgaagcccucaacaaucgauuccagauaaaggggguugagcugaaaucaggauauaaggacuggauccuuuggauuaguuuugcaaucagcuguuuccuguugugcgugguccuccuggguuuuauuaugugggccugucagaaaggcaacauccgcugcaauauauguaucuga

SEQ ID NO: 123751 - RNA, 1701 nt, Artificial Sequence; identical to SEQ ID NO: 123055
  derived and/or modified sequence opt3 from hemagglutinin__InfluenzaA__ABU80331

SEQ ID NO: 123752 - RNA, 1701 nt, Artificial Sequence
  derived and/or modified sequence opt3 from hemagglutinin__InfluenzaA__ABU80400
augaaggccauccugcucgugcuucuguacaccuucacagcugcaaacgccgacacuuugugcauuggcuaucacgcgaauaacagcacggauaccgucgacacaguuuuagagaaaaaugugacuguaacccauuccgugaaccugcuagaagauagacacaaugggaagcucuguaaacugaggggagucgcuccccuucaucuggguaagugcaacauagccggcugguugcucgggaauccugagugugaacugcuguuuacagcaucuucauggaguuacaucguggagaccagcaacuccgacaauggaacuugcuauccaggcgauuucauuaacuacgaagaacuccgggagcaguuaucuucgguuucuagcuuugaacgcuucgagaucuuuccgaaagccaguuccuggcccaaucacgaaacaaaccgaggugugaccgcugcauguccuuaugccggggcuaauucuuucuaccguaaccugauuuggcuugucaagaagggaaauagcuauccaaaauuguccaagucauacgugaacaacaaagagaaggagguacugguucuauggggcauccaucaucccccuacgaguacugaccaacagagccucuaccagaaugccgaugcguauguguuugucggcucauccaaauacaacaagaaguucaaaccagaaauagcaaccagacccaaggugagggggcaggccggacggaugaauuauuacuggacacugguggagccuggugacacuaucaccuuugaagcuacaggcaaccuugucguuccacgcuaugccuucgcaaugaaaagagggucaggaagcggcauuaucauuagugauaccccggugcacgacugcaauacgacuugucaaacacccaagggugcuaucaacaccucucugccuuuucagaauauacacccaguaacuauuggggagugccccaaauacgugaaguccacaaaauugaggauggccaccggacuccggaacaucccuagcauucagucgcgcggccuguucggcgcgaucgccggguuuaucgaaggagguuggacgggcaugauugaugggugguauggauaccaccaucagaaugagcaaggcucugguuacgcagcugaccgaaaguccacccagaacgccauagaugggaucacaaauaaggucaacucagugauugagaaaaugaauacucaguucaccgcuguuggcaaggaguucaaccacuuagagaaaagaaucgaaaaucugaacaggaagguggacgacggauuucucgauauauggacauauaacgccgagcuucuggucuugcuagaaaaugagcggacucuggacuaccacgauaguaacgugaaaaaucucuaugagaagguacguagccagcugaagaacaaugcaaaagaaauuggcaacggguguuucgaguuuuaccauaagugcgacgauaccuguauggaauccguuaaaaauggaacauaugacuacccaaaguauucugaggaaagcaaacuuaaccgcgaggagaucgauggugugaagcuggaaucaaccagaaucuaccaaauuuuggccaucuacaguacugucgcuuccagccucgugcuguuagucucucugggcgcgauuucauucuggaugugcaguaaugggagccuacagugcaggauauguaucuga

SEQ ID NO: 123753 - RNA, 1701 nt, Artificial Sequence
  derived and/or modified sequence opt3 from hemagglutinin__InfluenzaA__ABU92572
augaagaccaucauugcccugagcuacauacucugccuuguguucacacagaaacugcccggcaacgacaauuccacugcuacguuguguuuagggcaccaugcagucccuaacggaacccugguuaagacaaucacuaaugaucaaauugaggugaccaacgccacagaauugguacagucuucaaguaccgguagaaucugcgacagcccacaccagauucucgauggcgagaauuguacucugaucgacgcgcuucugggggauccgcauugcgacggauuucagaacaaagaaugggauuuguucguggagagguccaaggcuuauucuaauuguuaccccuaugacgucccugauuacgugucgcuccggucacugguugccagcaguggcacacuggaauuuaacaaugaguccuucaacuggaccgguguggcacaaaaugggacgucuagcgccugcaaacgccgauccgacaagucauuuuucagucgucucaacugguuacaccagcugaaguauaaauacccagcucuuaaugucacuaugcccaacaaugagaaguuugauaaauuguauauauggggagugcaucacccuggcaccgacagcgaucagaucucucuguacgcacaggccuccggcagaguaacaguuucaacuaagaggagccaacagaccgugauuccaaacaucgggagucggcccuggguccgcggagugucuuccagaauuagcaucuacuggacaauagugaaaccuggugacauucuacucaucaacucgaccggcaaucugauugcuccaaggggguauuucaagauccggucuggaaaguccucaaucaugcgcagugacgccccgauuggcaaauguaacagcgaaugcauaacgcccaaugguuccaucccuaacgauaagccauuucagaaugucaaccgaauuacuuacgggcccuguccuagauauguuaaacagaauacacuuaagcuggcgaccggaaugaggaacgugccagagaaacaaacucggggcaucuucggcgcaauagccggguuuauugaaaauggaugggaggguaugauggacggcugguacggguuccgucaccagaacucugagggaacaggccaggcugccgaucuaaagagcacccaagcagcuaucaaucagaucaacgguaaacucaaucgccugauugaaaagacgaacgagaaguuucaucagaucgaaaaagaguucucagaaguagaggggaggauucaggacuuagagaaguauguggaagauaccaaaauagaccuguggaguuacaaugccgagcuccuugucgcgcuggaaaaccaacacacaaucgauuugacugacuccgagaugaacaagcuauucgaaagaaccaaaaagcagcugcgggagaaugccgaggauaugggcaacggaugcuuuaagauuuaucauaaaugugacaaugcaugcaucggcagcauccgaaacgggacauacgaucacgacguguaccgcgacgaagcucucaauaacagauuccagauuaagggaguugagcugaaaucugguuauaaggauuggauacuuuggaucucauuugccauuaguugcuuccuguuguguaucgugcuccugggcuuuauuaugugggcuugccagaaagggaauaucagguguaacauaugcaucuga

SEQ ID NO: 123754 - RNA, 1701 nt, Artificial Sequence
  derived and/or modified sequence opt3 from hemagglutinin__InfluenzaA__ABU92573
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugacauucuacucaucaacucgacaggcaaucugauugccccaaggggguauuucaagauccggucuggaaaguccucaaucaugcgcagugacgcgccgauuggcaaauguaacagcgaaugcauaacccccaaugguuccaucccuaacgggaagccauuucagaaugucaaccgaauuacguacggagcaugucccagauauguuaaacagaauacucuuaagcuggccacaggcaugaggaacgugccugagaaacaaacccggggcaucuucggggcuauagccggauuuauugaaaaugguugggagggcaugauggaugggugguacggauuccgucaccagaacucugagggcacuggucaggcagcugaccuaaagagcacacaagccgcgaucaaucagaucaacgggaaacucaaucgccugauuaagaagaccaacgaaaaauuucaucagaucgagaaggaguucucagaaguagaaggcaggauucaggauuuagagaaauauguggaggacacgaagauagaucuguggaguuacaaugccgaacuccuugucgcacuggagaaccaacacaccaucgacuugacagauuccgaaaugaacaaacuauucgagagaacuaagaagcagcugcgggaaaaugcugaggacaugggaaacggcugcuuuaaaauuuaucauaagugugauaaugccugcaucgggagcauccgaaacggaaccuacgaccacgauguguaccgcgacgaggcucucaauaacagauuccagauuaaagguguugaacugaagucuggcuauaaagacuggauacuuuggaucucauuugccauuaguugcuuccuguuguguaucgugcuccugggguuuauuaugugggcaugccagaagggaaauaucagguguaacauaugcaucuga

SEQ ID NO: 123755 - RNA, 1701 nt, Artificial Sequence
  derived and/or modified sequence opt3 from hemagglutinin__InfluenzaA__ABU92575
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggaguaaacccuggguccggggagugucuucccgcauuagcaucuacuggaccauagugaagccuggugacauucuacucaucaacucgacaggcaaucugauugccccaagaggguauuucaagaucaggucuggaaaauccucaaucaugcggagugacgcgccgauuggcaaguguaacagcgaaugcauaacccccaaugguuccaucccuaacgauaaaccauuucagaaugucaaccgcauuacguacgggcccuguccucgauauguuaagcagaauacucuuaaacuggcaacaggaaugagaaacgugccagagaagcaaaccaggggcaucuucggcgccauagcuggguuuauugaaaauggaugggaggguaugauggacggcugguacggguuccggcaccagaacucugagggaacuggccaggccgcagauuugaaaagcacacaagcugccaucaaucagaucaacgguaagcucaaucgucugauugaaaagaccaacgagaaauuucaucagaucgaaaaggaguucucagaaguagaggggcgcauucaggacuuagagaaauauguggaagauacgaagauagaccuguggaguuacaaugcggagcuccuugucgcccuggaaaaccaacacaccaucgauuugacagacuccgagaugaacaaacuauucgaaagaacuaagaagcagcugagggagaaugcagaggauaugggcaacggaugcuuuaaaauuuaucauaagugugacaaugcuugcaucggcagcauccggaacgggaccuacgaucacgacguguaccgagacgaagcccucaauaaccgcuuccagauuaaaggaguugagcugaagucugguuauaaagauuggauacuuuggaucucauuugcuauuaguugcuuccuguuguguaucgugcuccugggcuuuauuaugugggccugccagaaggggaauaucagauguaacauaugcaucuga

SEQ ID NO: 123756 - RNA, 1701 nt, Artificial Sequence; identical to SEQ ID NO: 122067
  derived and/or modified sequence opt3 from hemagglutinin__InfluenzaA__ABU92576

SEQ ID NO: 123757 - RNA, 1701 nt, Artificial Sequence; identical to SEQ ID NO: 122067
  derived and/or modified sequence opt3 from hemagglutinin__InfluenzaA__ABU92577

SEQ ID NO: 123758 - RNA, 1701 nt, Artificial Sequence; identical to SEQ ID NO: 122088
  derived and/or modified sequence opt3 from hemagglutinin__InfluenzaA__ABU92578

SEQ ID NO: 123759 - RNA, 1701 nt, Artificial Sequence; identical to SEQ ID NO: 122088
  derived and/or modified sequence opt3 from hemagglutinin__InfluenzaA__ABU92579

SEQ ID NO: 123760 - RNA, 1701 nt, Artificial Sequence; identical to SEQ ID NO: 122088
  derived and/or modified sequence opt3 from hemagglutinin__InfluenzaA__ABU92580

SEQ ID NO: 123761 - RNA, 1701 nt, Artificial Sequence; identical to SEQ ID NO: 123753
  derived and/or modified sequence opt3 from hemagglutinin__InfluenzaA__ABU92581

SEQ ID NO: 123762 - RNA, 1701 nt, Artificial Sequence
  derived and/or modified sequence opt3 from hemagglutinin__InfluenzaA__ABU92582
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacagaaugucacgaugcccaacaaugagaaguuugauaaacuuuauauauggggagugcaucacccuggcacugacagcgaucagaucucuuuguacgcccaagcuagcggcagaguaaccguuucaacaaagaggagccagcagacugugauuccaaacaucgggagucggcccuggguccgcggagugucuuccagaauuagcaucuacuggaccauagugaaaccuggugacauucugcuaaucaacucgacaggcaaucucauugccccaaggggguauuucaagauccggucuggaaaguccucaaucaugcgcagugacgcgccgauuggcaaauguaacagcgaaugcauaacccccaaugguuccaucccuaacgauaagccauuucagaaugucaaccgaauuacguacggggcaugucccagauauguuaaacaaaauacucugaagcuagccacaggaaugaggaacgugccugagaaacagacccggggcaucuucggcgcuauagccggguuuauugaaaauggaugggaggguaugauggacggcugguacggguuccgucaccagaacucugagggaacuggccaagcagcugaucugaaguccacacaggccgcgaucaaucagaucaacgguaaauugaaucgccucauugaaaagaccaacgagaaguuucaucagaucgaaaaagaguucucagaaguagaggggaggauucaagaccuggagaaguauguggaagauacgaaaauagacuuauggaguuacaaugccgagcugcucgucgcacuugaaaaccagcacaccaucgaucugacagacuccgagaugaacaaguuguucgaaagaacuaaaaagcagcuacgggagaaugcugaggauaugggcaacggaugcuuuaagauuuaucauaaaugugacaaugccugcaucggcagcauccgaaacgggaccuacgaucacgacguguaccgcgacgaagcucugaauaacagauuccagauuaagggaguugagcucaaaucugguuauaaggauuggauacuguggaucucauuugccauuaguugcuuccuucuguguaucguguugcucggcuuuauuaugugggcaugccaaaaagggaauaucagguguaacauaugcaucuga

SEQ ID NO: 123763 - RNA, 1701 nt, Artificial Sequence; identical to SEQ ID NO: 123762
  derived and/or modified sequence opt3 from hemagglutinin__InfluenzaA__ABU92583

SEQ ID NO: 123764 - RNA, 1701 nt, Artificial Sequence
  derived and/or modified sequence opt3 from hemagglutinin__InfluenzaA__ABU92584
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugagauauaaguacccagcacuuaaugucacgaugcccaacaaugagaaauuugauaaguuguauauauggggagugcaucacccuggcacugacagcgaucagaucucucuguacgcccaggcuuccggcaggguaaccguuucaacaaaacggagccaacagacugugauuccaaacaucgggagucgccccugggucagaggagugucuuccaggauuagcaucuacuggaccauagugaagccuggugacauucuacucaucaacucgacaggcaaucugauugccccacggggguauuucaaaauccgcucuggaaaguccucaaucaugcgaagugacgcgccgauuggcaaguguaacagcgaaugcauaacccccaaugguuccaucccuaacgauaaaccauuucagaaugucaacagaauuacguacggggcaugucccagguauguuaagcagaaaacucuuaagcuggccacaggaaugcggaaugugccugagaaacaaacccguggcaucuucggcgcuauagccggguuuauugaaaacggaugggaggguaugauggacggcugguacggguuccgccaccagaauagcgagggaacuggccaggcagcugauuugaagucuacacaagccgcgaucaaccagaucaaugguaaacucaacagacugauugaaaagaccaaugagaaguuucaucagaucgaaaaagaguucucagaaguagaggggaggauucaggacuuagagaaguauguggaagauacgaaaauagaccuguggaguuacaacgccgagcuccuugucgcacuggaaaaucaacacaccaucgauuugacagacuccgagaugaacaagcuauucgaacggacuaaaaagcagcugcgagagaacgcugaggauaugggcaauggaugcuuuaagauuuaucauaaaugugacaacgccugcaucggcagcauccgcaaugggaccuacgaucacgacguguacagagacgaagcucucaacaauagguuccagauuaagggaguugagcugaaaucugguuauaaggauuggauacuuuggaucucauuugccauuaguugcuuccuguuguguaucgugcuccugggcuuuauuaugugggcaugccagaaagggaacauccgguguaauauaugcaucuga

SEQ ID NO: 123765 - RNA, 1701 nt, Artificial Sequence
  derived and/or modified sequence opt3 from hemagglutinin__InfluenzaA__ABU92586
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacagauaacgaccagaucucuuuguaugcccaggcuuccgggcguauuacugucucaaccaagagaagccaacagacagugaucccaaauauaggaaguaggccccggguacgcgauauuccuucuagaaucuccauuuacuggaccaucguuaagccaggugacauccugcuaauuaacagcacgggcaaucucauagccccgaggggguacuuuaaaauccggucgggaaagucuuccauuaugcgcucagacgcgcccaucggcaaguguaacagugaaugcauaacuccuaaugguagcauuccaaacgauaaacccuuccagaaugugaaccgaaucacauauggggcauguccuagauacgucaagcagaauacccugaaacuugccacuggaaugaggaacgugccagagaagcaaacacggggcaucuuuggcgcuauugccggguucaucgaaaauggaugggaggguaugguggacggcugguauggguuucgucaccagaacuccgagggaauuggccaggcagcugaucugaaaucuacccaagccgcgauagaccagaucaaugguaaguugaaccgccucauugggaaaacgaaugaaaaguuccaccagaucgagaaggaauuuagcgaggucgaaggcagaauccaggaucuggagaaauacguugaggacaccaagauugauuuauggucauauaacgccgaacugcucguggcacuugagaaccaacauacaauagaccugacugauagugaaaugaauaaauuguuugagaggaccaagaaacagcuacgggaaaacgcugaggacaugggaaauggcugcuucaagaucuaccacaagugugauaacgccugcauuggguccauccgaaauggaacauaugaccaugacguauaccgcgaugaggcucugaacaauagauuucagauuaaagguguggaacucaagagcggcuacaaaaacuggauccuguggauaucuuucgccaucucaugcuuucuucugugugucgcauugcucggguucauuaugugggccugccagaagggaaauaucagguguaacauuugcaucuga

SEQ ID NO: 123766 - RNA, 1701 nt, Artificial Sequence
  derived and/or modified sequence opt3 from hemagglutinin__InfluenzaA__ABU92587
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagccaucccaaauauaggaaguaggccccgggugcgcgacauuccuucuagaaucuccauuuacuggaccaucguaaagccaggugauauccugcuaauuaacagcacgggcaaucucauagcgccgaggggguauuuuaaaauccggucgggaaagucuuccauuaugcgcucagacgcacccaucggcaaguguaacagugaaugcauaacuccuaaugguagcauuccaaacgacaaacccuuccagaauguuaaccgaaucacauacggggccuguccuagauaugugaagcagaauacccugaaacuugcuacuggaaugaggaacgucccagagaagcaaacacggggcaucuuuggcgccauugcaggguucaucgaaaauggaugggaggguaugguggauggcugguacggguuucgucaccagaacuccgagggaauuggccaggcugccgaccugaaaucuacccaagcggccauagaucagaucaaugguaaguugaaccgccucauugggaaaacgaaugaaaaguuccaccagaucgagaaggaauuuagcgagguggaaggcagaauccaggaccuggagaaauaugucgaggauaccaagauugacuuauggucauacaacgcagaacugcucguugcucuugagaaccaacauacaauagaucugacugacagugaaaugaauaaauuguuugagaggaccaagaaacagcuacgggaaaacgccgaggauaugggaaauggcugcuucaagaucuaucacaagugugacaacgcuugcauuggguccauccgaaauggaacauacgaucaugacguguaccgcgacgaggcccugaacaauagauuucagauuaaagguguagaacucaagagcggcuauaaagauuggauccuguggauaucuuucgcaaucucaugcuuucuucuguguguggccuugcucggguucauuaugugggcuugccagaagggaaacaucagguguaauauuugcaucuga

SEQ ID NO: 123767 - RNA, 1701 nt, Artificial Sequence
  derived and/or modified sequence opt3 from hemagglutinin__InfluenzaA__ABU92588
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccaacaauucauuuuucagucgccugaacuggcucacucauuuaaaauuuaaguauccagcacugaaugugaccaugcccaacaacgagaaauucgacaaacuuuacaucuggggcguccaccauccuggcacagauaaugaccagauuagcuuguaugcccaggcuucugggcgaaucacuguguccaccaagcguucacaacagacaguaauuccaaacaucggaagcagacccaggguucgggauauaccuagucgcauuucuaucuacuggaccauugugaagccaggugacauccugcuaaucaauuccacgggcaaccucauugccccgagaggguacuuuaagauaaggagcggaaaaucgucuaucaugcgguccgacgcgcccauuggcaaguguaauucagagugcaucacuccuaacgguaguauaccaaaugauaaacccuuccagaacgucaaucgcauuacauauggggcauguccucgauacgugaagcagaacacccugaaacuugccacuggaaugagaaaugugccagaaaagcaaacaaggggcaucuuuggcgcuaucgccggguucauugagaacggaugggaagguauggucgacggcugguauggguuucggcaccagaauagcgagggaaucggccaggcagcugaucugaaauccacccaagccgcgauuaaccagauaaaugguaaguugaaccgucucaucgggaagacgaacgagaaauuccaccagauugaaaaggaguucucugaaguugagggccgcauccaggaccuggaaaaauacguggaggauaccaagaucgacuuauggagcuauaaugccgaguuucugguagcacucgaaaaccaacauacaauugaucuuacugacucagagaugaauaaacuguucgaaagaaccaagaagcaguugagggagaacgcugaagauaugggaaauggcugcuuuaaaauauaccacaagugugacaacgccugcaucgggaguauucggaauggaacauaugaucaugacguguaccgagacgaggcucuaaacaaucgcuuccagaucaaaggugucgagcugaaguccggcuacaaagauuggauucucuggaucagcuuugccauaucuugcuuccugcuuuguguggcacuguugggguuuaucaugugggccugccagaagggaaacauuagauguaauaucugcauuuga

SEQ ID NO: 123768 - RNA, 1701 nt, Artificial Sequence; identical to SEQ ID NO: 122649
  derived and/or modified sequence opt3 from hemagglutinin__InfluenzaA__ABU92590

SEQ ID NO: 123769 - RNA, 1701 nt, Artificial Sequence
  derived and/or modified sequence opt3 from hemagglutinin__InfluenzaA__ABU92591
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacagauaacgaccagaucucuuuguaugcccaggcuuccgggcguauuacugucucaaccaagagaagccaacagacagugaucccaaauauaggaaguaggccccggguacgcgauauuccuucuagaaucuccauuuacuggaccaucguuaagccaggugacauccugcuaauuaacagcacgggcaaucucauagccccgaggggguacuuuaaaauccggucgggaaagucuuccauuaugcgcucagacgcgcccaucggcaaguguaacagugaaugcauaacuccuaaugguagcauuccaaacgauaaacccuuccagaaugugaaccgaaucacauauggggcauguccuagauacgucaagcagaauacccugaaacuugccacuggaaugaggaacgugccagagaagcaaacacggggcaucuuuggcgcuauugccggguucaucgaaaauggaugggaggguaugguggacggcugguauggguuucgucaccagaacuccgagggaauuggccaggcagcugaucugaaaucuacccaagccgcgauagaccagaucaaugguaaguugaaccgccucauugggaaaacgaaugaaaaguuccaccagaucgagaaggaauuuagcgaggucgaaggcagaauccaggaucuggagaaauacguugaggacaccaagauugauuuauggucauauaacgccgaacugcucguggcacuugagaaccaacauacaauagaccugacugauagugaaaugaauaaauuguuugagaggaccaagaaacagcuacgggaaaacgcugaggacaugggaaauggcugcuucaagaucuaccacaagugugauaacgccugcauuggguccauccgaaauggaacauaugaccaugacguauaccgcgaugaggcucugaacaauagauuucagauuaaagguguggaacucaagagcggcuacaaagacuggauccuguggauaucuuucgccaucucaugcuuucuucugugugucgcauugcucggguucauuaugugggccugccagaagggaaacaucagguguaauauuugcaucuga

SEQ ID NO: 123770 - RNA, 1701 nt, Artificial Sequence; identical to SEQ ID NO: 123769
  derived and/or modified sequence opt3 from hemagglutinin__InfluenzaA__ABU92592

SEQ ID NO: 123771 - RNA, 1701 nt, Artificial Sequence
  derived and/or modified sequence opt3 from hemagglutinin__InfluenzaA__ABU92593
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuuuucuuuaugcccaggcuagcgggcguaucacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaaguuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccugaaaagcacccaagccgcgauugaucagauaaaugguaaauugaaccgccucaucgggaagacgaacgagaaguuccaccagauugaaaaagaguuuuccgaaguugagggcagaauccaggaccuggaaaaguacguggaggauaccaaaaucgacuuauggucuuauaaugccgagcugcucguagcacuugaaaaccaacauacaauugaucugacugacagcgagaugaauaaguuguucgaaaagaccaagaagcagcuaagggagaacgcugaagauaugggaaauggcugcuuuaaaauauaccacaagugugacaacgccugcaucgggucaauucggaauggaacauaugaucaugacguguaccgagacgaggcucugaacaaucgcuuccagaucaaaggugucgagcucaagaguggcuacaaagauuggauucuguggaucuccuuugccauaagcugcuuccuucuguguguggcauugcucggguuuaucaugugggccggacagaagggcaacaagagaugcaauauuuguaucuga

SEQ ID NO: 123772 - RNA, 1701 nt, Artificial Sequence
  derived and/or modified sequence opt3 from hemagglutinin__InfluenzaA__ABU92594
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaauccuguacccucauagaugcucugcuuggggacccgcagugcgauggauuucaaaacaaaaagugggaccuguucguggagagaucuaaagccuauucgaauuguuaccccuaugaugucccugacuacgcaucauugaggagccucguggccaguuccggcacucuggaauuuaacaaugagucuuucaacuggacagguguuacccagaaugggacgagcuccgcuugcaagcggcgcucaaacaauagcuuuuucagucgacugaacuggcucacucauuuaaaguuuaaauauccagcacugaaugugaccaugcccaacaacgagaaguucgauaaacuuuacaucuggggaguccaccauccuggcacagacaaugaucagauuuuucuuuaugcccaggcuucuggccguaucacuguguccaccaagagaucacaacagacaguaauuccaaacaucgggagcaggccccggguucgcaauauaccuaguagaauuucuaucuacuggaccauugugaaaccaggagacauccugcuaaucaacuccacggguaaucucauugccccgaggggcuacuucaagauacggagcgggaagucgucuaucaugcgcuccgaugcgcccauuggaaaauguaacucagaaugcaucacuccuaauggcaguauaccaaacgacaagcccuuucagaaugucaaccgaauuacauauggugcauguccuagauacgugaaacagaauacccugaaguuggccacugggaugaggaacgugccagagaaacaaacacggggaaucuucggcgcuaucgccggcuuuauugaaaaugggugggagggaauggucgacgguugguauggcuuccgucaccagaacagcgaggggaucggacaggcagcugaucugaaguccacccaagccgcgauuaaucagauaaacggcaaauugaaccgccucaucgguaagacgaaugaaaaguuccaccagauugagaaagaauuuucugagguugaagggagaauccaggaccuggagaaguacguggaggauaccaaaaucgacuuauggagcuauaacgccgaacugcucguagcacuugagaaucaacauacaauugaucugacugacucagaaaugaacaaguuguucgagaggaccaaaaagcagcuacgggaaaaugcugaggauaugggcaacggaugcuuuaagauauaccacaaaugugacaaugccugcaucggcaguauucgaaacgggacauaugaucaugacguguaccgcgaugaggcucugaauaacagauuccagaucaagggagucgaacucaaauccgguuacaaggacuggauucuguggaucagcuuugccauaucuugcuuccuucuguguguggcauugucaggcuuuaucaugugggccugccagaaagggaauauuagguguaacaucugcauuuga

SEQ ID NO: 123773 - RNA, 1701 nt, Artificial Sequence
  derived and/or modified sequence opt3 from hemagglutinin__InfluenzaA__ABU92595
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagguauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauuacauauggugcauguccuagauacgugaaacagaauacccugaagcuggccacugggaugaggaacgugccagagaaacaaacacggggaaucuucggcgcuaucgccggcuuuauugaaaaugggugggagggaauggucgaugguugguauggcuuccgucaccagaacagugaggggaucggacaggcagcugaccuuaagagcacccaagccgcgauugaucagauaaauggcaaauugaaccgccucaucgguaagacgaacgaaaaguuccaccagauugagaaagaauuuuccgagguugaagggagaauccaggaccuggagaaguacguggaggauaccaaaaucgacuuauggucuuauaaugccgaacugcucguagcacuugagaaccaacauacaauugaucugacugacagcgaaaugaauaaguuguucgagaaaaccaagaagcagcuaagggaaaacgcugaggauaugggcaauggaugcuuuaaaauauaccacaagugugacaacgccugcaucggcucaauucggaaugggacauaugaucaugacguguaccgagacgaggcucugaacaaucgcuuccagaucaaaggagucgaacucaagagugguuacaaagauuggauucuguggaucuccuuugccauaagcugcuuccuucuguguguggcauugcucggcuuuaucaugugggccugccagaaggggaacauuagauguaauaucugcauuuga

SEQ ID NO: 123774 - RNA, 1701 nt, Artificial Sequence
  derived and/or modified sequence opt3 from hemagglutinin__InfluenzaA__ABU92596
augaagaccaucauugcccugagcuacauacucugccuuguguucgcucagaaacugcccggcaacgacaauuccacagcaacuuuguguuuagggcaccaugccgucccuaacggaacgaugguuaagaccaucacaaaugaucaaauugaggugacuaacgcgaccgaacugguacagucuucaaguacaggugagaucugcgacagcccacaccagauucuagauggcgaaaauuguacccucaucgacgcucugcuuggggauccgcagugcgacggauuucaaaacaaaaagugggaucuguucguggagagauccaaagcccauucuaauuguuaucccuacgacgucccugauuaugcaucguugaggucacucauagccagcaguggcacucuggaauuuaacaaugaguccuucaacuggacaggugugacccagaaugggacgucuagcgcuugcaagcggcgcuccgacaacucauuuuucagucgacugaauuggcucacucacuuaaaguuuaaauacccagcacugaacguuaccaugcccaauaacgaggaguucgauaaacuuuauaucuggggagugcaucacccuggcacagacaacgaucagauuagcuuguacgcccaggcuucuggccguaucacugucuccaccaagagaucacaacagacagugauuccaaauaucgggagcaggccccggguacgcgacauaccuaguagaauuucuaucuauuggaccauuguuaagccaggagacauccugcuaaucaacuccacggguaaucucauugccccgaggggcuacuuuaaaauacggagcgggaagucgucuaucaugcgcuccgaugcgcccauuggaaaguguaacucaggcugcaucacuccuaaugguaguauaccaaacgacaaacccuuccagaaugugaaccgaauuacauacggggcauguccuagauaugucaagcagaauacccugaaacuugccacuggaaugaggaacgugccagaaaagcaaacacggggcaucuuuggcgcuaucgccggguucauugaaaauggaugggaggguaugguggauggcugguacggguuucgucaccagaacagcgagggaaucggccaggcagcugaccugaaauccacccaagccgcgauugaucagauaaaugguaaguugaaccgccucaucgggaaaacgaaugaaaaguuccaucagauugagaaggaguucucugaagucgaaggcagaauccaggaccuggagaaauauguugaggauaccaagaucgacuuauggagcuacaacgccgaacugcucguggcacuugagaaccaacacacaauugaucugacugacucagaaaugaauaaauuguuugagaggaccaagaaacagcuacgggaaaacgcugaggauaugggaaauggcugcuucaagauauaucauaagugugacaacgccugcaucgggaguauucgaaauggaacauacgaccacgauguauaucgcgacgaggcucugaacaauagauuucagaucaaagguguggaacucaaguccggcuacaaagauuggauucuguggaucagcuucgccauaucuugcuuucuucugugugucgcauugcucggguucaucaugugggccugccagaagggaaacauuagguguaauaucugcauuuga

SEQ ID NO: 123775 - RNA, 1701 nt, Artificial Sequence; identical to SEQ ID NO: 122646
  derived and/or modified sequence opt3 from hemagglutinin__InfluenzaA__ABU92597

SEQ ID NO: 123776 - RNA, 1701 nt, Artificial Sequence; identical to SEQ ID NO: 122089
  derived and/or modified sequence opt3 from hemagglutinin__InfluenzaA__ABU92601

SEQ ID NO: 123777 - RNA, 1701 nt, Artificial Sequence; identical to SEQ ID NO: 122089
  derived and/or modified sequence opt3 from hemagglutinin__InfluenzaA__ABU92602

SEQ ID NO: 123778 - RNA, 1701 nt, Artificial Sequence
  derived and/or modified sequence opt3 from hemagglutinin__InfluenzaA__ABU92603
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucgacuggacagguguuacccagaacgggacguccucugcuugcaagcggcgcagcgauaaguccuuuuucucacgacugaauuggcucacucauuuaaaauauaaguacccagcacugaacgugaccaugcccaauaacgagaaauuugacaaacuuuauauuuggggaguccaccauccuggcacagauagugaccagaucagcuuguacgcccaggcuucuggccguauuacuguguccaccaagagaucacaacagacaguaaucccaaauauagggagcaggccccggguucgcgacgugaguucuagaauuuccaucuacuggaccauugucaagccuggagauauccugcuaaucaacagcacggguaaccucauugccccaaggggcuauuucaagauacggucggggaaaucuuccaucaugcgcucagacgcgccgauuggaaaguguaauagugaaugcaucacucccaacggcagcauaccuaaugauaaaccauuucagaacgugaaucgaauuacauacggugcaugucccagauaugugaagcagaacacccugaaacuugccacugggaugaggaaugucccugagaagcaaacacggggaaucuucggcgcuaucgccggcuuuauugaaaacgggugggagggaaugguugacgguugguacggcuuccgucaccaaaauuccgaggggaccggacaggcagcugaucugaaaucuacgcaggccgcgaucaaccagauuaauggcaaguugaaccgccucauagguaagaccaaugaaaaauuucaccagaucgagaaggaguucagcgaaguggaagggaggauucaggaccuggagaaauauguagaggauacaaagaucgacuuauggucauacaacgccgaacugcucguggcacuugagaaucaacauacuaucgaucugaccgacagugaaaugaacaaauuguucgagagaacaaagaagcagcuacgggaaaacgcugaggauaugggcaauggaugcuuuaaaauuuaucacaagugugacaacgccugcauaggcuccauccgaaaugggacuuacgaccaugaugucuaccgcgacgaggcucugaacaauagauuccagauuaaaggaguggaacucaagagcgguuauaaagauuggauccuguggauuucuuuugccaucucaugcuuccuucuguguguugcauugcucggcuuuauaaugugggccugccagaaggggaacaucagguguaauauuugcaucuga

SEQ ID NO: 123779 - RNA, 1701 nt, Artificial Sequence; identical to SEQ ID NO: 122089
  derived and/or modified sequence opt3 from hemagglutinin__InfluenzaA__ABU92604

SEQ ID NO: 123780 - RNA, 1701 nt, Artificial Sequence; identical to SEQ ID NO: 123778
  derived and/or modified sequence opt3 from hemagglutinin__InfluenzaA__ABU92605

SEQ ID NO: 123781 - RNA, 1701 nt, Artificial Sequence; identical to SEQ ID NO: 123778
  derived and/or modified sequence opt3 from hemagglutinin__InfluenzaA__ABU92606

SEQ ID NO: 123782 - RNA, 1701 nt, Artificial Sequence; identical to SEQ ID NO: 122628
  derived and/or modified sequence opt3 from hemagglutinin__InfluenzaA__ABU92608

SEQ ID NO: 123783 - RNA, 1701 nt, Artificial Sequence; identical to SEQ ID NO: 122628
  derived and/or modified sequence opt3 from hemagglutinin__InfluenzaA__ABU92609

SEQ ID NO: 123784 - RNA, 1701 nt, Artificial Sequence
  derived and/or modified sequence opt3 from hemagglutinin__InfluenzaA__ABU92610
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauagcaaguuuaaauauccagcauuaaaugugaccaugcccaacaacgagaaguucgacaaacuguacaucuggggaguccaccauccuggcacagauaaugaccagauuuuucuuuaugcccaggcuucuggccguaucacuguguccaccaagagaucacaacagacaguaauuccaaacaucgggagcaggccccggguucgcaauauaccuaguagaauuucuaucuacuggaccauugugaaaccaggagauaucuugcugaucaacuccacggguaaucuaauugccccgaggggcuacuucaagauacggagcgggaagucgucuaucaugcgcuccgacgcgcccauuggaaaauguaacucagaaugcaucacuccuaauggcaguauaccaaacgacaagcccuuucagaaugucaaccgaauugcauauggugccuguccuagauacgugaaacagaauacacucaagcuggcuaccgggaugaggaacgugccagagaaacaaacucggggaaucuucggcgccaucgcaggcuuuauugaaaaugggugggagggaauggucgaugguugguauggcuuccgucaccagaacagcgaggggaucggacaggcugccgaccuuaaguccacacaagcggccauuaaucagauaaacggcaaacugaaccgcuugaucgguaagaccaaugaaaaguuccaccagauugagaaagaauuuucugagguugaagggagaauccaggaucucgagaaguacguggaggacacgaaaaucgaucuguggagcuauaacgcagaauuacugguagcucucgagaaucaacauaccauugaccuuacagauucagaaaugaacaagcuguucgagaggacuaaaaagcaguugcgggaaaaugccgaggacaugaguaacggcugcuuuaagauauaccacaaaugugauaaugcuugcaucggauccauucgaaacggcaccuaugaccaugauguguaccgcgacgaggcccuaaauaacagauuccagaucaagggggucgaacugaaaagcggauacaaggacuggauucucuggaucucuuuugcaauaucaugcuuccugcuuugugugguucuguuggguuuuaucaugugggccugccagaaaggcaauauuagguguaacaucugcauuuga

SEQ ID NO: 123785 - RNA, 1701 nt, Artificial Sequence
  derived and/or modified sequence opt3 from hemagglutinin__InfluenzaA__ABU92611
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgaggaguucgacaaacuuuacauuuggggcgugcaccauccuggcacagauaaugaccagaucagcuuguaugcccaggcuucugggaagauuacugucuccaccaagcguucacaacagacagugaucccaaacauaggaagcagacccaggguacgggauauuccuagucgcaucucuauuuacuggaccaucguuaaaccaggugacauccugcuaauuaauuccacgggcaaccucauagccccgagaggguacuuuaagaucaggagcggaaagucgucuauuaugcgguccgacgcgcccaucggcaaauguaauucagaaugcauaacuccuaacgguaguauuccaaaugauaagcccuuccagaacgugaaucgcaucacauauggggcauguccucgauacgucaaacagaacacccugaaacuugccacuggaaugagaaaugugccagagaagcaaacaaggggcaucuuuggcgcuauugccggguucaucgaaaacggaugggaggguaugguggacggcugguauggguuucggcaccagaauagcgagggaauuggccaggcagcugaucugaaguccacccaagccgcgauagaccagaucaacgguaaauugaaucgucucauugggaagacgaacgaaaaguuccaccagaucgagaaagaguucucugaagucgaaggccgcauccaggaucuggagaaguacguugaggacaccaaaauugauuuauggagcuauaacgccgaacugcucguggcacuugagaaucaacauacaauagaccugacugauucagaaaugaacaaguuguuugagagaaccaaaaagcagcuaagggaaaaugcugaggacaugggaaacggcugcuucaagaucuaccacaaaugugauaaugccugcauugggaguauccggaacggaacauaugaccaugacguauaccgagaugaggcucugaauaaccgcuuucagauuaaggguguggaacucaaauccggcuacaaggacuggauccuguggaucagcuucgccauaucuugcuuucuucugugugucgcauugcucggguucauuaucugggccugccugaaaggaaauauuagauguaacaucugcauauga

SEQ ID NO: 123786 - RNA, 1701 nt, Artificial Sequence
  derived and/or modified sequence opt3 from hemagglutinin__InfluenzaA__ABU92612
augaagaccaucauugcccugagcuacauacucugccuuguguucgcucagaaacugcccggcaacgacaauuccacagcaacuuuguguuuagggcaccaugccgucccuaacggaacgaugguuaagaccaucacaaaugaucaaauugaggugacuaacgcgaccgaacugguacagucuucaaguacagguggcaucugcgacagcccacaccagauucuagauggggagaauuguacccucaucgacgcucugcuuggagauccgcagugcgacggcuuucaaaacaaaaagugggaucuguucguggaaagauccaaagcccauucuaauuguuaucccuacgacgucccugauuaugcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucacuuaaaguuuaaauacccagcacugaaugugaccaugcccaacaacgagaaguucgacaaacuuuauauauggggcguccaucacccuggcacagauaaugaccagaucagcuuguacgcccaggcuucugggcguauuacuguguccaccaagagaucacaacagacaguaaucccaaacauuggaagcaggccccggguucgcgauaucccuaguagaauaucuauuuauuggaccaucgugaaaccaggugacauucugcuaaucaauuccacgggcaaccucaucgccccgaggggguacuuuaagauucggagcggaaagucgucuauaaugcgcuccgacgcgcccaucggcaaauguaauucagagugcauuacuccuaacgguaguaucccaaauaacaagcccuuccagaaugucaaccgaauaacauacggggcauguccuagauaugugaaacagaauacccugaaacuugccacuggaaugaggaacgugccagaaaagcaaacacggggcauuuuuggcgcuaucgccggguucaucgagaauggaugggaagguauggucgauggcugguacggguuucgucaccagaacagcgagggaauuggccaggcagcugaccugaaguccacccaagccgcgaucaaucagauuaacgguaaauugaaccgccucauagggaagacgaaugagaaguuccaucagaucgaaaaagaguucucugaaguugagggcaggauucaggaucuggaaaaguauguggaggacaccaaaaucgauuuauggagcuacaacgccgagcugcucguagcacuugaaaaucaacacacaaucgaccugacugauucagagaugaacaaguuguuugaaagaaccaaaaagcagcuacgggagaaugcugaagacaugggaaacggcugcuucaagauuuaucauaaaugugauaaugccugcauagggaguauccgaaacggaacauacgaccacgauguguaucgcgacgaggcucugaauaacagauuucagauuaagggugucgagcucaaauccggcuacaaggacuggauccuguggauuagcuucgccaucucuugcuuucuucuguguguggcauugcucggguucauaaugugggccugccagaaaggaaauaucagguguaacauuugcaucuga

SEQ ID NO: 123787 - RNA, 1701 nt, Artificial Sequence; identical to SEQ ID NO: 123274
  derived and/or modified sequence opt3 from hemagglutinin__InfluenzaA__ABU92613

SEQ ID NO: 123788 - RNA, 1701 nt, Artificial Sequence; identical to SEQ ID NO: 123773
  derived and/or modified sequence opt3 from hemagglutinin__InfluenzaA__ABU92614

SEQ ID NO: 123789 - RNA, 1701 nt, Artificial Sequence
  derived and/or modified sequence opt3 from hemagglutinin__InfluenzaA__ABU92615
augaagaccaucauugcccugagcuacauacucugccuuguguucgcucagaaacugcccggcaacgacaauuccacagcaacuuuguguuuagggcaccaugccgucccuaacggaacgaucguuagaaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaagaaaugggaucuguucguggaaagguccaaggccuauucuaauuguuaccccuaugacgucccugauuacgcaucguugcggucacucguggccagcagugguacucuggaguuuaacaaugaauccuucaacuggacagggguuacccagaauggaacgucuagcgcuugcaaacgccgauccaacaauucauuuuucagucgucugaacuggcucacucauuuaaaguuuaaguauccagcacugaaugugaccaugcccaacaacgagaaauucgacaaacuuuacaucuggggcguccaccauccuggcacagauaaugaccagauuagcuuguaugcccaggcuucugggagaaucacuguguccaccaagaggucacaacagacaguaauuccaaacguuggaagccggccccgcgugagagauaucccuaguaggauaucuauuuacuggaccaucgucaagccaggugacauucugcuaaucaauuccacgggcaaccucaucgccccgcggggguacuuuaaaauucgcagcggaaagucgucuauaaugcgauccgacgcgcccaucggcaaguguaauucagagugcauuacuccuaacgguaguaucccaaaugauaaacccuuccagaacgugaauagaauaacauauggggcauguccuagguacgugaagcagaacacccugaaacuugccacuggaaugcggaaugucccagaaaagcaaacacguggcauuuuuggcgcuaucgccggguucaucgagaacggaugggaagguaugguugacggcugguauggguuucgccaccagaauagcgagggaauuggccaggcagcugaucugaaauccacccaagccgcgaucaaccagauuaaugguaaguugaacagacucauagggaaaacgaacgagaaguuccaccagaucgaaaaggaguucucugaaguggagggcaggauucaggaccuggaaaaauacguagaggauaccaagaucgacuuauggagcuauaaugccgagcugcucguggcacuugaaaaccaacauacaaucgaucugacugacucagagaugaauaaauuguuugaacggaccaagaaacagcuacgagagaacgcugaagauaugggaaauggcugcuucaagauuuaccacaagugugacaacgccugcauagggaguauccgcaauggaacauaugaucaugacgucuacagagacgaggcucugaacaauagguuucagauuaaagguguggagcucaaguccggcuacaaagauuggauccuguggauuagcuucgccaucucuugcuuucuucuguguguugcauugcucggguucauaaugugggccugccagaagggaaacauccgguguaauauuugcaucuga

SEQ ID NO: 123790 - RNA, 1701 nt, Artificial Sequence
  derived and/or modified sequence opt3 from hemagglutinin__InfluenzaA__ABU92617
augaagaccaucauugcccugagcuacauacucugccuuguguucgcucagaaacugcccggcaacgacaauuccacagcaacuuuguguuuagggcaccauucugucccuaacggaacgaucguuaagaccauuacaaaugaucaaaucgaggugacuaacgccaccgaacugguacagucaaguagcacagguggcauuugcgacuccccacaccagauccuagauggggagaauuguacccucauagacgcgcugcuuggagauccgcagugcgacggcuuucaaaacaaaaagugggaucuguucguggaaagaucuaaggcuuauucgaauuguuaccccuaugacgucccugauuacgccucauugaggagccucaucgcaaguuccgguacucuggaguuuaacaaugaaucuuucaacuggacaggggugacccagaauggaacgagcuccgccugcaagcggcgcucaaacaguagcuuuuucucucgacugaauuggcucacucauuuaaaguuuaaauauccagcucugaacguuaccaugcccaauaacgaggaguucgacaaacuuuacauuuggggcgugcaccauccuggcacagauaacgaccagaucuccuuguaugcacaggccucagggcguauuacugucagcaccaaaagaagucaacagacagugaucccaaauauaggaucuaggccccggguacgcgauauuccuuccagaaucagcauuuacuggaccaucguuaagccaggugacauccugcuaauuaacucgacgggcaaucucauagcuccgaggggguacuuuaaaauccggucuggaaaguccucaauuaugcgcagugacgcccccaucggcaaguguaacagcgaaugcauaacuccuaaugguuccauuccaaacgauaaacccuuccagaaugugaaccgaaucacauauggggcguguccuagauacgucaagcagaauacccugaaacuugcaacuggaaugaggaacgugccagagaagcaaacacggggcaucuuuggcgccauugcuggguucaucgaaaauggaugggaggguaugguggacggcugguauggguuucgucaccagaacucugagggaauuggccaggccgcagaucugaaaagcacccaagcugccauagaccagaucaaugguaaguugaaccgccucauugggaaaacgaaugaaaaguuccaccagaucgagaaggaguucucagaagucgaaggcagaauccaggaucuggagaaauacguugaggacaccaagauugauuuauggaguuauaacgcggaacugcucguggcccuugagaaccaacauacaauagaccugacugauuccgaaaugaauaaauuguuugagaggaccaagaaacagcuacgggaaaacgcagaggacaugggaaauggcugcuucaagaucuaccacaagugugauaacgcuugcauugggagcauccgaaauggaacauaugaccaugacguauaccgcgaugaggcccugaacaauagauuucagauuaaagguguggaacucaagucuggcuacaaagacuggauccuguggauaucauucgcuaucaguugcuuucuucugugugucgccuugcucggguucauuaugugggcaugccagaagggaaacaucagguguaauauuugcaucuga

SEQ ID NO: 123791 - RNA, 1701 nt, Artificial Sequence; identical to SEQ ID NO: 123274
  derived and/or modified sequence opt3 from hemagglutinin__InfluenzaA__ABU92619

SEQ ID NO: 123792 - RNA, 1701 nt, Artificial Sequence; identical to SEQ ID NO: 123773
  derived and/or modified sequence opt3 from hemagglutinin__InfluenzaA__ABU92620

SEQ ID NO: 123793 - RNA, 1701 nt, Artificial Sequence
  derived and/or modified sequence opt3 from hemagglutinin__InfluenzaA__ABU92622
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacagauaacgaccagaucucuuuguaugcccaggcuuccgggcguauuacugucucaaccaagagaagccaacagacagugaucccaaauauaggaaguaggccccggguacgcgauauuccuucuagaaucuccauuuacuggaccaucguuaagccaggugacauccugcuaauuaacagcacgggcaaucucauagccccgaggggguacuuuaaaauccggucgggaaagucuuccauuaugcgcucagacgcgcccaucggcaaguguaacagugaaugcauaacuccuaaugguagcauuccaaacgauaaacccuuccagaaugugaaccgaaucacauauggggcauguccuagauccgucaagcagaauacccugaaacuugccacuggaaugaggaacgugccagagaagcaaacacggggcaucuuuggcgcuauugccggguucaucgaaaauggaugggaggguaugguggacggcugguacggguuucgucaccagaacucugagggaauuggccaggcagcugaucugaaaagcacccaagccgcgauagaccagaucaaugguaaguugaaccgccucauugggaaaacgaaugaaaaguuccaccagaucgagaaggaauuuucagaggucgaaggcagaauccaggaucuggagaaauauguugaggacaccaagauugauuuauggaguuacaacgccgaacugcucguggcacuugagaaccaacauacaauagaccugacugauuccgaaaugaauaaauuguuugagaggaccaagaaacagcuacgggaaaacgcugaggacaugggaaauggcugcuucaagaucuaucacaagugugauaacgccugcauugggagcauccgaaauggaacauacgaccaugacguauaucgcgaugaggcucugaacaauagauuucagauuaaagguguggaacucaagucuggcuacaaagacuggauccuguggauaucauucgccaucaguugcuuucuucugugugucgcauugcucggguucauuaugugggccugccagaagggaaacaucagguguaauauuugcaucuga

SEQ ID NO: 123794 - RNA, 1701 nt, Artificial Sequence; identical to SEQ ID NO: 122089
  derived and/or modified sequence opt3 from hemagglutinin__InfluenzaA__ABU92623

SEQ ID NO: 123795 - RNA, 1701 nt, Artificial Sequence
  derived and/or modified sequence opt3 from hemagglutinin__InfluenzaA__ABU92624
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucgacuggacagguguuacccagaacgggacguccucugcuugcaagcggcgcagcgauaaguccuuuuucucacgacugaauuggcucacucauuuaaaauauaaguacccagcacugaacgugaccaugcccaauaacgagaaauuugacaaacuuuauauuuggggaguccaccauccuggcacagauagugaccagaucagcuuguacgcccaggcucugggccguauuacugugucuaccaagagaucccaacagacaguaaucccaaauauagggucaaggccccggguucgcgacgugagcaguagaauuucuaucuacuggaccauugucaagccuggagauauccuacucaucaacuccacggguaaccugauugccccaaggggcuauuucaagauacggagcgggaaaucgucuaucaugcgcuccgacgcgccgauuggaaaguguaauucagaaugcaucacucccaacggcaguauaccuaaugauaaaccauuucagaacgugaaucgaauuacauacggugcaugucccagauaugugaagcagaacacccuuaaacuggccacugggaugaggaaugucccugagaagcaaacacggggaaucuucggcgcuaucgccggcuuuauugaaaacgggugggagggaaugguugacgguugguacggcuuccgucaccagaauagcgaggggaccggacaggcagcugauuugaaauccacgcaagccgcgaucaaccagauuaauggcaagcucaaccgccugauagguaagaccaaugaaaaauuucaccagaucgagaaggaguucucugaaguggaagggaggauucaggacuuagagaaauauguagaggauacaaagaucgaccuguggagcuacaacgccgaacuccuuguggcacuggagaaucaacauacuaucgauuugaccgacucagaaaugaacaaacuauucgagagaacaaagaagcagcugcgggaaaacgcugaggauaugggcaauggaugcuuuaaaauuuaucacaagugugacaacgccugcauaggcaguauccgaaaugggacuuacgaccaugaugucuaccgcgacgaggcucucaacaauagauuccagauuaaaggaguggaacugaaguccgguuauaaagauuggauccuuuggauuagcuuugccaucucuugcuuccuguuguguguugcacuccugggcuuuauaaugugggccugccagaaggggaacaucagguguaauauuugcaucuga

SEQ ID NO: 123796 - RNA, 1701 nt, Artificial Sequence; identical to SEQ ID NO: 123778
  derived and/or modified sequence opt3 from hemagglutinin__InfluenzaA__ABU92625

SEQ ID NO: 123797 - RNA, 1701 nt, Artificial Sequence; identical to SEQ ID NO: 122089
  derived and/or modified sequence opt3 from hemagglutinin__InfluenzaA__ABU92626

SEQ ID NO: 123798 - RNA, 1701 nt, Artificial Sequence
  derived and/or modified sequence opt3 from hemagglutinin__InfluenzaA__ABU92627
augaagaccaucauugcccugagcuacauacucugcaugguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagauuucuucaacaggugagaucugcgacaguccacaccagauacuggauggcgaaaauuguacccuaaucgacgcucuccugggggauccgcagugcgacggauuucaaaacaaaaagugggaucuuuucguggagagaagcaaagccuauuccaauuguuaccccuaugacgucccugauuacgcaucucugaggucguugguggccucaagcggcacucucgaauuuaacaaugagaguuucgacuggacagguguuacccagaacgggacguccucugcuugcaagcggcgcagcgauaaguccuuuuucucacgacugaauuggcugacucaucucaaauauaaguacccagcauuaaacgugaccaugcccaauaacgagaaauuugacaagcuguauauuuggggaguccaccauccuggcacagauagugaccagaucagccuuuacgcccaggcuucuggccguauuacuguguccaccaaaagaucacaacagacaguaaucccaaauauagggagcaggccccggguucgcgacgugaguucuagaauuuccaucuacuggaccauugucaagccuggagauaucuugcugaucaacaggccagguaaccuaauugccccgcggggcuauuucaagauacgcagcgggaaaucgucuaucaugcgauccgacgcgcccauuggaaaguguaauucagaaugcaucacgccuaacggcaguauaccaaaugauaaacccuuucagaacgugaauagaauuacuuacggugcauguccuagguaugugaagcagaacacacucaaacuggccaccgggaugcggaaugucccagagaagcaaacucguggaaucuucggcgcuaucgccggcuuuauugaaaacgggugggagggaaugguugacgguugguacggcuuccgccaccagaauagcgaggggacaggacaggcagcugaucuuaaauccacccaagccgcgaucaaccagauuaauggcaagcugaacagauugauagguaagacgaaugaaaaauuucaccagaucgagaaggaguucucugaaguggaagggaggauucaggaccucgagaaauauguagaggauaccaagaucgaccuguggagcuacaacgccgaauuacugguggcacucgagaaucaacauacaaucgaucuuacugacucagaaaugaacaaacuguucgagcggaccaagaagcaguugcgagaaaacgcugaggauaugggcaauggaugcuuuaaaauuuaucacaagugugacaacgccugcauaggcaguauccgcaaugggacauacgaccaugaugucuacagagacgaggcucuaaacaauagguuccagauuaaaggaguggaacugaaguccgguuauaaagauuggauccucuggauuagcuuugccaucucuugcuuccugcuuuguguugcacuguugggcuuuauaaugugggccugccagaaggggaacauccgguguaauauuugcaucuga

SEQ ID NO: 123799 - RNA, 1701 nt, Artificial Sequence; identical to SEQ ID NO: 123778
  derived and/or modified sequence opt3 from hemagglutinin__InfluenzaA__ABU92628

SEQ ID NO: 123800 - RNA, 1701 nt, Artificial Sequence; identical to SEQ ID NO: 123778
  derived and/or modified sequence opt3 from hemagglutinin__InfluenzaA__ABU92631

SEQ ID NO: 123801 - RNA, 1701 nt, Artificial Sequence
  derived and/or modified sequence opt3 from hemagglutinin__InfluenzaA__ABU92632
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacaagucauuuuucagucgacugaauuggcucacucauuuaaaauauaaguacccagcacugaacguuaccaugcccaauaacgagaaauuugacaagcuguauauuuggggcgugcaccauccuggcacagauagcgaccagaucucuuuguacgcccaggcuuccgggcguauuacugucucaaccaaaagaagccaacagacagugaucccaaacauaggaaguaggccccggguacgcgauguuucuuccagaauuagcaucuacuggaccauugugaagccuggugacauccugcuaaucaauucgacgggcaaccucauugccccaaggggguauuucaagauacggucuggaaaauccucaaucaugcgcagugacgcgccgauuggcaaguguaauagcgagugcaucacucccaacgguuccauaccuaaugauaaaccauuucagaacgucaaucgaauuacauacggggcaugucccagauaugugaagcagaacacccugaaacuugccacuggaaugaggaaugugccugaaaagcaaacacggggcaucuucggcgcuaucgccggguuuauugagaacggaugggaagguauggucgacggcugguacggguuccgucaccuuaauucugagggaaccggccaggcagcugauuugaaaagcacgcaggccgcgaucaaccaaauuaaugguaagcucaaccgccugauagggaagaccaaugagaaauuucaccagaucgaaaaggaguucucagaaguugagggcaggauucaggacuuagaaaaauauguggaggauacaaagaucgaccuguggaguuacaacgccgagcuccuuguagcacuggaaaaccagcauacuaucgauuugaccgacuccgagaugaauaaacuauucgaaagaacaaagaagcaacugcgggagaacgcugaagauaugggaaauggcugcuuuaaaauuuaucacaagugugacaacgccugcauagggagcauccgaaauggaacuuacgaucaugacguguaccgcgacgaggcucucaacaauagauuccagauuaaaggugucgagcugaagucuggcuauaaagauuggauccuuuggauuucauuugccaucaguugcuuccuguuguguguggcacuccugggguuuauaaugugggccugccagaagggaaacaucagguguaauauuugcaucuga

SEQ ID NO: 123802 - RNA, 1701 nt, Artificial Sequence
  derived and/or modified sequence opt3 from hemagglutinin__InfluenzaA__ABU92635
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucaaucguggccagcagugguacucucgaguuuaacaaugaauccuucaacuggacagggguuacccagaauggaacgucuagcgcuugcaagcggaaguccaacaaaucauuuuucagucgccugaauuggcugacucaucucaaguauaaauacccagcauuaaacgugaccaugcccaauaacgagaaguuugacaaacuguauauuuggggcguccaccauccuggcacagauaacgaccagaucagccuuuacgcccaggcuucugggcgaauuacuguguccaccaagcguucacaacagacaguaaucccaaauauaggaagcagacccaggguucgggaugugaguucucgcauuuccaucuacuggaccauugucaagccuggugacaucuugcugaucaacagcacgggcaaucuaauugccccaagaggguauuucaaaauaaggucgggaaagucuuccaucaugcggucagacgcgccgauuggcaaauguaacagugagugcaucacucccaaugguagcauaccuaacgauaagccauuucagaaugugaaccgcauuacauacggggcauguccccgauaugugaaacagaauacccucaagcuggccacuggaaugagaaacgucccugaaaaacaaacaaggggcaucuucggcgcuaucgccggguuuauugagaauggaugggaagguaugguugacggcugguacggguuccggcaccagaacuccgagggaaccggccaggcagcugaucuuaagucuacgcaagccgcgaucaaucagauuaacgguaagcugaaucguuugauagggaaaaccaacgagaaguuucaccagaucgaaaaagaguucagcgaaguggagggccgcauucaggaccucgaaaaguauguagaggauacaaaaaucgaccuguggucauacaacgccgaguuacugguggcacucgaaaaucaacauacuaucgaucuuaccgacagugagaugaacaagcuguucgaaagaacaaagaaacaguugagggagaaugcugaagauaugggaaacggcugcuuuaagauuuaucacaaaugugacaaugccugcauaggguccauccggaacggaacuuacgaucaugacgucuaccgagacgaggcucuaaauaaccgcuuccagauuaaggguguggagcugaaaagcggcuauaaggauuggauccucuggauuucuuuugccaucucaugcuuccugcuuuguguugcacuguugggguuuauaaugugggccugccagaagggaaauaucagauguaacauuugcaucuga

SEQ ID NO: 123803 - RNA, 1701 nt, Artificial Sequence; identical to SEQ ID NO: 122646
  derived and/or modified sequence opt3 from hemagglutinin__InfluenzaA__ABU92636

SEQ ID NO: 123804 - RNA, 1701 nt, Artificial Sequence
  derived and/or modified sequence opt3 from hemagglutinin__InfluenzaA__ABU92637
augaagaccaucauugcccugagcuacauacucugccuuguguucgcucagaaacugcccggcaacgacaauuccacagcaacuuuguguuuagggcaccaugccgucccuaacggaacgaccguuaagacaaucacuaaugaucaaauugaggugaccaacgcgacagaacugguacagucuucaaguaccgguggcaucugcgacagcccacaccagauucuagauggggagaauuguacucucaucgacgcucugcuuggagauccgcagugcgacggcuuucaaaacaaaaagugggaucuguucguggaaagauccaaagccuauucuaauuguuaccccuaugacgucccugauuacgugucguugaggucacucguugcaagcagugguacacuggaguuuaacaaugaauccuucaacuggaccggggugacgcagaauggaacuucuagcgccugcaagcggcgcuccaacaauucauuuuucagucgacugaacuggcucacccauuuaaaguuuaaauauccagcucugaaugucacaaugcccaacaacgagaaguucgacaaacuuuacauauggggcgugcaccauccuggcacugauaaugaccagaucagcuuguaugcacaggccucugggcguauuaccguauccacaaagagaucacaacagaccguuaucccaaacauuggaagcaggccccgggugcgcgauaucccuaguagaauaucuauuuacuggacgaucgucaaaccaggugacauucugcuaaucaauuccacuggcaaccucaucgcuccgaggggguacuuuaagauucggagcggaaagucgucuauaaugcgcuccgacgcccccaucggcaaauguaauucagagugcauuacaccuaacgguaguaucccaaaugauaagcccuuccagaacgugaaucgaauaaccuauggggcguguccuagauacgugaaacagaacacucugaaacuugcaacaggaaugaggaaugucccagaaaaacaaacccggggcauuuuuggcgccaucgcuggguucaucgagaacggaugggaagguaugguugacggcugguauggguuucgucaccagaauagcgagggaauuggccaggccgcagaucugaaguccacgcaagcugccaucaaccagauuaaugguaaauugaaccgccucauagggaagaccaacgagaaguuccaccagaucgaaaaagaguucucugaaguggagggcaggauucaggaccuggaaaaguacguagaggauacaaaaaucgacuuauggagcuauaaugcggagcugcucguggcccuugaaaaccaacauacuaucgaucugaccgacucagagaugaauaaguuguuugaaagaacaaagaagcagcuacgggagaacgcagaagauaugggaaauggcugcuucaagauuuaccacaaaugugacaacgcuugcauagggaguauccgaaauggaacuuaugaucaugacgucuaccgcgacgaggcccugaacaauagauuucagauuaaggguguggagcucaaauccggcuacaaggauuggauccuguggauuagcuucgcuaucucuugcuuucuucuguguguugccuugcucggguucauaaugugggcaugccagaaaggaaacaucagguguaauauuugcaucuga

SEQ ID NO: 123805 - RNA, 1701 nt, Artificial Sequence
  derived and/or modified sequence opt3 from hemagglutinin__InfluenzaA__ABU92639
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacacuaaaugggaucuguucguggagagaagcaaggccuauuccaauuguuaccccuaugacgucccugauuacgcaucuuugaggucgcucguggccucaagcggcacacuggaauuuaacaaugagaguuucgacuggaccgguguuacgcagaacgggacuuccucugcuugcaaacggcgcagcgauaaguccuuuuucucacgacugaauuggcucacccauuuaaaguauaaauacccagcacugaacgugacaaugcccaauaacgagaaguuugacaaacuuuauauuuggggaguccaccauccuggcacugauagugaccagaucagcuuguacgcccaggcuucuggccguauuaccguguccacaaagagaucacaacagaccguaaucccaaauauagggagcaggccccggguucgcgacgugaguucuagaauuuccaucuacuggacgauugucaaaccuggagauauccugcuaaucaacagcacugguaaccucauugccccaaggggcuauuucaagauacggucggggaagucuuccaucaugcgcucagacgcgccgauuggaaaauguaauagugaaugcaucacacccaacggcagcauaccuaaugauaagccauuucagaacgugaaucgaauuaccuacggugcaugucccagauaugugaaacagaacacucugaaacuugccacagggaugaggaaugucccugagaagcaaacccggggaaucuucggcgcuaucgccggcuuuauugaaaacgggugggagggaaugguugacgguugguacggcuuccgucaccaaaauuccgaggggacgggacaggcagcugaucugaagucuacccaggccgcgaucaaccagauuaauggcaaauugaaccgccucauagguaagacaaaugaaaaguuucaccagaucgagaaagaguucagcgaaguggaagggaggauucaggaccuggagaaguauaucgaggauacuaaaaucgacuuauggucauacaacgccgaacugcucguagcacuugagaaucaacauaccauugaucugacagacagugaaaugaacaaguuguucgagagaacuaaaaagcagcuacgggaaaacgcugaggauaugggcaauggaugcuuuaagauauaucacaaaugugacaacgccugcaucggcuccauucgaaaugggaccuacgaccaugauguguaccgcgacgaggcucugaacaauagauuccagaucaagggagucgaacucaaaagcgguuauaaggauuggauucuguggaucucuuuugccauaucaugcuuccuucuguguguggcauugcucggcuuuaucaugugggccugccagaaagggaacauuagguguaauaucugcauuuga

SEQ ID NO: 123806 - RNA, 1701 nt, Artificial Sequence
  derived and/or modified sequence opt3 from hemagglutinin__InfluenzaA__ABU92640
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauuacauauggugcauguccuagauacgugaaacagaauacccugaagcuggccacugggaugaggaacgugccagagaaacaaacacggggaaucuucggcgcuaucgccggcuuuauugaaaaugggugggagggaauggucgaugguugguauggcuuccgucaccagaacagugaggggaucggacaggcagcugaccuuaagagcacccaagccgcgauuaaucagauaaacggcaaauugaaccgccucaucgguaagacgaaugaaaaguuccaccagauugagaaagaauuuuccgagguugaagggagaauccaggaucuggagaaguacguggaggacaccaaaaucgauuuauggucuuauaacgccgaacugcucguagcacuugagaaucaacauacaauugaccugacugauagcgaaaugaacaaguuguucgagaggaccaaaaagcagcuacgggaaaaugcugaggacaugggcaacggaugcuuuaagauauaccacaaaugugauaaugccugcaucggcucaauucgaaacgggacauaugaccaugauguguaccgcgacgaggcucugaauaacagauuccagaucaagggagucgaacucaaaagugguuacaaggacuggauucuguggaucuccuuugccauaagcugcuuccuucugugugcagccuugcucggcuuuaucaugugggcuugccagaaagggaauauuagguguaacaucugcauuuga

SEQ ID NO: 123807 - RNA, 1701 nt, Artificial Sequence
  derived and/or modified sequence opt3 from hemagglutinin__InfluenzaA__ABU92641
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccaacaauucauuuuucagucgccugaacuggcucacucauuuaaaauuuaaguauccagcacugaaugugaccaugcccaacaacgagaaauucgacaaacuuuacaucuggggcguccaccauccuggcacagauaaugaccagauuagcuuguaugcccaggcuucugggcgaaucacuguguccaccaagcguucacaacagacaguaauuccaaacaucggaagcagacccaggguucgggauauaccuagucgcauuucuaucuacuggaccauugugaagccaggugacauccugcuaaucaauuccacgggcaaccucauugccccgagaggguacuuuaagauaaggagcggaaaaucgucuaucaugcgguccgacgcgcccauuggcaaguguaauucagagugcaucacuccuaacgguaguauaccaaaugauaaacccuuccagaacgucaaucgcauuacauauggggcauguccucgauacgugaagcagaacacccugaaacuugccacuggaaugagaaaugugccagaaaagcaaacaaggggcaucuuuggcgcuaucgccggguucauugagaacggaugggaagguauggucgacggcugguauggguuucggcaccagaauagcgagggaaucggccaggcagcugaucugaaauccacccaagccgcgauuaaccagauaaaugguaaguugaaccgucucaucgggaagacgaacgagaaauuccaccagauugaaaaggaguucucugaaguugagggccgcauccaggaccuggaaaaauacguggaggauaccaagaucgacuuauggagcuauaaugccgagcugcucguagcacuugaaaaccaacauacaauugaucugacugacucagagaugaauaaauuguuugaaagaaccaagaagcagcuaagggagaacgcugaagauaugggaaauggcugcuucaaaauauaccacaagugugacaacgccugcaucgggaguauucggaauggaacauaugaucaugacguguaccgagacgaggcucugaacaaucgcuuucagaucaaaggugucgagcucaaguccggcuacaaagauuggauucuguggaucagcuucgccauaucuugcuuucuucuguguguggcauugcucggguucaucaugugggccugccagaagggaaacauuagauguaauaucugcauuuga

SEQ ID NO: 123808 - RNA, 1701 nt, Artificial Sequence
  derived and/or modified sequence opt3 from hemagglutinin__InfluenzaA__ABU92642
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuuuucuuuaugcccaggcuagcgggcguaucauugugucuacuaagagaucccaacagaccguaaucccaaacauaggaucaaggccccggguucgcaauauuccuagcagaaucaguauuuacuggacaaucgugaaaccaggugauauccugcuaauuaacucuaccggcaaucucauagccccgaggggguacuucaagauccgguccggaaagagcucgauuaugcgcucugacgcgcccaucggcaaauguaacuccgagugcauaacgccuaaugguucaauuccaaacgacaagcccuuucagaaugucaaccgaaucacuuauggggcauguccuagauacgugaaacagaauacacugaaguuggccaccggaaugaggaacgugccagaaaaacaaacucggggcaucuucggcgcuauugccggguuuaucgagaauggaugggaagguauggucgauggcugguauggguuccgucaccagaacagugagggaauuggccaggcagcugaccugaaaagcacacaagccgcgauagaucagaucaaugguaaauugaaccgccucauugggaagaccaacgagaaguuccaccagaucgaaaaagaguuuuccgaaguugagggcagaauccaggaccuggaaaaguacguggaggauacgaaaauugacuuauggucuuauaaugccgagcugcucguagcacuugaaaaccaacauaccauagaucugacagacagcgagaugaauaaguuguucgaaaagacuaagaagcagcuaagggagaacgcugaagauaugggaaauggcugcuuuaaaaucuaccacaagugugacaacgccugcauugggucaauccggaauggaaccuaugaucaugacguguaccgagacgaggcucugaacaaucgcuuccagauuaaaggugucgagcucaagaguggcuacaaagauuggauccuguggauauccuuugccaucagcugcuuccuucuguguguggcauugcucggguuuauuaugugggccugccagaagggaaacaucagauguaauauuugcaucuga

SEQ ID NO: 123809 - RNA, 1701 nt, Artificial Sequence
  derived and/or modified sequence opt3 from hemagglutinin__InfluenzaA__ABU92643
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucgacuggacagguguuacccagaacgggacguccucugcuugcaagcggcgcagcgauaaguccuuuuucucacgacugaauuggcucacucauuuaaaauauaaguacccagcacugaacgugaccaugcccaauaacgagaaauuugacaaacuuuauauuuggggaguccaccauccuggcacagauagugaccagaucagcuuguacgcccaggcuucuggccguauuacuguguccaccaagagaucacaacagacaguaaucccaaauauagggagcaggccccggguucgcgacgugaguucuagaauuuccaucuacuggaccauugucaagccuggagauauccugcuaaucaacagcacggguaaccucauugccccaaggggcuauuucaagauacggucggggaaaucuuccaucaugcgcucagacgcgccgauuggaaaguguaauagugaaugcaucacucccaacggcagcauaccuaaugauaaaccauuucagaacgugaaucgaauuacauacggugcaugucccagauaugugaagcagaacacccugaaacuugccacugggaugaggaaugucccugagaagcaaacacggggaaucuucggcgcuaucgccggcuuuauugaaaacgggugggagggaaugguugacgguugguacggcuuccgucaccaaaauuccgaggggaccggacaggcagcugaucugaaaucuacgcaggccgcgaucaaccagauuaauggcaaguugaaccgccucauagguaagaccaaugaaaaauuucaccagaucgagaaggaguucagcgaaguggaagggaggauucaggaccuggagaaauauguagaggauacaaagaucgacuuauggucauacaacgccgaacugcucguggcacuugagaaucaacauacuaucgaucugaccgacagugaaaugaacaaauuguucgagagaacaaagaagcagcuacgggaaaacgcugaggauaugggcaauggaugcuuuaaaauuuaucacaagugugacaacgccugcauaggcuccauccgaaaugggacuuacgaccauaacgucuaccgcgaugaggcucugaauaacagauuccagauuaaaggaguggaacucaagagcgguuauaaagacuggauccuguggauuucuuuugccaucucaugcuuccuucuguguguugcauugcucggcuuuauaaugugggccugccagaaggggaauaucagguguaacauuugcaucuga

SEQ ID NO: 123810 - RNA, 1701 nt, Artificial Sequence
  derived and/or modified sequence opt3 from hemagglutinin__InfluenzaA__ABU92645
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauugcauauggugccuguccuagauacgugaaacagaauacacugaagcuggcuaccgggaugaggaacgugccagagaaacaaacucggggaaucuucggcgccaucgcaggcuuuauugaaaaugggugggagggaauggucgaugguugguauggcuuccgucaccagaacagugaggggaucggacaggcugccgaccuuaagagcacacaagcggccauuaaucagauaaacggcaaauugaaccgccucaucgguaagaccaaugaaaaguuccaccagauugagaaagaauuuuccgagguugaagggagaauccaggaucuggagaaguacguggaggacacgaaaaucgauuuauggucuuauaacgcagaacugcucguagcucuugagaaucaacauaccauugaccugacagauagcgaaaugaacaaguuguucgagaggacuaaaaagcagcuacgggaaaaugccgaggacaugggcaacggaugcuuuaagauauaccacaaaugugauaaugcuugcaucggcucaauucgaaacgggaccuaugaccaugauguguaccgcgacgaggcccugaauaacagauuccagaucaagggaauugaacucaaaagugguuacaaggacuggauccuguggauauccuuugcaaucagcugcuuccuucugugugucguguugcucggcuuuauuaugugggccugccagaaagggaauaucagguguaacauuugcaucuga

SEQ ID NO: 123811 - RNA, 1701 nt, Artificial Sequence
  derived and/or modified sequence opt3 from hemagglutinin__InfluenzaA__ABU92646
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuagcuuguaugcccaggcuucugggcguaucacuguguccaccaagagaucacaacagacaguaauuccaaauaucggaagcaggccccggguucgcgaugugccuaguagaauaucuauuuacuggaccaucgucaagccaggugacauucugcuaaucaacuccacgggcaaucucaucgccccgaggggguacuuuaagauucggagcggaaaaucgucuauaaugcgcuccgacgcgcccaucggcaaguguaacucagagugcauuacuccuaaugguaguaucccaaacgauaaacccuuccagaaugugaaccgaauaacauauggggcauguccuagauacgugaagcagaauacccugaaacuugccacuggaaugaggaacgucccagaaaagcaaacacggggcauuuuuggcgcuaucgccggguucaucgagaauggaugggaagguaugguugacggcugguauggguuucgucaccagaacagcgagggaaccggccaggcagcugaucugaaauccacgcaagccgcgauuaaucagaucaacgguaaguugaaucgccucauugggaagaccaacgagaaauuccaccagauagaaaaggaguucucugaaguggagggcagaauccaggaccuggaaaaauacguagaggauacaaagauugacuuauggagcuauaacgccgagcugcucguggcacuugaaaaucaacauacuaucgaucugaccgacucagagaugaacaaauuguuugaaaggacaaagaagcagcuacgggagaaugcugaagauaugggaaacggcugcuucaaaaucuaccacaagugugacaaugccugcauugggaguauacgaaacggaacuuaugaucaugacgucuaccgcgacgaggcucugaauaacagauuucagaucaaagguguggagcucaaguccggcuacaaagauuggauucuguggaucagcuucgccauuucuugcuuucuucuguguguugcauugcucggguucaucaugugggccugccagaagggaaauauaagguguaacaucugcauuuga

SEQ ID NO: 123812 - RNA, 1701 nt, Artificial Sequence; identical to SEQ ID NO: 122089
  derived and/or modified sequence opt3 from hemagglutinin__InfluenzaA__ABU92647

SEQ ID NO: 123813 - RNA, 1701 nt, Artificial Sequence
  derived and/or modified sequence opt3 from hemagglutinin__InfluenzaA__ABU92648
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucaacuggacagguguuacccagaaugggacguccucugcuugcaagcggcgcagcgacaaguccuuuuucucacgacugaacuggcucacucauuuaaaauauaaguacccagcacugaaugugaccaugcccaacaaugagaaauuugauaaacuuuauauuuggggaguccaccauccuggcacagacagugaucagaucagcuuguacgcccaggcuucuggccguauuacuguguccaccaagagaucacaacagacaguaaucccaaacauagggagcaggccccggguucgcgacgugaguucuagaauuuccaucuacuggaccauugucaagccuggagacauccugcuaaucaacagcacggguaaucucauugccccaaggggcuauuucaagauacggucggggaaaucuuccaucaugcgcucagaugcgccgauuggaaaguguaacagugaaugcaucacucccaauggcagcauaccuaacgacaaaccauuucagaaugugaaccgaauuacauacggugcaugucccagauaugugaagcagaauacccugaaacuugccacugggaugaggaacgucccugagaagcaaacacggggaaucuucggcgcuaucgccggcuuuauugaaaaugggugggagggaaugguugaugguugguacggcuuccgucaccagaacuccgaggggaccggacaggcagcugaccugaaaucuacgcaagccgcgaucaaucagauuaacggcaaguugaaucgccucauagguaagaccaacgaaaaauuucaccagaucgagaaggaguucagcgaaguggaagggaggauucaggaucuggagaaauauguagaggacacaaagaucgauuuauggucauacaaugccgaacugcucguggcacuugagaaccaacauacuaucgaccugaccgauagugaaaugaacaaauuguucgagagaacaaagaagcagcuacgggaaaaugcugaggacaugggcaacggaugcuuuaaaauuuaucacaagugugauaaugccugcauaggcuccauccgaaacgggacuuacgaccaugacgucuaccgcgaugaggcucugaauaacagauuccagauuaaaggaguggaacucaagagcgguuauaaagacuggauccuguggauuucuuuugccaucucaugcuuccuucuguguguugcauugcucggcuuuauaaugugggccugccagaaggggaauaucagguguaacauuugcaucuga

SEQ ID NO: 123814 - RNA, 1701 nt, Artificial Sequence; identical to SEQ ID NO: 122089
  derived and/or modified sequence opt3 from hemagglutinin__InfluenzaA__ABU92649

SEQ ID NO: 123815 - RNA, 1701 nt, Artificial Sequence; identical to SEQ ID NO: 123778
  derived and/or modified sequence opt3 from hemagglutinin__InfluenzaA__ABU92650

SEQ ID NO: 123816 - RNA, 1701 nt, Artificial Sequence
  derived and/or modified sequence opt3 from hemagglutinin__InfluenzaA__ABU92651
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuuauaacgagaguuucgacuggacagguguuacccagaaugggacguccucugcuugcaagcggcgcagcgauaaguccuuuuucucacgacugaacuggcucacucauuuaaaauacaaguauccagcacugaaugugaccaugcccaacaaugagaaauuugacaaacuuuacauuuggggaguccaccauccuggcacagauagugaccagaucagcuuguacgcccaggcuucuggccguauuacuguguccaccaagagaucacaacagacaguaaucccaaacauagggagcaggccccggguucgcgacgugaguucuagaauuuccaucuauuggaccauugucaagccuggagauauccugcuaaucaauagcacggguaaccucauugccccaaggggcuacuucaagauacggucggggaaaucuuccaucaugcgcucagacgcgccgauuggaaaguguaacagugaaugcaucacucccaauggcagcauaccuaacgauaaaccauuucagaaugugaaccgaauuacauauggugcaugucccagauacgugaagcagaauacccugaaacuugccacugggaugaggaacgucccugagaagcaaacacggggaaucuucggcgcuaucgccggcuuuauugaaaaugggugggagggaaugguugacgguugguauggcuuccgucaccagaacuccgaggggaccggacaggcagcugaucugaaaucuacgcaagccgcgaucaaucagauuaacggcaaguugaaucgccucauagguaagaccaacgaaaaauuucaccagaucgagaaggaguucagcgaaguggaagggaggauucaggaccuggagaaauacguagaggauacaaagaucgacuuauggucauauaaugccgaacugcucguggcacuugagaaccaacauacuaucgaucugaccgacagugaaaugaauaaauuguucgagagaacaaagaagcagcuacgggaaaacgcugaggauaugggcaacggaugcuuuaaaauuuaccacaagugugacaaugccugcauaggcuccauccgaaacgggacuuacgaccaugaugucuaucgcgacgaggcucugaauaacagauuccagauuaaaggaguggaacucaagagcgguuacaaagauuggauccuguggauuucuuuugccaucucaugcuuccuucuguguguugcauugcucggcuuuauaaugugggccugccagaaggggaauaucagguguaacauuugcaucuga

SEQ ID NO: 123817 - RNA, 1701 nt, Artificial Sequence
  derived and/or modified sequence opt3 from hemagglutinin__InfluenzaA__ABU92652
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugauggcugguacggguuccgucaccagaacucugagggaaccggccaggcagcugaccugaaaagcacgcaagccgcgauuaaucagaucaacgguaaguugaaucgccucauugggaagaccaacgagaaauuucaccagauagaaaaggaguucucagaaguggagggcagaauccaggaucuggaaaaauauguagaggacacaaagauugauuuauggaguuacaaugccgagcugcucguggcacuugaaaaccaacauacuaucgaccugaccgauuccgagaugaacaaauuguucgaaaggacaaagaagcagcuacgggagaaugcugaagacaucggaaacggcugcuuuaaaauuuaucacaagugugauaaugccugcauagggagcauccgaaacggaacuuacgaccaugacgucuaccgcgaugaggcucugaauaacagauuccagauuaaagguguggagcucaagucuggcuauaaagacuggauccuguggauuucauuugccaucaguugcuuccuucuguguguugcauugcucggguuuauaaugugggccugccagaagggaaauaucagguguaacauuugcaucuga

SEQ ID NO: 123818 - RNA, 1701 nt, Artificial Sequence; identical to SEQ ID NO: 123778
  derived and/or modified sequence opt3 from hemagglutinin__InfluenzaA__ABU92653

SEQ ID NO: 123819 - RNA, 1701 nt, Artificial Sequence
  derived and/or modified sequence opt3 from hemagglutinin__InfluenzaA__ABU92654
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaguuguacaucuggggcguccaccauccuggcacagauaacgaccagauuagcuuguaugcccaggcuucugggaaaaucacuguguccaccaagcguucacaacagacaguaauuccaaauaucggaagcagacccaggguucgggaugugccuagucgcauaucuauuuacuggaccaucgucaagccaggugacauucugcuaaucaacuccacgggcaaucucaucgccccgagaggguacuuuaaaauuaggagcggaaagucgucuauaaugcgguccgacgcgcccaucggcaaauguaacucagagugcauuacuccuaaugguaguauccugaacgauaagccauuccagaaugugaaccgcauaacauauggggcauguccccgauacgugaaacagaauacccuuaagcuggccacuggaaugagaaacgucccugaaaaacaaacaaggggcauuuuuggcgcuaucgccggguucaucgagaauggaugggaagguaugguugacggcugguauggguuucggcaccagaacgcagagggaaccggccaggcugccgaucuuaagagcacgcaagcggccauuaaucagaucaacgguaagcucaaucgucugauugggaaaaccaacgagaaguuccaccagauagaaaaagaguucuccgaaguggagggccgcauccaggacuuagaaaaguacguagaggauacaaaaauugaccuguggucuuauaacgcagagcuccuuguggcucuggaaaaucaacauacuaucgauuugaccgacagcgagaugaacaagcuauuugaaagaacaaagaaacagcugagggagaaugccgaagauaugggaaacggcugcuucaagaucuaccacaaaugugacaaugcuugcauugggucaauacggaacggaacuuaugaucaugacgucuaccgagacgaggcccucaauaaccgcuuucagaucaaggguguggagcugaaaaguggcuacaaggauuggauucuuuggaucuccuucgcaauuagcugcuuucuguuguguguugcccuccugggguucaucaugugggcuugccagaagggaaauauaagauguaacaucugcauuuga

SEQ ID NO: 123820 - RNA, 1701 nt, Artificial Sequence
  derived and/or modified sequence opt3 from hemagglutinin__InfluenzaA__ABU92655
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuagcuuguaugcccaggcuucugggcguaucacuguguccaccaagagaucacaacagacaguaauuccaaauaucggaagcaggccccggguucgcgaugugccuaguagaauaucuauuuacuggaccaucgucaagccaggugacauucugcuaaucaacuccacgggcaaucucaucgccccgaggggguacuuuaagauucggagcggaaaaucgucuauaaugcgcuccgacgcgcccaucggcaaguguaacucagagugcauuacuccuaaugguaguaucccaaacgauaaacccuuccagaaugugaaccgaauaacauauggggcauguccuagauacgugaagcagaauacccugaaacuugccacuggaaugaggaacgucccagaaaagcaaacacggggcauuuuuggcgcuaucgccggguucaucgagaauggaugggaagguaugguugacggcugguauggguuucgucaccagaacgcagagggaaccggccaggcugccgaucugaaaagcacgcaagcggccauuaaucagaucaacgguaaguugaaucgccucauugggaagaccaacgagaaauuccaccagauagaaaaggaguucuccgaaguggagggcagaauccaggaccuggaaaaauacguagaggauacaaagauugacuuauggucuuauaacgcagagcugcucguggcucuugaaaaucaacauacuaucgaucugaccgacagcgagaugaacaaauuguuugaaaggacaaagaagcagcuacgggagaaugccgaagauaugggaaacggcugcuucaaaaucuaccacaagugugacaaugcuugcauugggucaauacgaaacggaacuuaugaucaugacgucuaccgcgacgaggcccugaauaacagauuucagaucaaagguguggagcucaagaguggcuacaaagauuggauucuguggaucuccuucgcaauuagcugcuuucuucuguguguugccuugcucggguucaucaugugggcuugccagaagggaaauauaagguguaacaucugcauuuga

SEQ ID NO: 123821 - RNA, 1701 nt, Artificial Sequence; identical to SEQ ID NO: 123778
  derived and/or modified sequence opt3 from hemagglutinin__InfluenzaA__ABU92656

SEQ ID NO: 123822 - RNA, 1701 nt, Artificial Sequence; identical to SEQ ID NO: 122649
  derived and/or modified sequence opt3 from hemagglutinin__InfluenzaA__ABU92657

SEQ ID NO: 123823 - RNA, 1701 nt, Artificial Sequence; identical to SEQ ID NO: 123778
  derived and/or modified sequence opt3 from hemagglutinin__InfluenzaA__ABU92658

SEQ ID NO: 123824 - RNA, 1701 nt, Artificial Sequence; identical to SEQ ID NO: 122649
  derived and/or modified sequence opt3 from hemagglutinin__InfluenzaA__ABU92659

SEQ ID NO: 123825 - RNA, 1701 nt, Artificial Sequence; identical to SEQ ID NO: 123778
  derived and/or modified sequence opt3 from hemagglutinin__InfluenzaA__ABU92660

SEQ ID NO: 123826 - RNA, 1701 nt, Artificial Sequence
  derived and/or modified sequence opt3 from hemagglutinin__InfluenzaA__ABU92661
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucgacuggacagguguuacccagaacgggacguccucugcuugcaagcggcgcagcgauaaguccuuuuucucacgacugaauuggcucacucauuuaaaauauaaguacccagcacugaacgugaccaugcccaauaacgagaaauuugacaaacuuuauauuuggggaguccaccauccuggcacagauagugaccagaucagcuuguacgcccaggcuucuggccguauuacuguguccaccaagagaucacaacagacaguaaucccaaauauagggagcaggccccggguucgcgacgugaguucuagaauuuccaucuacuggaccauugucaagccuggagauauccugcuaaucaacagcacggguaaccucauugccccaaggggcuauuucaagauacggucggggaaaucuuccaucaugcgcucagacgcgccgauuggaaaguguaauagugaaugcaucacucccaacggcagcauaccuaaugauaaaccauuucagaacgugaaucgaauuacauacggugcaugucccagauaugugaagcagaacacccugaaacuugccacugggaugaggaaugucccugagaagcaaacacggggaaucuucggcgcuaucgccggcuuuauugaaaacgggugggagggaaugguugacgguugguacggcuuccgucaccaaaauuccgaggggaccggacaggcagcugaucugaaaucuacgcaggccgcgaucaaccagauuaauggcaaguugaaccgccucauagguaagaccaaugaaaaauuucaccagaucgagaaggaguucagcgaaguggaagggaggauucaggaccuggagaaauauguagaggauacaaagaucgacuuauggucauacaacgccgaacugcucguggcacuugagaaucaacauacuaucgaucugaccgacagugaaaugaacaaauuguucgagagaacaaagaagcagcuacgggaaaacgcugaggauaugggcaauggaugcuuuaaaauuuaucacaagugugacaacgccugcauaggcuccauccgaaaugggacuuacgaccaugaugucuaccgcgacgaggcucugaacaauagauuccagauuaaaggaguggaacucgagagcgguuauaaggauuggauccuguggauuucuuuugccaucucaugcuuccuucuguguguugcauugcucggcuuuauaaugugggccugccagaaagggaacaucagguguaauauuugcaucuga

SEQ ID NO: 123827 - RNA, 1701 nt, Artificial Sequence; identical to SEQ ID NO: 122089
  derived and/or modified sequence opt3 from hemagglutinin__InfluenzaA__ABU92662

SEQ ID NO: 123828 - RNA, 1701 nt, Artificial Sequence; identical to SEQ ID NO: 123778
  derived and/or modified sequence opt3 from hemagglutinin__InfluenzaA__ABU92663

SEQ ID NO: 123829 - RNA, 1701 nt, Artificial Sequence; identical to SEQ ID NO: 123778
  derived and/or modified sequence opt3 from hemagglutinin__InfluenzaA__ABU92664

SEQ ID NO: 123830 - RNA, 1701 nt, Artificial Sequence
  derived and/or modified sequence opt3 from hemagglutinin__InfluenzaA__ABU92665
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuagcuuguaugcccaggcuucugggcguaucacuguguccaccaagagaucacaacagacaguaauuccaaauaucggaagcaggccccggguucgcgaugugccuaguagaauaucuauuuacuggaccaucgucaagccaggugacauucugcuaaucaacuccacgggcaaucucaucgccccgaggggguacuuuaagauucggagcggaaaaucgucuauaaugcgcuccgacgcgcccaucggcaaguguaacucagagugcauuacuccuaaugguaguaucccaaacgauaaacccuuccagaaugugaaccgaauaacauauggggcauguccuagauacgugacccagaauacucugaaacuugccacaggaaugaggaacgucccagaaaagcaaacccggggcauuuuuggcgcuaucgccggguucaucgagaauggaugggaagguaugguugacggcugguauggguuucgucaccagaacagcgagggaacgggccaggcagcugaucugaaguccacccaagccgcgauuaaucagaucaacgguaaauugaaucgccucauugggaagacaaacgagaaguuccaccagauagaaaaagaguucucugaaguggagggcagaauccaggaccuggaaaaguacguagaggauacuaaaauugacuuauggagcuauaacgccgagcugcucguggcacuugaaaaucaacauaccaucgaucugacagacucagagaugaacaaguuguuugaaaggacuaaaaagcagcuacgggagaaugcugaagauaugggaaacggcugcuucaagaucuaccacaaaugugacaaugccugcauugggaguauacgaaacggaaccuaugaucaugacgucuaccgcgacgaggcucugaauaacagauuucagaucaaggguguggagcucaaauccggcuacaaggauuggauucuguggaucagcuucgccauuucuugcuuucuucuguguguugcauugcucggguucaucaugugggccugccagaaaggaaauauaagguguaacaucugcauuuga

SEQ ID NO: 123831 - RNA, 1701 nt, Artificial Sequence; identical to SEQ ID NO: 123778
  derived and/or modified sequence opt3 from hemagglutinin__InfluenzaA__ABU92666

SEQ ID NO: 123832 - RNA, 1701 nt, Artificial Sequence; identical to SEQ ID NO: 122088
  derived and/or modified sequence opt3 from hemagglutinin__InfluenzaA__ABU92667

SEQ ID NO: 123833 - RNA, 1701 nt, Artificial Sequence; identical to SEQ ID NO: 122088
  derived and/or modified sequence opt3 from hemagglutinin__InfluenzaA__ABU92668

SEQ ID NO: 123834 - RNA, 1701 nt, Artificial Sequence
  derived and/or modified sequence opt3 from hemagglutinin__InfluenzaA__ABU92669
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagagguccacugccuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuucccuguacgcucaggccucagggagaguaacaguuagcacuaaaaggagucagcaaaccgugaucccaaacauuggcucucggcccuggguccgcggcguguccagcagaaucucgauauacuggacaauugugaagccuggggauauccuacucauuaacucuaccggaaaucugaucgcgccaagggguuauuucaaaauccggaacggcaaguccucaauuaugcgcaguaaugcaccgauagggaaguguaacagcgaaugcaucacgcccaauggauccauuccuaacgacaaaccauuucagaaugucaaccgaaucacuuacggcgccugucccagauauguuaagcagaauacacuuaaacuggcuaccgguaugaggaacgugccugagaagcagacucgggggauauucggagccauugcaggcuuuaucgaaaauggcugggaggggaugguagacggaugguacgguuuccgucaucaaaacucugagggcacagggcaggcugccgauuugaaaagcacccaggcggccaucaaucaaauuaacggaaagcucaaucgccugaucgagaaaacgaacgaaaaguuucaccagauugaaaaggaguucucagaaguggagggcagaauacaggacuuagagaaauaugucgaagauaccaagaucgaccuguggaguuacaacgcagagcuccuuguggcucuggaaaaucagcauacaauugauuugacugacuccgagaugaacaaacuauucgaaaggacccggaagcaacugcgagagaaugccgaggauauggguaacgggugcuuuaaaaucuaucacaagugugacaaugcuugcaucggcagcauucgcaacggaacauacgaucacgacguuuacagagaugaagcccucaauaacagguuccagauaaagggcguggagcugaaaucuggguauaaggacuggauccuuuggauuucauuugcaaucaguugcuuccuguugugugucgugcuccugggauuuauuaugugggccugccagaaagguaauauccgguguaacauaugcaucuga

SEQ ID NO: 123835 - RNA, 1701 nt, Artificial Sequence; identical to SEQ ID NO: 122088
  derived and/or modified sequence opt3 from hemagglutinin__InfluenzaA__ABU92670

SEQ ID NO: 123836 - RNA, 1701 nt, Artificial Sequence
  derived and/or modified sequence opt3 from hemagglutinin__InfluenzaA__ABU92671
augaagaccaucauugcccugagccacauacucugccuuguguucgcucagaaacugcccgucaacgacaauuccacagcaacuuuguguuuaggccaucacgccguuccuaacgggacgcuggugaagaccaucacaaaugaucauauugagguaacuaacgcgaccgaacuugugcaaucuucaaguacaggaagaaucugcgacauuccacaccagauccucgauggugagaauuguacccugauagacgcucuacugggcgauccgcauugcgacggguuucagaacaaagaaugggauuuguucgucgagaggagcacugccuacuccaauuguuaucccuacgacgugccugauuaugcaucucuccggucgcugguugccucaagcggaacacuggaauuuaacaaugagaguuucaacuggaccggcguggcucagaaugguacguccucugcaugcaagcgccgaagcaucaaauccuuuuucucacgucucaacugguuacaccaacugaaguacaaguauccagcccuuaaugucacuaugcccaacaaugagaaauuugacaaguuguacauuuggggagugcaccauccuaguaccgauagcgaccagaucucucuguaugcucaggccccagggagaguaacaguuuccacuaaaaggucacagcaaaccgugauucccaacaucggcagccggccuuggguccgcggcgugaguucuagaauauccauuuacuggacaaucgugaagccaggggauauucuacucaucaacagcaccggaaaucugaucgcgccgagggguuacuucaaaauucggucgggcaagucuuccauaaugcgcucaaacgcacccaucgggaaguguaauagugaaugcauuacgccuaacggaagcaucccaaaugacaaacccuuucagaacgucaaucgaauaacuuauggcgccuguccuagauacguuaagcagaacacacuuaaacuggcuaccgguaugaggaaugugccagagaagcagacucgggggauuuucggagccaucgcaggcuuuaucgaaaacggcugggaggggaugguagacggaugguaugguuuccgucaccaaaauuccgagggcacagggcaggcugccgauuugaaaucuacccaggcggccauuaaccaaaucaauggaaagcucaaccgccugauugagaaaacgaaugaaaaguuucaucagauagaaaaggaguucagcgaagcagagggcagaauccaggacuuagagaaauacguggaagauaccaagauugaccuguggucauauaacgcugagcuccuugucgcccuggaaaaccagcacacaaucgauuugacugacagugagaugaauaaacuauucgaaaggacccggaagcaacugcgagagaacgcugaggauauggguaaugggugcuuuaaaaucuaccacaagugugacaacgccugcauuggcuccauacgcaauggaacauaugaucaugacguguacagagaugaagcacucaacaauagguuccagaucaagggcguugagcugaaaagcggguacaaggacuggauucuuuggaucucuuuugccauuucaugcuuccuguugugugugguccuccugggauuuaucaugugggcuugccagaaagguaacauacgguguaauaucugcauuuga

SEQ ID NO: 123837 - RNA, 1701 nt, Artificial Sequence; identical to SEQ ID NO: 122088
  derived and/or modified sequence opt3 from hemagglutinin__InfluenzaA__ABU92672

SEQ ID NO: 123838 - RNA, 1701 nt, Artificial Sequence; identical to SEQ ID NO: 122088
  derived and/or modified sequence opt3 from hemagglutinin__InfluenzaA__ABU92673

SEQ ID NO: 123839 - RNA, 1701 nt, Artificial Sequence
  derived and/or modified sequence opt3 from hemagglutinin__InfluenzaA__ABU92674
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcucuacugggcgauccgcacugcgacggguuucagaacaaagaaugggauuuguucgucgagaggcggacugccuauuccaauuguuaccccuaugacgugccugauuacgcaucucuccgcucgcugguugccucaagcggaacacuggaauuuaacaaugagaguuucaacuggaccggcguggcucagaaugguacguccucugcaugcaagcgacguagcauaaaauccuuuuucucaagacucaacugguuacaucaacugaaguauaaguacccagcccuuaaugucacuaugcccaacaaugagaaauuugacaaguuguauaucuggggagugcaccacccuaguaccgauagcgaccagauuucucuguacgcucaggccuccgggaggguaacaguuucaacuaaacggagccagcaaaccgugaucccaaacauuggcagucgccccugggucagaggcgugucuuccaggaucagcauauacuggacaauugugaagccuggggauauccuacucauuaacucgaccggaaaucugaucgcgccacgggguuauuucaaaauccgcucuggcaaguccucaauuaugcgaaguaacgcaccgauagggaaguguaauagcgaaugcaucacgcccaacggauccauuccuaaugacaaaccauuucagaacgucaauagaaucacuuacggcgccugucccagguauguuaagcagaacacacuuaaacuggcuaccgguaugcggaaugugccugagaagcagacucgugggauauucggagccauugcaggcuuuaucgaaaacggcugggaggggaugguagacggaugguacgguuuccgccaucaaaauucugagggcacagggcaggcugccgauuugaaaagcacccaggcggccaucaaccaaauuaauggaaagcucaacagacugaucgagaaaacgaaugaaaaguuucaccagauugaaaaggaguucucagaaguggagggcaggauacaggacuuagagaaauaugucgaagauaccaagaucgaccuguggaguuacaacgcagagcuccuuguggcucuggaaaaccagcauacaauugauuugacugacuccgagaugaauaaacuauucgaacggacccgaaagcaacugcgcgagaacgccgaggauauggguaaugggugcuuuaaaaucuaucacaagugugacaacgcuugcaucggcagcauuagaaauggaacauacgaucacgacguuuacagggaugaagcccucaacaaucgguuccagauaaagggcguggagcugaaaucuggguauaaggacuggauccuuuggauuucauuugcaaucaguugcuuccuguugugugucgugcuccugggauuuauuaugugggccugccagaaagguaacauccgcuguaauauaugcaucuga

SEQ ID NO: 123840 - RNA, 1701 nt, Artificial Sequence
  derived and/or modified sequence opt3 from hemagglutinin__InfluenzaA__ABU92675
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacagauaacgaccagaucucuuuguaugcccaggcuuccgggcguauuacugucucaaccaagagaagccaacagacagugaucccaaauauaggaaguaggccccggguacgcgauauuccuucuagaaucuccauuuacuggaccaucguuaagccaggugacauccugcuaauuaacagcacgggcaaucucauagccccgaggggguacuuuaaaauccggucgggaaagucuuccauuaugcgcucagacgcgcccaucggcaaguguaacagugaaugcauaacuccuaaugguagcauuccaaacgauaaacccuuccagaaugugaaccgaaucacauauggggcauguccuagauacgucaagcagaauacccugaaacuugccacuggaaugaggaacgugccagagaagcaaacacggggcaucuuuggcgcuauugccggguucaucgaaaauggaugggaggguaugguggacggcugguauggguuucgucaccagaacuccgagggaauuggccaggcagcugaucugaaaucuacccaagccgcgauagaccagaucaaugguaaguugaaccgccucauugggaaaacgaaugaaaaguuccaccagaucgagaaggaauuuagcgaggucgaaggcagaauccaggaucuggagaaauacguugaggacaccaagauugauuuauggucauauaacgccgaacugcucguggcacuugagaaccaacauacaauagaccugacugauagugaaaugaauaaauuguuugagaggaccaagaaacagcuacgggaaaacgcugaggacaugggaaauggcugcuucaagaucuaccacaagugugauaacgccugcaugggguccauucgaaauggaacauaugaccaugacguauaccgcgaugaggcucugaacaauagauuucagaucaaagguguggaacucaagagcggcuacaaagacuggauucuguggaucucuuucgccauaucaugcuuucuucugugugucgcauugcucggguucaucaugugggccugccagaagggaaacauuagguguaauaucugcauuuga

SEQ ID NO: 123841 - RNA, 1701 nt, Artificial Sequence; identical to SEQ ID NO: 122649
  derived and/or modified sequence opt3 from hemagglutinin__InfluenzaA__ABU92676

SEQ ID NO: 123842 - RNA, 1701 nt, Artificial Sequence; identical to SEQ ID NO: 123769
  derived and/or modified sequence opt3 from hemagglutinin__InfluenzaA__ABU92677

SEQ ID NO: 123843 - RNA, 1701 nt, Artificial Sequence
  derived and/or modified sequence opt3 from hemagglutinin__InfluenzaA__ABU92678
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggccugcaaaacaaaaagugggauuuguuuguggaaagauccaaagccuauucuaauuguuaccccuaugacgucccugauuacgcaucgcucaggucacugaucgccagcagugguacucuggaguucaacaaugaauccuuuaacuggacaggggugacccagaauggaacgucuagcgcuugcaagcggcgcuccaacaauucauucuuuagucgacucaacugguuaacucaucugaaguucaaauauccagcacuuaauguuaccaugcccaacaacgaggaguuugacaaguuguacauuuggggcgugcaccauccuggcacagauaaugaccagaucagccuguaugcccaggcuucugggcguauuacugucuccaccaaaagaucacaacagacagugaucccaaacauaggaagcaggccccggguacgcgauauuccuaguagaaucucuauuuacuggaccaucguuaagccaggugacauccuacucauuaauuccacgggcaaccugauagccccgaggggguacuucaaaauccggagcggaaagucgucuauuaugcgcuccgacgcgcccaucggcaauuguaacucagaaugcauaacuccuaaugguaguauuccaaacgauaagcccuuucagaaugugaaccgaaucacauauggggcauguccuagauacgucaaacagaauacccuuaagcuggccacuggaaugaggaacgugccagagaaacaaacacggggcaucuucggcgcuauugccggguuuaucgaaaauggaugggaggguaugguggacggcugguauggguuccgucaccagaacagcgagggaauuggccaggcagcugauuugaaguccacccaagccgcgauagaccagaucaaugguaaacucaaccgccugauugggaagacgaacgaaaaauuucaccagaucgagaaggaguucucugaagucgaaggcagaauccaggauuuagagaaguacguugaggacaccaaaauugaucuguggagcuauaaugccgaacuccuuguggcacuggagaaccaacauacaauagacuugacugauucagaaaugaauaagcuauucgagaggaccaaaaagcagcugcgggaaaacgcugaggacaugggaaauggcugcuuuaaaaucuaccacaagugugauaacgccugcauugggaguauccgaaauggaacauaugaccaugacguauaccgcgaugaggcucucaacaauagauuccagauuaaggguguggaacugaaauccggcuacaaggacuggauccuuuggaucagcuuugccauaucuugcuuccuguugugugucgcacuccugggguuuauuaugugggccugccagaaaggaaacaucagguguaauauuugcaucuga

SEQ ID NO: 123844 - RNA, 1701 nt, Artificial Sequence
  derived and/or modified sequence opt3 from hemagglutinin__InfluenzaA__ABU92680
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuuuucuuuaugcccaggcuagcgggcguaucacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaaguuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccugaaaagcacccaagccgcgauugaucagauaaaugguaaauugaaccgccucaucgggaagacgaacgagaaguuccaccagauugaaaaagaguuuuccgaaguugagggcagaauccaggaccuggaaaaguacguggaggauaccaaaaucgacuuauggucuuauaaugccgagcugcucguagcacuugaaaaccaacauacaauugaucugacugacagcgagaugaauaaguuguucgaaaagaccaagaagcagcuaagggagaacgcugaagauaugggaaauggcugcuuuaaaauauaccacaagugugacaacgccugcaucgggucaauucggaauggaacauaugaucaugacguguaccgagacgaggcucugaacaaucgcuuccagaucaaaggugucgagcucaagaguggcuacaaagauuggauucuguggaucuccuuugccauaagcugcuuccuucuguguguggcauugcucggguuuaucaugugggccugccagaagggaaacauuagauguaauaucugcauuuga

SEQ ID NO: 123845 - RNA, 1701 nt, Artificial Sequence; identical to SEQ ID NO: 123773
  derived and/or modified sequence opt3 from hemagglutinin__InfluenzaA__ABU92681

SEQ ID NO: 123846 - RNA, 1701 nt, Artificial Sequence; identical to SEQ ID NO: 122089
  derived and/or modified sequence opt3 from hemagglutinin__InfluenzaA__ABU92682

SEQ ID NO: 123847 - RNA, 1701 nt, Artificial Sequence; identical to SEQ ID NO: 123778
  derived and/or modified sequence opt3 from hemagglutinin__InfluenzaA__ABU92683

SEQ ID NO: 123848 - RNA, 1701 nt, Artificial Sequence
  derived and/or modified sequence opt3 from hemagglutinin__InfluenzaA__ABU92684
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucauugaaagaagcaaagccuauuccaauuguuaccccuaugacgugccugauuacgcaucuuugaggucgcucgucgccucaagcgguacucuggaguuuaacaaugaaaguuucgacuggacaggggugacccagaacggaacguccucugcuugcaagcggcgcagcaauaaguccuuuuucucacgacugaacuggcucacucauuuaaaauauaaguacccagcacugaauguuaccaugcccaacaaugagaaauuugauaaacuuuauaucuggggcgugcaccauccuggcacagacagugaucagauuagcuuguacgcccaggcuccagggcguaucacugucucuaccaagagaucccaacagacagugauacccaacauuggaucaaggccucggguacgcgacguuagcaguagaaucucuauuuacuggaccaucgugaagccaggugacauccugcuaauuaacuccacgggcaaucucauagccccgaggggguauuucaagauccggagcggaaaaucgucuauuaugcgcuccgaugcgcccaucggcaaguguaacucagagugcauaacuccuaaugguaguauuccaaacgacaaacccuuucagaaugucaaccgaaucacauacggggcauguccuagauaugugaagcagaauacccugaaacuugccacuggaaugaggaacgugccagaaaagcaaacacggggcaucuucggcgcuauugccggguuuaucgagaauggaugggaagguauggucgauggcugguacggguuccgucaccagaacagcgagggaaccggccaggcagcugaccugaaauccacgcaagccgcgauuaaucagauaaacgguaaguugaaucgccucaucgggaagaccaacgagaaauuucaccagauugaaaaggaguucucugaaguugagggcagaauccaggaucuggaaaaauauguggaggacacaaagaucgauuuauggagcuacaaugccgagcugcucguagcacuugaaaaccaacauacuauugaccugaccgauucagagaugaacaaauuguucgaaaggacaaagaagcagcuacgggagaaugcugaagacaugggaaacggcugcuuuaaaauauaucacaagugugauaaugccugcaucgggaguauucgaaacggaacuuacgaccaugacguguaccgcgaugaggcucugaauaacagauuccagaucaaaggugucgagcucaaguccggcuauaaagacuggauucuguggaucagcuuugccauaucuugcuuccuucuguguguggcauugcucggguuuaucaugugggccugccagaagggaaauauuagguguaacaucugcauuuga

SEQ ID NO: 123849 - RNA, 1701 nt, Artificial Sequence
  derived and/or modified sequence opt3 from hemagglutinin__InfluenzaA__ABU92685
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucauuuaaaauauaaguacccagcacugaaugugaccaugcccaacaaugagaaauuugauaaacuuuauauuuggggcguccaccauccuggcacagacagugaucagaucagcuuguacgcccaggcuucugggcguauuacuguguccaccaagagaucacaacagacaguaaucccaaacauaggaagcaggccccggguucgcgacgugaguucuagaauuuccaucuacuggaccauugucaagccuggugacauccugcuaaucaacagcacgggcaaucucauugccccaaggggguauuucaagauacggucgggaaaaucuuccaucaugaagucagaugcgccgauuggcaaauguaacagugagugcaucacucccaaugguagcauaccuaacgacaagccauuucagaaugugaaccgcauuacauacggggcauguccccgauaugugaaacagaauacccugaaacuugccacuggaaugagaaacgucccugaaaagcaaacaaggggcaucuucggcgcuaucgccggguuuauugagaauggaugggaagguaugguugauggcugguacggguuccggcaccagaacuccgagggaaccggccaggcagcugaccugaagucuacgcaagccgcgaucaaucagauuaacgguaaguugaaucgucucauagggaaaaccaacgagaaguuucaccagaucgaaaaagaguucagcgaaguggagggccgcauucaggaucuggaaaaguauguagaggacacaaaaaucgauuuauggucauacaaugccgagcugcucguggcacuugaaaaccaacauacuaucgaccugaccgauagugagaugaacaaguuguucgaaagaacaaagaaacagcuaagggagaaugcugaagacaugggaaacggcugcuuuaagauuuaucacaaaugugauaaugccugcauaggguccauccggaacggaacuuacgaccaugacgucuaccgagaugaggcucugaauaaccgcuuccagauuaaggguguggagcucaaaagcggcuauaaggacuggauccuguggauuucuuuugccaucucaugcuuccuucuguguguugcauugcucggguuuauaaugugggccugccagaagggaaauaucagauguaacauuugcaucuga

SEQ ID NO: 123850 - RNA, 1701 nt, Artificial Sequence; identical to SEQ ID NO: 123778
  derived and/or modified sequence opt3 from hemagglutinin__InfluenzaA__ABU92686

SEQ ID NO: 123851 - RNA, 1701 nt, Artificial Sequence; identical to SEQ ID NO: 123778
  derived and/or modified sequence opt3 from hemagglutinin__InfluenzaA__ABU92687

SEQ ID NO: 123852 - RNA, 1701 nt, Artificial Sequence; identical to SEQ ID NO: 123811
  derived and/or modified sequence opt3 from hemagglutinin__InfluenzaA__ABU92688

SEQ ID NO: 123853 - RNA, 1701 nt, Artificial Sequence; identical to SEQ ID NO: 123778
  derived and/or modified sequence opt3 from hemagglutinin__InfluenzaA__ABU92689

SEQ ID NO: 123854 - RNA, 1701 nt, Artificial Sequence
  derived and/or modified sequence opt3 from hemagglutinin__InfluenzaA__ABU92691
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucauuuaaaauauaaguacccagcacugaaugugaccaugcccaacaaugagaaauuugauaaacuuuauauuuggggcguccaccauccuggcacagacagugaucagaucagcuuguacgcccaggcuucugggcguauuacuguguccaccaagagaucacaacagacaguaaucccaaacauaggaagcaggccccggguucgcgacgugaguucuagaauuuccaucuacuggaccauugucaagccuggugacauccugcuaaucaacagcacgggcaaucucauugccccaaggggguauuucaagauacggucgggaaaaucuuccgugaugcgcucagaugcgccgaucggcaaguguaacagugagugcauuacucccaaugguagcaucccuaacgacaaaccauuucagaaugugaaccgaauaacauacggggcaugucccagauaugucaagcagaauacccugaaacuugccacuggaaugaggaacguuccugaaaagcaaacacggggcauuuucggcgcuaucgccggguuuaucgagaauggaugggaagguaugguggauggcugguacggguuccgucaccagaacuccgagggaaccggccaggcagcugaccugaaaucuacgcaagccgcgauuaaucagaucaacgguaaguugaaucgccucauugggaagaccaacgagaaauuucaccagauagaaaaggaguucagcgaaguagagggcagaauccaggaucuggaaaaauauguggaggacacaaagauugauuuauggucauacaaugccgagcugcucgucgcacuugaaaaccaacauacuaucgaccugaccgauagugagaugaacaaauuguucgaaaggacaaagaagcagcuacgggagaaugcugaagacaucggaaacggcugcuuuaaaauuuaucacaagugugauaaugccugcauaggguccauccgaaacggaacuuacgaccauaauguguaccgcgacgaggcucugaacaauagauuccagauuaaagguguugagcucaagagcggcuauaaagauuggauccuguggauuucuuuugccaucucaugcuuccuucuguguguggcauugcucggguuuauaaugugggccugccagaagggaaacaucagguguaauauuugcaucuga

SEQ ID NO: 123855 - RNA, 1701 nt, Artificial Sequence; identical to SEQ ID NO: 122706
  derived and/or modified sequence opt3 from hemagglutinin__InfluenzaA__ABU92692

SEQ ID NO: 123856 - RNA, 1701 nt, Artificial Sequence
  derived and/or modified sequence opt3 from hemagglutinin__InfluenzaA__ABU92693
augaaggccaucauugcucugagcuacauacucugccuuguguucgcacagaaacugcccggcaacgacaauuccaccgccacauuguguuuagggcaccaugcggucccuaacggaacuaucguuaagacgauuaccaaugaucaaaucgaggugacaaacgcuacugaacugguacagauuucuucaaccggugagaucugcgacaguccacaccagauacuagauggcgaaaauuguacacucaucgacgcccugcuuggggauccgcagugcgacggauuucaaaacaaaaagugggaucuguucguggagagaagcaaagcauauuccaauuguuaccccuaugacgucccugauuacgccucuuugaggucgcucguggcuucaagcggcacccuggaauuuaacaaugagaguuucgacuggacugguguuacacagaacgggaccuccucugcaugcaagcggcgcagcgauaaguccuuuuucucacgacugaauuggcucacgcauuuaaaauauaaguacccagcccugaacgugacuaugcccaauaacgagaaauuugacaaacuuuauauuuggggaguccaccauccuggcaccgauagugaccagaucagcuuguacgcucaggccucuggccguauuacaguguccacuaagagaucacaacagaccguaaucccaaauauagggagcaggccccggguucgcgacgugaguucuagaauuuccaucuacuggacaauugucaagccuggagauauccugcuaaucaacagcaccgguaaccucauugcgccaaggggcuauuucaagauacggucggggaaaucuuccaucaugcgcucagacgcaccgauuggaaaguguaauagugaaugcaucacgcccaacggcagcauaccuaaugauaaaccauuucagaacgugaaucgaauuacuuacggugccugucccagauaugugaagcagaacacacugaaacuugcuaccgggaugaggaaugucccugagaagcaaacucggggaaucuucggcgccaucgcaggcuuuauugaaaacgggugggagggaaugguugacgguugguacggcuuccgucaccaaaauuccgaggggacaggacaggcugccgaucugaaaucuacccaggcggccaucaaccagauuaauggcaaguugaaccgccucauagguaagacgaaugaaaaauuucaccagaucgagaaggaguucagcgaaguggaagggaggauucaggaccuggagaaauauguagaggauaccaagaucgacuuauggucauacaacgcagaacugcucguggcucuugagaaucaacauacaaucgaucugacugacagugaaaugaacaaauuguucgagagaaccaagaagcagcuacgggaaaacgccgaggauaugggcaauggaugcuuuaaaauuuaucacaagugugacaacgcuugcauaggcuccauccgaaaugggacauacgaccaugaugucuaccgcgacgaggcccugaacaauagauuccagauuaaaggaguggaacucaagagcgguuauaaagauuggauccuguggauuucuuuugcaaucucaugcuuccuucuguguguugccuugcucggcuuuauaaugugggcuugccagaaggggaacaucagguguaauauuugcaucuga

SEQ ID NO: 123857 - RNA, 1701 nt, Artificial Sequence
  derived and/or modified sequence opt3 from hemagglutinin__InfluenzaA__ABU92694
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaaagcaaacacggggcaucuuuggcgcuaucgccggguucauugagaacggaugggaagguauggucgacggcugguauggguuucgucaccagaauagcgagggaaucggccaggcagcugaucugaaguccacccaagccgcgauuaaccagauaaaugguaaauugaaccgccucaucgggaagacgaacgagaaguuccaccagauugaaaaagaguucucugaaguugagggcagaauccaggaccuggaaaaguacguggaggauaccaaaguagacuuauggagcuauaaugccgagcugcucguggcacuugaaaaccaacauacaaucgaucugacugacucagagaugaauaaguuguuugaaaggaccaaaaagcagcuacgggagaacgcugaagauaugggaaauggcugcuucaagauuuaccacaaaugugacaacgccugcauagggaguauccgaaauggaacauaugaucaugacgucuaccgcgacgaggcucugaacaauagauuucagauuaaggguguggagcucaaauccggcuacaaggauuggauccuguggauuagcuucgccaucucuugcuuucuucuguguguugcauugcucggguucauaaugugggccugccagaaaggaaacaucagguguaauauuugcaucuga

SEQ ID NO: 123858 - RNA, 1701 nt, Artificial Sequence; identical to SEQ ID NO: 123769
  derived and/or modified sequence opt3 from hemagglutinin__InfluenzaA__ABU92695

SEQ ID NO: 123859 - RNA, 1701 nt, Artificial Sequence
  derived and/or modified sequence opt3 from hemagglutinin__InfluenzaA__ABU92696
augaagaccaucauugcccugggcuacauacucugccuuguguucgcucagaaacugcccgggaacgacaauagcacagcaacuuuguguuuaggacaccaugccgucccuaacgguacgaucguuaagaccauuacaaaugaucaaaucgaggugacuaacgcgaccgaacugguacaguccucuucaacaggcgggauuugcgacaguccacaccagauccuagauggagagaauuguacccucauagacgcucugcuuggcgauccgcagugcgacgguuuucaaaacaaaaagugggaucuguucguggaaagaagcaaagccuauuccaauuguuaccccuaugacgucccugauuacgcaucuuugaggucgcucaucgccucaagcgggacucuggaguuuaacaaugaaaguuucaacuggacaggagugacccagaauggcacguccucugcuugcaagcggcgcagcaacuccucauuuuucagucgacugaauuggcucacucauuuaaaguuuaaauauccagcacugaacguuaccaugcccaauaacgaggaguucgacaaacuuuacauuuggggcgugcaccauccugggacagauaacgaccagaucagcuuguaugcccaggcuucuggacguauuacugucuccaccaagagaucacaacagacagugaucccaaauauagguagcaggccccggguacgcgauauuccuaguagaaucucuauuuacuggaccaucguuaagccaggcgacauccugcuaauuaacuccacggggaaucucauagccccgaggggauacuuuaaaauccggagcggcaagucgucuauuaugcgcuccgacgcgcccaucgguaaguguaacucagaaugcauaacuccuaaugggaguauuccaaacgauaaacccuuccagaaugugaaccgaaucacauauggagcauguccuagauacgucaagcagaauacccugaaacuugccacuggcaugaggaacgugccagagaagcaaacacggggcaucuuuggggcuauugccggauucaucgaaaaugguugggagggcaugguggacgggugguauggauuucgucaccagaacagcgagggcauuggucaggcagcugaucugaaauccacccaagccgcgauagaccagaucaaugggaaguugaaccgccucauuggcaaaacgaaugaaaaguuccaccagaucgagaaggaguucucugaagucgaaggaagaauccaggaucuggagaaauacguugaggacaccaagauugauuuauggagcuauaacgccgaacugcucguggcacuugagaaccaacauacaauagaccugacugauucagaaaugaauaaauuguuugagaggaccaagaaacagcuacgggaaaacgcugaggacaugggcaaugggugcuucaagaucuaccacaagugugauaacgccugcauuggaaguauccgaaaugguacauaugaccaugacguauaccgcgaugaggcucugaacaauagauuucagauuaaaggcguggaacucaaguccggguacaaagacuggauccuguggaucagcuucgccauaucuugcuuucuucugugugucgcauugcucggauucauuaugugggccugccagaagggcaacaucagguguaauauuugcaucuga

SEQ ID NO: 123860 - RNA, 1701 nt, Artificial Sequence; identical to SEQ ID NO: 122649
  derived and/or modified sequence opt3 from hemagglutinin__InfluenzaA__ABU92697

SEQ ID NO: 123861 - RNA, 1701 nt, Artificial Sequence; identical to SEQ ID NO: 122259
  derived and/or modified sequence opt3 from hemagglutinin__InfluenzaA__ABU92698

SEQ ID NO: 123862 - RNA, 1701 nt, Artificial Sequence
  derived and/or modified sequence opt3 from hemagglutinin__InfluenzaA__ABU92699
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacugggcugggguuacacagaauggaaccucuagcgcaugcaagcggcgcuccaacaauucauuuuucagucgacugaacuggcucacgcauuuaaaguuuaaauauccagcccugaaugugacuaugcccaacaacgagaaguucgacaaacuuuacaucuggggcguccaccauccuggcaccgauaaugaccagauuuuucuuuaugcucaggccagcgggcguaucacagugucuacuaagagaucccaacagaccguaauuccaaacaucggaucaaggccccggguucgcaauauaccuagcagaauuaguaucuacuggacaauugugaaaccaggugauauccugcuaaucaacucuaccggcaaucucauugcgccgaggggguacuucaagauacgguccggaaagagcucgaucaugcgcucugacgcacccauuggcaaauguaacuccgagugcaucacgccuaaugguucaauaccaaacgacaagcccuuucagaaugucaaccgaauuacuuauggggccuguccuagauacgugaaacagaauacacugaaguuggcuaccggaaugaggaacgugccagaaaaacaaacucggggcaucuucggcgccaucgcaggguuuauugagaauggaugggaagguauggucgauggcugguauggguuccgucaccagaacagugagggaaucggccaggcugccgaccugaaaagcacacaagcggccauugaucagauaaaugguaaauugaaccgccucaucgggaagaccaacgagaaguuccaccagauugaaaaagaguuuuccgaaguugagggcagaauccaggaccuggaaaaguacguggaggauacgaaaaucgacuuauggucuuauaaugcagagcugcucguagcucuugaaaaccaacauaccauugaucugacagacagcgagaugaauaaguuguucgaaaagacuaagaagcagcuaagggagaacgccgaagauaugggaaauggcugcuuuaaaauauaccacaagugugacaacgcuugcaucgggucaauucggaauggaaccuaugaucaugacguguaccgagacgaggcccugaacaaucgcuuccagaucaaaggugucgagcucaagaguggcuacaaagauuggauucuguggaucuccuuugcaauaagcugcuuccuucuguguguggccuugcucggguuuaucaugugggcuugccagaagggaaacauuagauguaauaucugcauuuga

SEQ ID NO: 123863 - RNA, 1701 nt, Artificial Sequence
  derived and/or modified sequence opt3 from hemagglutinin__InfluenzaA__ABU92700
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagguauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagcguuucgacaaguuguacaucuggggaguccaccauccuggcacagauaaugaccagauuuuucuuuaugcccaggcuagcggcagaaucacugugucuaccaaaaggucccaacagacaguaauuccaaacaucgggucacggccccgcguuagaaauauaccuagcaggauuaguaucuacuggaccauugugaagccaggagauauccugcuaaucaacucuacggguaaucucauugccccgcggggcuacuucaaaauacgcuccggaaagagcucgaucaugcgaucugacgcgcccauugggaaguguaacuccgaaugcaucacuccuaauggcucaauaccaaacgacaaacccuuucagaaugucaacagaauuacauauggugcauguccuagguacgugaagcagaauacccugaaacuugccacugggaugcggaacgugccagagaagcaaacacguggaaucuucggcgcuaucgccggcuuuauugaaaaugggugggagggaauggucgaugguugguauggcuuccgccaccagaacagugaggggaucggacaggcagcugaccugaaaagcacccaagccgcgauugaucagauaaauggcaaguugaacagacucaucgguaaaacgaacgaaaaguuccaccagauugagaaggaauuuuccgagguugaagggaggauccaggaccuggagaaauacguggaggauaccaagaucgacuuauggucuuauaaugccgaacugcucguagcacuugagaaccaacauacaauugaucugacugacagcgaaaugaauaaauuguucgagaagaccaaaaagcagcuacgggaaaacgcugaggauaugggcaauggaugcuuuaagauauaccacaaaugugacaacgccugcaucggcucaauucgaaaugggacauaugaucaugacguguaccgcgacgaggcucugaacaauagauuccagaucaagggagucgaacucaaaagugguuacaaggauuggauucuguggaucuccuuugccauaagcugcuuccuucuguguguggcauugcucggcuuuaucaugugggccugccagaaagggaacauuagguguaauaucugcauuuga

SEQ ID NO: 123864 - RNA, 1701 nt, Artificial Sequence
  derived and/or modified sequence opt3 from hemagglutinin__InfluenzaA__ABU92701
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagguauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagcguuucgacaaguuguacaucuggggaguccaccauccuggcacagauaaugaccagauuuuucuuuaugcccaggcuagcggcagaaucacugugucuaccaaaaggucccaacagacaguaauuccaaacaucgggucacggccccgcguuagaaauauaccuagcaggauuaguaucuacuggaccauugugaagccaggagauauccugcuaaucaacucuacggguaaucucauugccccgcggggcuacuucaaaauacgcuccggaaagagcucgaucaugcgaucugacgcgcccauugggaaguguaacuccgaaugcaucacuccuaauggcucaauaccaaacgacaaacccuuucagaaugucaacagaauuacauauggugcauguccuagguacgugaagcagaauacccugaaacuugccacugggaugcggaacgugccagagaagcaaacacguggaaucuucggcgcuaucgccggcuuuauugaaaaugggugggagggaauggucgaugguugguauggcuuccgccaccagaacagugaggggaucggacaggcagcugaccugaaaagcacccaagccgcgauugaucagauaaauggcaaguugaacagacucaucgguaaaacgaacgaaaaguuccaccagauugagaaggaauuuuccgagguugaagggaggauccaggaccuggagaaauacguggaggauaccaagaucgacuuauggucuuauaaugccgaacugcucguagcacuugagaaccaacauacaauugaucugacugacagcgaaaugaauaaauuguucgagaagaccaaaaagcagcuacgggaaaacgcugaggauaugggcaauggaugcuuuaagauauaccacaaaugugacaacgccugcaucggcucaauucgaaaugggacauaugaucaugacguguaccgcgacgaggcucugaacaauagacuccagaucaagggagucgaacugaaaagugguuacaaggauuggauucuuuggaucuccuucgccauaagcugcuuucuguuguguguggcacuccugggcuucaucaugugggccugccagaaagggaacauuagguguaauaucugcauuuga

SEQ ID NO: 123865 - RNA, 1701 nt, Artificial Sequence; identical to SEQ ID NO: 122628
  derived and/or modified sequence opt3 from hemagglutinin__InfluenzaA__ABU92702

SEQ ID NO: 123866 - RNA, 1701 nt, Artificial Sequence; identical to SEQ ID NO: 123844
  derived and/or modified sequence opt3 from hemagglutinin__InfluenzaA__ABU92703

SEQ ID NO: 123867 - RNA, 1701 nt, Artificial Sequence
  derived and/or modified sequence opt3 from hemagglutinin__InfluenzaA__ABU92704
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagaaauaaagccuauuccaacuguuaccccuaugacgucccugauuacgcaucuuugaggucgcucguggccucaagcgguacucuggaguuuaauaacgaaaguuucaauuggacagggguuacccagaacggaacguccucugcuugcaagcggcgcagcaauaacuccuuuuucucacgacugaauuggcucacucauuuaaaguuuaaauauccagcacugaacgugaccaugcccaacaaugagaaguucgacaaacuuuacaucuggggcguccaccauccuggcacagauaacgaccagaucuuuuuguaugcccaggcuagugggcguauuacugugagcaccaagagaucucaacagacaguaauuccaaauaucggauccaggccccggguucgcaacauaccuucaagaauuagcaucuacuggaccauugugaaaccaggugauauccugcuaaucaauaguacgggcaaccucauugccccgaggggguacuucaagauacggucuggaaaguccagcaucaugcgcucggacgcgcccauuggcaaauguaauucugagugcaucacuccuaacgguuccauaccaaaugacaagcccuuucagaacgucaaucgaauuacauauggggcauguccuagauacgugaaacagaacacccugaaacuugccacuggaaugaggaaugugccagaaaaacaaacacggggcaucuucggcgcuaucgccggguuuauugagaacggaugggaagguauggucgauggcugguauggguuccgucaccaaaauucagagggaaucggccaggcagcugaccugaagaguacccaggccgcgauugaucagauaaacgguaaauugaaccgccucaucgggaagacgaaugagaaguuccaccagauugaaaaagaguuuagcgaaguugagggcagaauccaggaccuggaaaaguacguggaggauaccaaaaucgacuuaugguccuauaacgccgagcugcucguagcacuugaaaaucaacauacaauugaucugacugacucugagaugaacaaguuguucgaaaagaccaagaagcagcuaagggagaaugcugaagauaugggaaacggcugcuuuaaaauauaccacaagugugacaaugccugcaucgggagcauucggaacggaacauaugaucaugacguguaccgagacgaggcucugaauaaccgcuuccagaucaaaggugucgagcucaagucaggcuacaaagauuggauucuguggaucaguuuugccauauccugcuuccuucuguguguggcauugcucggguuuaucaugugggccugccagaagggaaauauuagauguaacaucugcauuuga

SEQ ID NO: 123868 - RNA, 1701 nt, Artificial Sequence
  derived and/or modified sequence opt3 from hemagglutinin__InfluenzaA__ABU92705
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgaggaguucgacaagcuguacauuuggggcgugcaccauccuggcacagauaaugaccagaucagcuuguaugcccaggcuccagggcguauuacugucucuaccaaaagaucccaacagacagugauccccaacauaggaucaaggccucggguacgcgauauuccaagcagaaucaguauuuacuggaccaucguuaagccgggugacauccugcuaauuaauucuacgggcaaccucauagcccccaggggguacuuuaaaauccgguccggaaagagcucgauuaugcgcucugacgcgccuaucggcaaguguaaauccgaaugcauaacuccaaaugguucaauucccaacgauaagccuuuccagaaugugaaccgaaucacauauggggcauguccaagauacgucaaacagaauacccugaaacuugccacuggaaugaggaacgugcccgagaagcaaacacggggcaucuuuggcgcuauugccggguucaucgaaaauggaugggaggguaugguggacggcugguauggguuucgucaccagaacagugagggaauuggccaggcagcugaucuuaagagcacccaagccgcgauagaccagaucaaugguaaauugaaccgccucauugggaagacgaaugaaaaguuccaccagaucgagaaagaguucuccgaagucgaaggcagaauccaggaucuggagaaguacguugaggacaccaaaauugauuuauggucuuauaacgccgaacugcucguggcacuugagaaccaacauacaauagaccugacugauagcgaaaugaauaaguuguuugagaggaccaaaaagcagcuacgggaaaacgcugaggacaugggaaauggcugcuucaagaucuaccacaaaugugauaacgccugcauugggucaauccgaaauggaacauaugaccaugacguauaccgcgaugaggcucugaacaauagauuuaggauuaagaguguggaacucaaauccgguuacaaggacuggauccuguggaucagcuucgccauaucuugcuuucuucugugugucgcauugcucggcuucauuaugugggccugccagaaagggaacauccgguguaauauuugcaucuga

SEQ ID NO: 123869 - RNA, 1701 nt, Artificial Sequence; identical to SEQ ID NO: 122089
  derived and/or modified sequence opt3 from hemagglutinin__InfluenzaA__ABU92706

SEQ ID NO: 123870 - RNA, 1701 nt, Artificial Sequence; identical to SEQ ID NO: 123778
  derived and/or modified sequence opt3 from hemagglutinin__InfluenzaA__ABU92707

SEQ ID NO: 123871 - RNA, 1701 nt, Artificial Sequence; identical to SEQ ID NO: 123778
  derived and/or modified sequence opt3 from hemagglutinin__InfluenzaA__ABU92708

SEQ ID NO: 123872 - RNA, 1701 nt, Artificial Sequence
  derived and/or modified sequence opt3 from hemagglutinin__InfluenzaA__ABU92709
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacugggcugggguuacacagaauggaaccucuagcgcaugcaagcggcgcuccaacaagucauuuuucagucgacugaauuggcucacgcauuuaaaauauaaguacccagcccugaacgugacuaugcccaauaacgagaaauuugacaaacuuuauaucuggggcguccaccauccuggcaccgauagcgaccagauuucuuuguacgcucaggccuccgggcguaucacagugucaacuaagagaagccaacagaccguaauuccaaacaucggaaguaggccccggguucgcgaugugucuuccagaauaagcauuuacuggacaaucgucaagccuggugacauucugcuaaucaauucgaccggcaaccucaucgcgccaaggggguauuucaagauucggucuggaaaauccucaauaaugcgcagugacgcaccgaucggcaaguguaauagcgagugcauuacgcccaacgguuccaucccuaaugauaaaccauuucagaacgugaaucgaauaacuuacggggccugucccagauaugugaagcagaacacacugaaacuugcuaccggaaugaggaaugucccugaaaagcaaacucggggcauuuucggcgccaucgcaggguuuaucgagaacggaugggaagguaugguugacggcugguacggguuccgucaccaaaauucugagggaacaggccaggcugccgaucugaaaagcacccaggcggccauuaaccagaucaaugguaaguugaaccgccucauugggaagacgaaugagaaauuucaccagauagaaaaggaguucucagaaguggagggcagaauccaggaccuggaaaaauauguagaggauaccaagauugacuuauggaguuacaacgcagagcugcucguggcucuugaaaaccaacauacaaucgaucugacugacuccgagaugaauaaauuguucgaaaggaccaagaagcagcuacgggagaacgccgaagauaugggaaauggcugcuuuaaaaucuaucacaagugugacaacgcuugcauugagagcauacgaaaugggacauacgaucaugacgucuaccgcgacgaggcccugaacaauagauuccagaucaaaggaguggaacucaagucugguuauaaagauuggauucuguggaucucauuugcaauuaguugcuuccuucuguguguugccuugcucggcuuuaucaugugggcuugccagaaggggaacauaagguguaauaucugcauuuga

SEQ ID NO: 123873 - RNA, 1701 nt, Artificial Sequence; identical to SEQ ID NO: 122067
  derived and/or modified sequence opt3 from hemagglutinin__InfluenzaA__ABU92710

SEQ ID NO: 123874 - RNA, 1701 nt, Artificial Sequence; identical to SEQ ID NO: 122089
  derived and/or modified sequence opt3 from hemagglutinin__InfluenzaA__ABU92711

SEQ ID NO: 123875 - RNA, 1701 nt, Artificial Sequence; identical to SEQ ID NO: 122089
  derived and/or modified sequence opt3 from hemagglutinin__InfluenzaA__ABU92712

SEQ ID NO: 123876 - RNA, 1701 nt, Artificial Sequence; identical to SEQ ID NO: 123778
  derived and/or modified sequence opt3 from hemagglutinin__InfluenzaA__ABU92713

SEQ ID NO: 123877 - RNA, 1701 nt, Artificial Sequence; identical to SEQ ID NO: 123778
  derived and/or modified sequence opt3 from hemagglutinin__InfluenzaA__ABU92714

SEQ ID NO: 123878 - RNA, 1701 nt, Artificial Sequence
  derived and/or modified sequence opt3 from hemagglutinin__InfluenzaA__ABU92715
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucgacuggacagguguuacccagaacgggacguccucugcuugcaagcggcgcagcaauaaguccuuuuucucacgacugaacuggcucacucauuuaaaauauaaguacccagcacugaaugugaccaugcccaacaaugagaaauuugaaaaacuuuauauuuggggaguccaccauccuggcacagauagugaccagaucaacuuguacgcccaggcuagcggccguauuacugugucuaccaagagaucccaacagacaguaaucccaaacauagggucaaggccccggguucgcgaugugagcaguagaauuucuaucuacuggaccauugucaagccuggagacauccugcuaaucaauuccacggguaaccucauugccccaaggggcuauuucaagauacggagcgggaaaucgucuaucaugcgcuccgacgcgccgauuggaaaguguaauucagagugcaucacucccaacggcaguauaccuaaugauaaaccauuucagaacgugaaucgaauuacauacggugcaugucccagauaugugaagcagaacacccugaaacuugccacugggaugaggaaugucccugaaaagcaaacacggggaaucuucggcgcuaucgccggcuuuauugagaacgggugggagggaaugguugacgguugguacggcuuccgucaccagaauagcgaagggaccggacaggcagcugaucugaaauccacgcaagccgcgaucaaccagauuaauggcaaguugaaccgccucauagguaagaccaaugagaaauuucaccagaucgaaaaggaguucucugaaguggaggggaggauucaggaccuggagaaauauguagaagauacaaagaucgacuuauggagcuacaacgccgagcugcucguggcacuugaaaaccaacauacuaucgaucugaccgacucagagaugaauaaauuguucgaaagaacaaagaagcagcuacgggagaacgcugaggauaugggcaauggaugcuuuaaaauuuaucacaagugugacaacgccugcauaggcaguauccgaaaugggacuuacgaucaugacgucuaccgcgacgaagcucugaacaauagauuccagauuaaaggaguggagcucaaguccgguuauaaagauuggauccuguggauuagcuuugccaucucuugcuuccuucuguguguugcauugcucggcuuuauaaugugggccugccagaaggggaacaucagguguaauauuugcaucuga

SEQ ID NO: 123879 - RNA, 1701 nt, Artificial Sequence; identical to SEQ ID NO: 123778
  derived and/or modified sequence opt3 from hemagglutinin__InfluenzaA__ABU92716

SEQ ID NO: 123880 - RNA, 1701 nt, Artificial Sequence; identical to SEQ ID NO: 123778
  derived and/or modified sequence opt3 from hemagglutinin__InfluenzaA__ABU92717

SEQ ID NO: 123881 - RNA, 1701 nt, Artificial Sequence; identical to SEQ ID NO: 122089
  derived and/or modified sequence opt3 from hemagglutinin__InfluenzaA__ABU92718

SEQ ID NO: 123882 - RNA, 1701 nt, Artificial Sequence; identical to SEQ ID NO: 122089
  derived and/or modified sequence opt3 from hemagglutinin__InfluenzaA__ABU92719

SEQ ID NO: 123883 - RNA, 1701 nt, Artificial Sequence
  derived and/or modified sequence opt3 from hemagglutinin__InfluenzaA__ABU92720
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacucuucguugaggucacucguggcaagcaguggcacucuggaauuuaacaaugaguccuucgacuggacagguguuacccagaacgggacgucuagcgccugcaagcggcgcuccgauaagucauuuuucagucgacugaauuggcucacucauuuaaaauauaaguacccagcucugaacgugaccaugcccaauaacgagaaauuugacaaacuuuauauuuggggaguccaccauccuggcacagauagcgaccagaucucuuuguacgcacaggccuccggccguauuacugugucaaccaagagaagccaacagacaguaaucccaaauauagggaguaggccccggguucgcgacgugucuuccagaauuagcaucuacuggaccauugucaagccuggagauauccugcuaaucaacucgacggguaaccucauugcuccaaggggcuauuucaagauacggucugggaaauccucaaucaugcgcagugacgccccgauuggaaaguguaauagcgaaugcaucacucccaacggcuccauaccuaaugauaaaccauuucagaacgugaaucgaauuacauacggugcgugucccagauaugugaagcagaacacccugaaacuugcaacugggaugaggaaugucccugagaagcaaacacggggaaucuucggcgccaucgcuggcuuuauugaaaacgggugggagggaaugguugacgguugguacggcuuccgucaccaaaauucugaggggaccggacaggccgcagaucugaaaagcacgcaggcugccaucaaccagauuaauggcaaguugaaccgccucauagguaagaccaaugaaaaauuucaccagaucgagaaggaguucucagaaguggaagggaggauucaggaccuggagaaauauguagaggauacaaagaucgacuuauggaguuacaacgcggaacugcucguggcccuugagaaucaacauacuaucgaucugaccgacuccgaaaugaacaaauuguucgagagaacaaagaagcagcuacgggaaaacgcagaggauaugggcaauggaugcuuuaaaauuuaucacaagugugacaacgcuugcauaggcagcauccgaaaugggacuuacgaccaugaugucuaccgcgacgaggcccugaacaauagauuccagauuaaaggaguggaacucaagucugguuauaaagauuggauccuguggauuucauuugcuaucaguugcuuccuucuguguguugccuugcucggcuuuauaaugugggcaugccagaaggggaacaucagguguaauauuugcaucuga

SEQ ID NO: 123884 - RNA, 1701 nt, Artificial Sequence
  derived and/or modified sequence opt3 from hemagglutinin__InfluenzaA__ABU92721
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucgacuggacagguguuacccagaacgggacguccucugcuugcaagcggcgcagcgauaaguccuuuuucucacgacugaauuggcucacucauuuaaaauauaaguacccagcacugaacgugaccaugcccaauaacgagaaauuugacaaacuuuauauuuggggaguccaccauccuggcacagauagugaccagaucagcuuguacgcccaggcuucuggccguauuacuguguccaccaagagaucacaacagacaguaaccccaaauaucgggagcaggccccggguucgcgacgugaguucuagaauauccauuuacuggacgaucgucaagccuggagauauucugcuaaucaacagcacugguaaccucaucgccccaaggggcuauuucaagauucggucggggaaaucuuccauaaugcgcucagacgcgccgaucggaaaguguaauagugaaugcauuacacccaacggcagcaucccuaaugauaaaccauuucagaacgugaaucgaauaaccuacggugcaugucccagauaugugaagcagaacacucugaaacuugccacagggaugaggaaugucccugagaagcaaacccggggaauuuucggcgcuaucgccggcuuuaucgaaaacgggugggagggaaugguugacgguugguacggcuuccgucaccaaaauuccgaggggacgggacaggcagcugaucugaaaucuacccaggccgcgauuaaccagaucaauggcaaguugaaccgccucauugguaagacaaaugaaaaauuucaccagauagagaaggaguucagcgaaguggaagggagaauccaggaccuggagaaauauguagaggauacuaagauugacuuauggucauacaacgccgaacugcucguggcacuugagaaucaacauaccaucgaucugacagacagugaaaugaacaaauuguucgagaggacuaagaagcagcuacgggaaaacgcugaggauaugggcaauggaugcuuuaaaaucuaucacaagugugacaacgccugcauuggcuccauacgaaaugggaccuacgaccaugaugucuaccgcgacgaggcucugaacaauagauuccagaucaaaggaguggaacucaagagcgguuauaaagauuggauucuguggaucucuuuugccauuucaugcuuccuucuguguguugcauugcucggcuuuaucaugugggccugccagaaggggaacauaagguguaauaucugcauuuga

SEQ ID NO: 123885 - RNA, 1701 nt, Artificial Sequence; identical to SEQ ID NO: 123769
  derived and/or modified sequence opt3 from hemagglutinin__InfluenzaA__ABU92722

SEQ ID NO: 123886 - RNA, 1701 nt, Artificial Sequence; identical to SEQ ID NO: 122089
  derived and/or modified sequence opt3 from hemagglutinin__InfluenzaA__ABU92723

SEQ ID NO: 123887 - RNA, 1701 nt, Artificial Sequence; identical to SEQ ID NO: 123872
  derived and/or modified sequence opt3 from hemagglutinin__InfluenzaA__ABU92724

SEQ ID NO: 123888 - RNA, 1701 nt, Artificial Sequence
  derived and/or modified sequence opt3 from hemagglutinin__InfluenzaA__ABU92725
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauauaaguacccagcacugaacgugaccaugcccaauaacgagaaauuugacaaacuuuauaucuggggcguccaccauccuggcacagauagcgaccagauuaacuuguacgcccaggcuucugggcguaucacuguguccaccaagagaucacaacagacaguaauuccaaauaucggaagcaggccccggguucgcgaugugccuaguagaauaucuauuuacuggaccaucgucaagccaggugaccugcuacucauuaacuccacgggcaaucugaucgccccgaggggguauuucaagauccggagcggaaaaucgucuauuaugcgcuccgacgcgcccauaggcaaguguaacucagagugcaucacuccuaaugguaguauuccaaacgauaaacccuuucagaaugugaaccgaaucacauacggggcauguccuagauaugugaagcagaauacccuuaaacuggccacuggaaugaggaacgucccagaaaagcaaacacggggcauauucggcgcuauugccggguuuaucgagaauggaugggaagguaugguugacggcugguacggguuccgucaccagaacagcgagggaaccggccaggcagcugauuugaaauccacgcaagccgcgaucaaucagauuaacgguaagcucaaucgccugaucgggaagaccaacgagaaauuucaccagauugaaaaggaguucucugaaguggagggcagaauacaggacuuagaaaaauauguagaggauacaaagaucgaccuguggagcuacaacgccgagcuccuuguggcacuggaaaaucaacauacuauugauuugaccgacucagagaugaacaaacuauucgaaaggacaaagaagcagcugcgggagaaugcugaagauaugggaaacggcugcuuuaaaaucuaucacaagugugacaaugccugcaucgggaguauucgaaacggaacuuacgaucaugacgucuaccgcgacgaggcucucaauaacagauuccagauaaaagguguggagcugaaguccggcuauaaagauuggauccuuuggauuagcuuugccaucucuugcuuccuguuguguguugcacuccugggguuuauuaugugggccugccagaagggaaauaucagguguaacauaugcaucuga

SEQ ID NO: 123889 - RNA, 1701 nt, Artificial Sequence; identical to SEQ ID NO: 123872
  derived and/or modified sequence opt3 from hemagglutinin__InfluenzaA__ABU92726

SEQ ID NO: 123890 - RNA, 1701 nt, Artificial Sequence
  derived and/or modified sequence opt3 from hemagglutinin__InfluenzaA__ABU92727
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuuuagccgacugaauuggcucacucauuuaaaguuuaaauauccagcacugaacguuaccaugcccaauaacgaggacuucgauaaacuuuacauuuggggcgugcaccauccuggcacagacaacgaucagaucucuuuguaugcccaggcuuccgggcguauuacugucucaaccaagagaagccaacagacagugaucccaaauauaggaaguaggccccggguacgcgacauuccuucuagaaucuccauuuacuggaccaucguuaagccaggugacauccugcuaauuaacagcacgggcaaucucauagccccgaggggguacuuuaaaauccggucgggaaagucuuccauuaugcgcucagaugcgcccaucggcaaguguaacagugagugcauaacuccuaaugguagcauuccaaacgacaaacccuuccagaaugugaaccgaaucacauauggggcauguccuagauacgucaagcagaauacccugaaacuugccacuggaaugaggaacgugccagaaaagcaaacacggggcaucuuuggcgcuauugccggguucaucgagaauggaugggaagguaugguggauggcugguauggguuucgucaccagaacuccgagggaauuggccaggcagcugaccugaaaucuacccaagccgcgauagaucagaucaaugguaaguugaaccgccucauugggaaaacgaaugagaaguuccaccagaucgaaaaggaguucagcgaagucgagggcagaauccaggaccuggaaaaauacguugaggauaccaagauugacuuauggucauauaacgccgagcugcucguggcacuugaaaaccaacauacaauagaucugacugacagugagaugaauaaauuguuugaaaggaccaagaaacagcuacgggagaacgcugaagauaugggaaauggcugcuucaagaucuaccacaagugugacaacgccugcauuggguccauccgaaauggaacauaugaccaugauguauaccgcgacgaggcucugaacaauagauuucagauuaaagguguggagcucaagagcggcuacaaagauuggauccuguggauaucuuucgccaucucaugcuuucuucugugugucgcauugcucggguucauuaugugggccugccagaagggaaacaucagguguaauauuugcaucuga

SEQ ID NO: 123891 - RNA, 1701 nt, Artificial Sequence
  derived and/or modified sequence opt3 from hemagglutinin__InfluenzaA__ABU92728
augaagaccaucauugcccugagcuacauacucugccagguguucgcucaaaaacuucccggcaacgacaauuccacagcaacucuguguuuggggcaccaugccgucccuaacggaacgaucguuaagaccauuacaaaugaucagaucgaggugacuaacgcgaccgaauuaguacagauuucuucaacaggugagaucugcgacaguccacaccagauacuggauggcgaaaauuguacccuaaucgacgcucuccugggggauccgcaaugcgacggauuucagaacaaaaagugggaucuuuucguggagagaagcaaagccuauuccaauuguuaccccuaugacgucccugauuacgcaucucugaggucguugguggccucaagcggcacucucgaauuuaacaaugagaguuucgacuggacagguguuacccagaacgggacguccucugcuugcaagcggcgcagcgauaaguccuuuuucucacgacugaauuggcugacucaucucaaauauaaguacccagcauuaaacgugaccaugcccaauaacgagaaauuugacaagcuguauauuuggggaguccaccauccuggcacagauaaugaccagaucagucuuuacgcccaagcuagcggccguauuacugugucuaccaaaagaucccagcagacaguaaucccaaacauagggucaaggccccggguucgcgacgugagcaguagaauuucuaucuacuggaccauugucaagccuggagauaucuugcugaucaacuccacggguaaucuaauugccccaaggggcuauuucaagauacggagcgggaaaucgucuaucaugcgcuccgacgcgccgauuggaaaguguaacucagaaugcaucacucccaauggcaguauaccuaacgauaaaccauuucagaaugugaaccgaauuacauacggugcaugucccagauaugugaagcaaaauacccucaaacuggccacugggaugaggaacgucccugagaagcagacacggggaaucuucggcgcuaucgccggcuuuauugaaaaugggugggagggaaugguugacgguugguacggcuuccgucaccagaacagcgaggggaccggacaagcagcugaucuuaaauccacgcaggccgcgaucaaucagauuaacggcaagcugaaucgcuugauagguaagaccaacgaaaaauuucaccagaucgagaaggaguucucugaaguggaagggaggauucaagaccucgagaaauauguagaggauacaaagaucgaccuguggagcuacaaugccgaauuacugguggcacucgagaaccagcauacuaucgaucuuaccgacucagaaaugaacaaacuguucgagagaacaaagaagcaguugcgggaaaaugcugaggauaugggcaacggaugcuuuaaaauuuaucacaagugugacaaugccugcauaggcaguauccgaaacgggacuuacgaccaugaugucuaccgcgacgaggcucuaaauaacagauuccagauuaaaggaguggaacugaaguccgguuauaaagauuggauccucuggauuagcuuugccaucucuugcuuccugcuuuguguugcacuguugggcuuuauaaugugggccugccaaaaggggaauaucagguguaacauuugcaucuga

SEQ ID NO: 123892 - RNA, 1701 nt, Artificial Sequence; identical to SEQ ID NO: 123891
  derived and/or modified sequence opt3 from hemagglutinin__InfluenzaA__ABU92729

SEQ ID NO: 123893 - RNA, 1701 nt, Artificial Sequence; identical to SEQ ID NO: 123769
  derived and/or modified sequence opt3 from hemagglutinin__InfluenzaA__ABU92730

SEQ ID NO: 123894 - RNA, 1701 nt, Artificial Sequence
  derived and/or modified sequence opt3 from hemagglutinin__InfluenzaA__ABU92731
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacguguggggcguccaccauccuggcacauauaacgaucagauuucuuuguacgcccaggcuuccgggcguaucacugugucaaccaagagaagccaacagacaguaauuccaaauaucggaaguaggccccggguucgcgacauaccuucuagaauuuccaucuacuggaccauugugaagccaggugauauccugcuaaucaacagcacgggcaaucucauugccccgaggggguauuuuaaaauacggucgggaaagucuuccaucaugcgcucagacgcgcccauuggcaaguguaacagugaaugcaucacuccuaaugguagcauaccaaacgacaaacccuuccagaaugucaaccgaauuacauacggggcauguccuagauaugugaagcagaauacccugaaacuugccacuggaaugaggaacgugccagagaagcaaacacggggcaucuuuggcgcuaucgccggguucauugaaaauggaugggaggguauggucgauggcugguacggguuucgucaccagaacuccgagggaaucggccaggcagcugaccugaaaucuacccaagccgcgauugaucagauaaaugguaaguugaaccgccucaucgggaaaacgaaugaaaaguuccaccagauugagaaggaauuuagcgagguugaaggcagaauccaggaccuggagaaauauguggaggauaccaagaucgacuuauggucauacaacgccgaacugcucguagcacuugagaaccaacauacaauugaucugacugacagugaaaugaauaaauuguuugagaggaccaagaaacagcuacgggaaaacgcugaggauaugggaaauggcugcuucaagauauaucacaagugugacaacgccugcaucggguccauucgaaauggaacauacgaucaugacguguaccgcgacgaggcucugaacaauagauuucagaucaaaggugucgaacucaagagcggcuauaaagauuggauucuguggaucucuuucgccauaucaugcuuucuucuguguguggcauugcucggguucaucaugugggccugccagaagggaaacauuagguguaauaucugcauuuga

SEQ ID NO: 123895 - RNA, 1701 nt, Artificial Sequence
  derived and/or modified sequence opt3 from hemagglutinin__InfluenzaA__ABU92732
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacucaaguuucuucagccgacugaauuggcucacucauuuaaaguuuaaauauccagcacugaacguuaccaugcccaauaacgaggaguucgacaaacuuuacauuuggggcgugcaccauccuggcacauauaacgaucagaucucuuuguacgcccaggcuuccgggcguauuacugucucaaccaagagaagccaacagacagugaucccaaauauaggaaguaggccccggguacgcgacauuccuucuagaaucuccauuuacuggaccaucguuaagccaggugauauccugcuaauuaacagcacgggcaaucucauagccccgaggggguauuuuaaaauccggucgggaaagucuuccauuaugcgcucagacgcgcccaucggcaaguguaacagugaaugcauaacuccuaaugguagcauuccaaacgacaaacccuuccagaaugugaaccgaaucacauacggggcauguccuagauaugucaagcagaauacccugaaacuugccacuggaaugaggaacgugccagagaagcaaacacggggcaucuuuggcgcuauugccggguucaucgaaaauggaugggaggguaugguggauggcugguacggguuucgucaccagaacuccgagggaauuggccaggcagcugaccugaaaucuacccaagccgcgauagaucagaucaaugguaaguugaaccgccucauugggaaaacgaaugaaaaguuccaccagaucgagaaggaauuuagcgaggucgaaggcagaauccaggaccuggagaaauauguugaggauaccaagauugacuuauggucauacaacgccgaacugcucguggcacuugagaaccaacauacaauagaucugacugacagugaaaugaauaaauuguuugagaggaccaagaaacagcuacgggaaaacgcugaggauaugggaaauggcugcuucaagaucuaucacaagugugacaacgccugcauuggguccauccgaaauggaacauacgaucaugacguauaccgcgacgaggcucugaacaauagauuucagauuaaagguguggaacucaagagcggcuauaaagauuggauccuguggauaucuuucgccaucucaugcuuucuucugugugucguguugcucggguucauuaugugggcaugccagaagggaaacaucagguguaauauuugcaucuga

SEQ ID NO: 123896 - RNA, 1701 nt, Artificial Sequence
  derived and/or modified sequence opt3 from hemagglutinin__InfluenzaA__ABU92733
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucaucgaaagauccaaagccuauucuaauuguuaccccuaugacgugccugauuacgcaucguugaggucacucgucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagauaaugaccagaucagcuuguaugcccaggcuucugggcguauuacugucuccaccaagagaucacaacagacagugaucccaaacauaggaagcaggccccggguacgcgauauuccuaguagaaucucuauuuacuggaccaucguuaaaccaggugacauccugcuaauuaauuccacgggcaaccucauagccccgaggggguacuuuaagauccggagcggaaagucgucuauuaugcgcuccgacgcgcccaucggcaaauguaauucagagugcauaacuccuaacgguaguauuccaaaugauaagcccuuccagaacgugaaucgaaucacauauggggcauguccuagauacgucaaacagaacacccugaaacuugccacuggaaugaggaaugugccagaaaagcaaacacggggcaucuuuggcgcuauugccggguucaucgagaacggaugggaagguaugguggacggcugguauggguuucgucaccagaauagcgagggaauuggccaggcagcugaucugaaguccacccaagccgcgauaaaccagaucaaugguaaauugaaccgccucauugggaagacgaacgagaaguuccaccagaucgaaaaagaguucucugaagucgagggcagaauccaggaccuggaaaaguacguugaggauaccaaaguggacuuauggagcuauaaugccgagcugcucguagcacuugaaaaccaacauacaauugaucugacugacucagagaugaauaaguuguuugaaaggaccaaaaagcagcuacgggagaacgcugaagauaugggaaauggcugcuucaagauauaccacaaaugugacaacgccugcaucgggaguauucgaaauggaacauauaaccaugauguguaccgcgacgaggcucugaauaacagauuucagaucaagggugucgagcucaaauccggcuacaaggacuggauucuguggaucagcuucgccauaucuugcuuucuucuguguguggcauugcucggguucaucaugugggccugccagaaaggaaauauuagguguaacaucugcauuuga

SEQ ID NO: 123897 - RNA, 1701 nt, Artificial Sequence; identical to SEQ ID NO: 123769
  derived and/or modified sequence opt3 from hemagglutinin__InfluenzaA__ABU92734

SEQ ID NO: 123898 - RNA, 1701 nt, Artificial Sequence
  derived and/or modified sequence opt3 from hemagglutinin__InfluenzaA__ABU92735
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgggagcccacaccagauccuagacggagagaauuguacccucauagaugcucugcuuggcgacccgcagugcgaugguuuucaaaacaaaaagugggaccuguucguggaaagauccaaagccuauucuaauuguuaccccuaugaugucccugacuacgcaucguugaggucacucguggccagcagugggacucuggaguuuaacaaugaauccuucaacuggacaggaguuacccagaauggcacgucuagcgcuugcaagcggcgcuccaacaauucauuuuucagucgacugaacuggcucacucauuuaaaguuuaaauauccagcacugaaugugaccaugcccaacaacgagaaguucgauaaacuuuacaucuggggcguccaccauccugggacagacaaugaucagauuagcuuguaugcccaggcuccagcccguaucacugugucuaccaagagaucccaacagacaguaauucccaacaucggaucaaggccucggguucgcgacauaccaagcagaauuaguaucuacuggaccauugugaaaccgggugauauccugcuaaucaauucuacgggcaaccucauugcgcccaggggguacuuuaagauacuguccggaaagagcucgaucaugcggucugacgcaccuauuggcaaauguaauuccgagugcaucacuccaaacgguucaauacccaaugacaagccuuuccagaacgucaaucgcauuacauauggggccuguccacgauacgugaaacagaacacccuuaagcuggcuacuggaaugagaaaugugcccgaaaaacaaacaaggggcaucuuuggcgccaucgcaggguucauugagaacggaugggaagguauggucgauggcugguauggguuucggcaccagaauagugagggaaucggccaggcugccgaccucaagagcacccaagcggccauuaaccagauaaaugguaaauugaaccgucugaucgggaagacgaacgagaaguuccaccagauugaaaaagaguucuccgaaguugagggccgcauccaggauuuagaaaaguacguggaggacaccaaaaucgaucuguggucuuauaaugcagagcuccuuguagcucuggaaaaccaacauacaauugacuugacugauagcgagaugaauaagcuauuugaaagaaccaaaaagcagcugagggagaacgccgaagacaugggaaauggcugcuucaagauauaccacaaaugugauaacgcuugcaucgggucaauucggaauggaacauaugaccaugauguguaccgagacgaggcccucaacaaucgcuuucagaucaagggugucgagcugaaaaguggcuacaaggacuggauucuuuggaucuccuucgcaaugagcugcuuucuguuguguguggcccuccugggguucauaaugugggcuugccagaaaggaaacaucagauguaauauuugcaucuga

SEQ ID NO: 123899 - RNA, 1701 nt, Artificial Sequence; identical to SEQ ID NO: 123844
  derived and/or modified sequence opt3 from hemagglutinin__InfluenzaA__ABU92737

SEQ ID NO: 123900 - RNA, 1701 nt, Artificial Sequence
  derived and/or modified sequence opt3 from hemagglutinin__InfluenzaA__ABU92738
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagauaaugaccagaucagcuuguaugcccaggcuccagggcguauuacugucucuaccaagagaucccaacagacagugauccccaacauaggaucaaggccucggguacgcgauauuccaagcagaaucaguauuuacuggaccaucguuaaaccgggugacauccugcuaauuaauucuacgggcaaccucauagcccccaggggguacuuuaagauccgguccggaaagagcucgauuaugcgcucugacgcgccuaucggcaaauguaauuccgagugcauaacuccaaacgguucaauucccaaugauaagccuuuccagaacgugaaucgaaucacauauggggcauguccaagauacgucaaacagaacacccugaagcuggccacuggaaugaggaaugugcccgaaaaacaaacacggggcaucuuuggcgcuauugccggguucaucgagaacggaugggaagguaugguggacggcugguauggguuucgucaccagaauagugagggaauuggccaggcagcugaucuuaagagcacccaagccgcgauagaccagaucaacgguaaauugaaucgccucauugggaagacgaacgagaaguuccaccagaucgaaaaagaguucuccgaagucgagggcagaauccaggaucuggaaaaguacguugaggacaccaaaauugauuuauggucuuauaacgccgagcugcucguggcacuugaaaaucaacauacaauagaccugacugauagcgagaugaacaaguuguuugaaaggaccaaaaagcagcuacgggagaaugcugaagacaugggaaacggcugcuucaagaucuaccacaaaugugauaaugccugcauugggucaauccgaaacggaacauaugaccaugacguauaccgcgaugaggcucugaauaacagauuucagauuaaggguguggagcucaaaaguggcuacaaggacuggauccuguggauauccuucgccaucagcugcuuucuucugugugucguguugcucggguucauuaugugggcaugccagaaaggaaauaucagguguaacauuugcaucuga

SEQ ID NO: 123901 - RNA, 1701 nt, Artificial Sequence; identical to SEQ ID NO: 123778
  derived and/or modified sequence opt3 from hemagglutinin__InfluenzaA__ABU92739

SEQ ID NO: 123902 - RNA, 1701 nt, Artificial Sequence
  derived and/or modified sequence opt3 from hemagglutinin__InfluenzaA__ABU92740
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacacucugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcaagcggcgcuccaacaauucauuuuucagucgacugaacuggcucacccauuuaaaguuuaaauauccagcucugaaugugacaaugcccaacaacgagaaguucgacaaacuuuacaucuggggaguccaccauccuggcacugauaaugaccagauuuuucuuuaugcacaggccagcggccguaucaccgugucuacaaagagaucccaacagaccguaauuccaaacaucgggucaaggccccggguucgcaauauaccuagcagaauuaguaucuacuggacgauugugaaaccaggagauauccugcuaaucaacucuacugguaaucucauugcuccgaggggcuacuucaagauacgguccgggaaaagcucgaucaugcgcucugacgcccccauuggaaaauguaacuccgaaugcaucacaccuaauggcucaauaccaaacgacaagcccuuucagaaugucaaccgaauuaccuauggugcguguccuagauacgugaaacagaauacucugaaguuggcaacagggaugaggaacgugccagagaaacaaacccggggaaucuucggcgccaucgcuggcuuuauugaaaaugggugggagggaauggucgaugguugguauggcuuccgucaccagaacagugaggggaucggacaggccgcagaccugaaaagcacgcaagcugccauuaaucagauaaacggcaaauugaaccgccucaucgguaagaccaaugaaaaguuccaccagauugagaaagaauuuuccgagguugaagggagaauccaggaucuggagaaguacguggaggacacaaaaaucgauuuauggucuuauaacgcggaacugcucguagcccuugagaaucaacauacuauugaccugaccgauagcgaaaugaacaaguuguucgagaggacaaagaagcagcuacgggaaaaugcagaggacaugggcaacggaugcuuuaagauauaccacaaaugugauaaugcuugcaucggcucaauucgaaacgggacuuaugaccaugauguguaccgcgacgaggcccugaauaacagauuccagaucaagggagucgaacucaaaagugguuacaaggacuggauucuguggaucuccuuugcuauaagcugcuuccuucuguguguggccuugcucggcuuuaucaugugggcaugccagaaagggaauauuagguguaacaucugcauuuga

SEQ ID NO: 123903 - RNA, 1701 nt, Artificial Sequence
  derived and/or modified sequence opt3 from hemagglutinin__InfluenzaA__ABU92741
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgaggaguucgacaaacuuuacauuuggggcgugcaccauccuggcacagauaaugaccagaucagcuuguaugcccaggcuccagggcguauuacugucucuaccaagagaucccaacagacagugauccccaacauaggaucaaggccucggguacgcgauauuccaagcagaaucaguauuuacuggaccaucguuaagccgggugacauccugcuaauuaauucuacgggcaaccucauagcccccaggggguacuuuaaaauccgguccggaaagagcucgauuaugcgcucugacgcgccuaucggcaaguguaauuccgaaugcauaacuccaaacgguucaauucccaaugauaaaccuuuccagaacgugaaucgaaucacauauggggcauguccaagauacgucaagcagaacacccugaaacuugccacuggaaugaggaaugugcccgagaagcaaacacggggcaucuuuggcgcuauugccggguucaucgaaaacggaugggaggguaugguggacggcugguauggguuucgucaccagaauagugagggaauuggccaggcagcugaucugaaaagcacccaagccgcgauagaccagaucaacgguaaguugaaucgccucauugggaaaacgaacgaaaaguuccaccagaucgagaaggaguucuccgaagucgaaggcagaauccaggaucuggagaaauacguugaggacaccaagauugauuuauggucuuauaacgccgaacugcucguggcacuugagaaucaacauacaauagaccugacugauagcgaaaugaacaaauuguuugagaggaccaagaaacagcuacgggaaaaugcugaggacaugggaaacggcugcuucaagaucuaccacaagugugauaaugccugcauugggucaauccgaaacggaacauaugaccaugacauuuaccgcgaugaggcucugaauaacagauuucagaucaaagguguagaacucaagaguggcuacaaagacuggauacuguggaucuccuucgccauuagcugcuuucuucuguguguggucuugcucggguucaucaugugggcaugccagaagggaaauauuagguguaacaucugcauauga

SEQ ID NO: 123904 - RNA, 1701 nt, Artificial Sequence; identical to SEQ ID NO: 123844
  derived and/or modified sequence opt3 from hemagglutinin__InfluenzaA__ABU92742

SEQ ID NO: 123905 - RNA, 1701 nt, Artificial Sequence
  derived and/or modified sequence opt3 from hemagglutinin__InfluenzaA__ABU92743
augaagaccaucauugcccugagcuacauacucuaucuuguguucgcucagaaacugcccgagaacgacaauuccacagcaacuuugugcuuaggccaccaugccgucccuaacgggacgaucguuaagaccauuacaaaugaucaaaucgaagugacuaacgcgaccgagcugguacagucuucaaguacaggagguauuugugacagcccacaccagauccuagauggcgaaaauugcacccucauagacgcucugcuuggggauccgcagugugacggauuucaaaacaaaaagugggaucuguucguggagagauccaaagccuacucuaauugcuaucccuacgacgucccugauuaugcaucguugaggucacucguggccagcaguggcacucuggaauuuaacaaugaguccuucaacuggacagguguuacccagaaugggacgucuagcgcuuguaagcggcgcuccaacaauucauuuuucagucgacugaacuggcucacucauuuaaaguuuaaauacccagcacugaaugugaccaugcccaacaacgagaaguucgacaaacuuuauaucuggggaguccaccauccuggcacagauaaugaccagaucuuuuuguacgcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuauuucaagauacgguccggaaagagcucgaucaugcgcucugacgcgcccauugggaaaugcaacuccgaauguaucacuccuaauggcucaauaccaaacgacaagcccuuucagaaugucaaccgaauuacauacggugcaugcccuagauaugugaaacagaauacccugaagcuggccacugggaugaggaacgugccagagaaacaaacacggggaaucuucggcgcuaucgccggcuuuauugaaaaugggugggagggaauggucgaugguugguacggcuuccgucaccagaacagugaggggaucggacaggcagcugaccuuaagagcacccaagccgcgauugaucagauaaauggcaaauugaaccgccucaucgguaagacgaacgaaaaguuccaccagauugagaaagaauuuuccgagguugaagggagaauccaggaccuggagaaguauguggaggauaccaaaaucgacuuauggucuuacaaugccgaacugcucguagcacuugagaaccaacauacaauugaucugacugacagcgaaaugaauaaguuguucgagaaaaccaagaagcagcuaagggaaaacgcugaggauaugggcaauggauguuuuaaaauauaucacaagugcgacaacgccuguaucggcucaauucggaaugggacauacgaucaugacguguaccgagacgaggcucugaacaaucgcuuccagaucaaaggagucgaacucaagagugguuauaaagauuggauucuguggaucuccuuugccauaagcugcuuccuucugugcguggcauugcucggcuuuaucaugugggccugucagaaggggaacauuagaugcaauaucuguauuuga

SEQ ID NO: 123906 - RNA, 1701 nt, Artificial Sequence; identical to SEQ ID NO: 123844
  derived and/or modified sequence opt3 from hemagglutinin__InfluenzaA__ABU92744

SEQ ID NO: 123907 - RNA, 1701 nt, Artificial Sequence
  derived and/or modified sequence opt3 from hemagglutinin__InfluenzaA__ABU92745
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgaggaguucgacaaacuuuacauuuggggcgugcaccauccuggcacagauaaugaccagaucagcuuguaugcccaggcuccagggcguauuacugucucuaccaagagaucccaacagacagugauccccaacauaggaucaaggccucggguacgcgauauuccaagcagaaucaguauuuacuggaccaucguuaagccgggugacauccugcuaauuaauucuacgggcaaccucauagcccccaggggguacuuuaaaauccggauuggaaaguccagcaucaugcgcucggacgcgccuauaggcaaguguaauucugaaugcauuacuccaaacgguuccauccccaaugauaaaccuuuccagaacgugaaucgaaucacauauggggcauguccaagauacgucaagcagaacacccugaaacuugccacuggaaugaggaaugugcccgagaagcaaacacggggcauuuuuggcgcuaucgccggguucauugaaaacggaugggaggguaugguggacggcugguauggguuucgucaccaaaauucagagggaauaggccaggcagcugaucugaaaaguacccaggccgcgaucgaccagauuaacgguaaguugaaucgccucaucgggaaaacgaacgaaaaguuccaccagaucgagaaggaguucagcgaagucgaaggcaggauucaggaucuggagaaauacguugaggacaccaagauagauuuaugguccuauaacgccgaacugcucguggcacuugagaaucaacauacaaucgaccugacugauucugaaaugaacaaauuguuugagagaaccaagaaacagcuacgggaaaaugcugaggacaugggaaacggcugcuucaagauuuaccacaagugugauaaugccugcaucgggagcauucgaaacggaacauaugaccaugacguauaccgcgaugaggcucugaauaacagauuucagaucaaagguguggaacucaagucaggcuacaaagacuggauacuguggaucaguuucgccauuuccugcuuucuucugugugucguguugcucggguucaucaugugggcaugccagaagggaaauauuagguguaacaucugcauauga

SEQ ID NO: 123908 - RNA, 1701 nt, Artificial Sequence; identical to SEQ ID NO: 123844
  derived and/or modified sequence opt3 from hemagglutinin__InfluenzaA__ABU92746

SEQ ID NO: 123909 - RNA, 1701 nt, Artificial Sequence; identical to SEQ ID NO: 122089
  derived and/or modified sequence opt3 from hemagglutinin__InfluenzaA__ABU92747

SEQ ID NO: 123910 - RNA, 1701 nt, Artificial Sequence
  derived and/or modified sequence opt3 from hemagglutinin__InfluenzaA__ABU92748
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauagcaaguuuaaauauccagcauuaaaugugaccaugcccaacaacgagaaguucgacaaacuguacaucuggggaguccaccauccuggcacagauaaugaccagacuuuucuuuaugcccaggcuucuggccguauuaccguguccacaaagagaucacaacagaccguaaucccaaacauugggagcaggccccggguucgcaauaucccuaguagaauaucuauuuacuggacgaucgugaaaccaggagauauuuugcugaucaacuccacugguaaucuaaucgccccgaggggcuacuucaagauucggagcgggaagucgucuauaaugcgcuccgacgcgcccaucggaaaauguaacucagaaugcauuacaccuaauggcaguaucccaaacgacaagcccuuucagaaugucaaccgaauaaccuauggugcauguccuagauacgugaaacagaauacucucaagcuggccacagggaugaggaacgugccagagaaacaaacccggggaauuuucggcgcuaucgccggcuuuaucgaaaaugggugggagggaauggucgaugguugguauggcuuccgucaccagaacagcgaggggauuggacaggcagcugaccuuaaguccacgcaagccgcgaucaaucagauuaacggcaaacugaaccgcuugauagguaagaccaaugaaaaguuccaccagaucgagaaagaauuuucugagguugaagggaggauucaggaucucgagaaguacguggaggacacaaaaaucgaucuguggagcuauaacgccgaauuacugguagcacucgagaaucaacauacuaucgaccuuaccgauucagaaaugaacaagcuguucgagagaacuaaaaagcaguugcgggaaaaugcugaggacaugggcaacggaugcuuuaagauuuaccacaaaugugauaaugccugcauaggcaguauccgaaacgggacauaugaccaugauguguaccgcgacgaggcucuaaauaacagauuccagauuaagggagucgaacugaaauccgguuacaaggacuggauccucuggauuagcuuugccaucucuugcuuccugcuuugugugguucuguugggcuuuauaaugugggcaugccagaaagggaauaucagguguaacauuugcaucuga

SEQ ID NO: 123911 - RNA, 1701 nt, Artificial Sequence; identical to SEQ ID NO: 122089
  derived and/or modified sequence opt3 from hemagglutinin__InfluenzaA__ABU92749

SEQ ID NO: 123912 - RNA, 1701 nt, Artificial Sequence
  derived and/or modified sequence opt3 from hemagglutinin__InfluenzaA__ABU92750
augaagaccaucauugcccugagcuacauacucugccuuguguucgcucagaaacugcccggcaacgacaauagaacagcaacuuuguguuuagggcaccaugccgucccuaacggaacgaucguuaagaccauuacaaaugaucaaaucgaggugacuaacgcgaccgaacugguacagauuuccucuacagguggcaucugcgacucaccacaccagauacuagauggggagaauuguacccucaucgacgcucugcuuggagauccgcagugcgacggcuuucaaaacaaaaagugggaucuguucguggaaaggaguaaagccuauagcaauuguuaccccuaugacgucccugauuacgcauccuugcggucucucguggccucgucagguacucuggaguuuaacaaugagagcuucgacuggacagggguuacccagaacggaacgaguuccgcuugcaagcgccgaucuaauaagagcuuuuucucccgucugaacuggcucacucauuuaaaauauaaguacccagcacugaaugugaccaugcccaacaaugaaaaauuugauaaacuuuauauuuggggcguccaccauccuggcacagacucagaucagaucaguuuguacgcccaggcuagcgggagaauuacugugucuaccaagaggucccaacagacaguaaucccaaacauaggaucacggccccgcguuagagacgugagcaguaggauuucuaucuacuggaccauugucaagccuggugacauccugcuaaucaacuccacgggcaaucucauugccccacggggguauuucaagauacgcagcggaaaaucgucuaucaugcgauccgaugcgccgauuggcaaguguaacucagagugcaucacucccaaugguaguauaccuaacgacaaaccauuucagaaugugaacagaauuacauacggggcaugucccagguaugugaagcagaauacccugaaacuugccacuggaaugcggaacgucccugaaaagcaaacacguggcaucuucggcgcuaucgccggguuuauugagaauggaugggaagguaugguugauggcugguacggguuccgccaccagaacagcgagggaaccggccaggcagcugaccugaaauccacgcaagccgcgaucaaucagauuaacgguaaguugaauagacucauagggaagaccaacgagaaauuucaccagaucgaaaaggaguucucugaaguggagggcaggauucaggaucuggaaaaauauguagaggacacaaagaucgauuuauggagcuacaaugccgagcugcucguggcacuugaaaaccaacauacuaucgaccugaccgauucagagaugaacaaauuguucgaacggacaaagaagcagcuacgagagaaugcugaagacaugggaaacggcugcuuuaaaauuuaucacaagugugauaaugccugcauagggaguauccgcaacggaacuuacgaccaugacgucuacagagaugaggcucugaauaacagguuccagauuaaagguguggagcucaaguccggcuauaaagacuggauccuguggauuagcuuugccaucucuugcuuccuucuguguguugcauugcucggguuuauaaugugggccugccagaagggaaauauccgguguaacauuugcaucuga

SEQ ID NO: 123913 - RNA, 1701 nt, Artificial Sequence
  derived and/or modified sequence opt3 from hemagglutinin__InfluenzaA__ABU92751
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauauaaguacccagcacugaacgugaccaugcccaauaacgagaaauuugacaaacuuuauaucuggggcguccaccauccuggcacagauagcgaccagauuucuuuguacgcccaggcuuccgggcguaucacugugucaaccaagagaagccaacagacaguaauuccaaacaucggaaguaggccccggguucgcgaugugucuuccagaauaagcauuuacuggaccaucgucaagccuggugacauucugcuaaucaauucgacgggcaaccucaucgccccaaggggguauuucaagauucggucuggaaaauccucaauaaugcgcagugacgcgccgaucggcaaguguaauagcgagugcauuacucccaacgguuccaucccuaaugauaaaccauuucagaacgugaaucgaauaacauacggggcaugucccagauaugugaagcagaacacccugaaacuugccacuggaaugaggaaugucccugaaaagcaaacacggggcauuuucggcgcuaucgccggguuuaucgagaacggaugggaagguaugguugacggcugguacggguuccgucaccaaaauucugagggaaccggccaggcagcugaucugaaaagcacgcaggccgcgauuaaccagaucaaugguaaguugaaccgccucauugggaagaccaaugagaaauuucaccagauagaaaaggaguucucagaaguggagggcagaauccaggaccuggaaaaauauguagaggauacaaagauugacuuauggaguuacaacgccgagcugcucguggcacuugaaaaccaacauacuaucgaucugaccgacuccgagaugaauaaauuguucgaaaggacaaagaagcagcuacgggagaacgcugaagauaugggaaauggcugcuuuaaaaucuaucacaagugugacaacgccugcauugggagcauacgaaauggaacuuacgaucaugacgucuaccgcgacgaggcucugaacaauagauuccagaucaaagguguggagcucaagucuggcuauaaagauuggauucuguggaucucauuugccauuaguugcuuccuucuguguguugcauugcucggguuuaucaugugggccugccagaagggaaacauaagguguaauaucugcauuuga

SEQ ID NO: 123914 - RNA, 1701 nt, Artificial Sequence; identical to SEQ ID NO: 123778
  derived and/or modified sequence opt3 from hemagglutinin__InfluenzaA__ABU92752

SEQ ID NO: 123915 - RNA, 1701 nt, Artificial Sequence; identical to SEQ ID NO: 122089
  derived and/or modified sequence opt3 from hemagglutinin__InfluenzaA__ABU92753

SEQ ID NO: 123916 - RNA, 1701 nt, Artificial Sequence; identical to SEQ ID NO: 123778
  derived and/or modified sequence opt3 from hemagglutinin__InfluenzaA__ABU92754

SEQ ID NO: 123917 - RNA, 1701 nt, Artificial Sequence
  derived and/or modified sequence opt3 from hemagglutinin__InfluenzaA__ABU92755
augaagaccaucauugcccugagcuacauacucugccuuguguucgcucagaaacugcccggcaacgacaaugggacagcaacuuuguguuuaggacaccaugccgucccuaacgguacgaucguuaagaccauuacaaaugaucaaaucgaggugacuaacgcgaccgaacugguacaguccucuucaacaggcgggauuugcgacaguccacaccagauccuagauggagagaauuguacccucauagacgcucugcuuggcgauccgcagugcgacgguuuucaaaacaaaaagugggaucuguucguggaaagaagcaaagccuauuccaauuguuaccccuaugacgucccugauuacgcaucuuugaggucgcucguggccucaagcgggacucuggaguuuaacaaugaaaguuucaacuggacaggaguuacccagaauggcacguccucugcuugcaagcggcgcagcaacaaguccuuuuucucacgacugaauuggcucacucauuuaaaauuuaaguauccagcacugaacgugaccaugcccaauaacgagaaauucgacaaacuuuacaucuggggcguccaccauccugggacagauaacgaccagauuaguuuguaugcccaggcuagcggacguaucacugugucuaccaagagaucccaacagacaguaauuccaaauaucgguucaaggccccggguucgcgaugugccuagcagaauaaguauuuacuggaccaucgucaagccaggcgacauucugcuaaucaacucuacggggaaucucaucgccccgaggggauacuuuaagauucgguccggcaaaagcucgauaaugcgcucugacgcgcccaucgguaaguguaacuccgagugcauuacuccuaaugggucaaucccaaacgauaaacccuuccagaaugugaaccgaauaacauauggagcauguccuagauacgugaagcagaauacccugaaacuugccacuggcaugaggaacgucccagaaaagcaaacacggggcauuuuuggggcuaucgccggauucaucgagaaugguugggaaggcaugguugacgggugguauggauuucgucaccagaacgcagagggcaccggucaggcugccgaucugaaaaguacgcaagcggccauuaaucagaucaacgggaaguugaaucgccucauuggcaagaccaacgagaaauuccaccagauagaaaaggaguucagcgaaguggagggaagaauccaggaccuggaaaaauacguagaggauacaaagauugacuuaugguccuauaacgcagagcugcucguggcucuugaaaaucaacauacuaucgaucugaccgacucugagaugaacaaauuguuugaaaggacaaagaagcagcuacgggagaaugccgaagauaugggcaacgggugcuucaaaaucuaccacaagugugacaaugcuugcauuggaagcauacgaaacgguacuuaugaucauaaugucuaccgcgacgaggcccugaacaauagauuucagaucaaaggcguggagcucaagucaggguacaaagacuggauucuguggaucaguuucgcaauuuccugcuuucuucuguguguuguguugcucggauucaucaugugggccugccagaagggcaacauaagguguaauaucugcauuuga

SEQ ID NO: 123918 - RNA, 1701 nt, Artificial Sequence
  derived and/or modified sequence opt3 from hemagglutinin__InfluenzaA__ABU92756
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagcccauuccaauuguuaucccuacgacgucccugauuaugcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucacuuaaaauacaaguauccagcacugaaugugaccaugcccaacaaugagaaauuugauaaacuuuacauuuggggcguccaucacccuggcacagacagugaucagaucagcuuguaugcccaggcuucugggcguauuacuguguccaccaagagaucacaacagacaguaaucccaaacauaggaagcaggccccggguucgcgacgugaguucuagaauuuccaucuacuggaccauugucaagccuggugacauccugcuaaucaacagcacgggcaaucucauugccccaaggggguacuucaagauacggucgggaaaaucuuccaucaugcgcucagaugcgccgauuggcaaguguaacagugagugcaucacucccaaugguagcauaccuaacgacaaaccauuucagaaugugaaccgaauuacauauggggcaugucccagauacgugaagcagaauacccugaaacuugccacuggaaugaggaacgucccugaaaagcaaacacggggcaucuucggcgcuaucgccggguuuauugagaauggaugggaagguaugguugauggcugguauggguuccgucaccagaacuccgagggaaccggccaggcagcugaccugaaaucuacgcaagccgcgaucaaucagauuaacgguaaguugaaucgccucauagggaagaccaacgagaaauuucaucagaucgaaaaggaguucagcgaaguggagggcaggauucaggaucuggaaaaauacguagaggacacaaagaucgauuuauggucauauaaugccgagcugcucguggcacuugaaaaccaacacacuaucgaccugaccgauagugagaugaacaaauuguucgaaagaacaaagaagcagcuacgggagaaugcugaagacaugggaaacggcugcuuuaaaauuuaccauaagugugauaaugccugcauaggguccauccgaaacggaacuuaugaccacgacgucuaccgcgaugaggcucugaauaacagauuccagauuaaagguguggagcucaagagcggcuacaaagacuggauccuguggauuucuuuugccaucucaugcuuccuucuguguguugcauugcucggguuuauaaugugggccugccagaagggaaauaucagguguaacauuugcaucuga

SEQ ID NO: 123919 - RNA, 1701 nt, Artificial Sequence
  derived and/or modified sequence opt3 from hemagglutinin__InfluenzaA__ABU92757
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucgacuggacagguguuacccagaacgggacguccucugcuugcaagcggcgcagcgauaaguccuuuuucucacgacugaauuggcucacucauuuaaaauauaaguacccagcacugaacgugaccaugcccaauaacgagaaauuugacaaacuuuauauuuggggaguccaccauccuggcacagauagugaccagaucagcuuguacgcccaggcuucuggccguauuacuguguccaccaagagaucacaacagacaguaaucccaaauauagggagcaggccccggguucgcgacgugaguucuagaauuuccaucuacuggaccauugucaagccuggagauauccugcuaaucaacagcacggguaaccucauugccccaaggggcuauuucaagauacggcgcgggaaaucgucuaucaugcgauccgacgcgccgauuggaaaguguaauucagaaugcaucacucccaacggcaguauaccuaaugauaaaccauuucagaacgugaauagaauuacauacggugcaugucccagguaugugaagcagaacacccugaaacuugccacugggaugcggaaugucccugagaagcaaacacguggaaucuucggcgcuaucgccggcuuuauugaaaacgggugggagggaaugguugacgguugguacggcuuccgccaccagaauagcgaggggaccggacaggcagcugaucugaaauccacgcaagccgcgaucaaccagauuaauggcaaguugaacagacucauagguaagaccaaugaaaaauuucaccagaucgagaaggaguucucugaaguggaagggaggauucaggaccuggagaaauauguagaggauacaaagaucgacuuauggagcuacaacgccgaacugcucguggcacuugagaaucaacauacuaucgaucugaccgacucagaaaugaacaaauuguucgagcggacaaagaagcagcuacgagaaaacgcugaggauaugggcaauggaugcuuuaaaauuuaucacaagugugacaacgccugcauaggcaguauccgcaaugggacuuacgaccaugaugucuacagagacgaggcucugaacaauagguuccagauuaaaggaguggaacucaaguccgguuauaaagauuggauccuguggauuagcuuugccaucucuugcuuccuucuguguguugcauugcucggcuuuauaaugugggccugccagaaggggaacauccgguguaauauuugcaucuga

SEQ ID NO: 123920 - RNA, 1701 nt, Artificial Sequence; identical to SEQ ID NO: 123778
  derived and/or modified sequence opt3 from hemagglutinin__InfluenzaA__ABU92758

SEQ ID NO: 123921 - RNA, 1701 nt, Artificial Sequence; identical to SEQ ID NO: 123778
  derived and/or modified sequence opt3 from hemagglutinin__InfluenzaA__ABU92759

SEQ ID NO: 123922 - RNA, 1701 nt, Artificial Sequence
  derived and/or modified sequence opt3 from hemagglutinin__InfluenzaA__ABU92760
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcaauaguccacaccagauacuagacggcgaaaacuguacccucaucgaugcucugcuuggggacccgcagugcgauggauuucaaaauaaaaagugggaccuguucguggagagaagcaaagccuauuccaacuguuaccccuaugaugucccugacuacgcaucuuugaggucgcucguggccucaagcggcacucuggaauuuaauaacgagaguuucgauuggacagguguuacccagaaugggacguccucugcuugcaagcggcgcagcgacaaguccuuuuucucacgacugaacuggcucacucauuuaaaauauaaguacccagcacugaaugugaccaugcccaacaaugagaaauuugauaaacuuuauauuuggggaguccaccauccuggcacagacagugaucagaucagcuuguacgcccaggcuucuggccguauuacuguguccaccaagagaucacaacagacaguaaucccaaacauagggagcaggccccggguucgcgacgugaguucuagaauuuccaucuacuggaccauugucaagccuggagacauccugcuaaucaacagcacggguaaucucauugccccaaggggcuauuucaagauacggucggggaaaucuuccaucaugcgcucagaugcgccgauuggaaaguguaacagugaaugcaucacucccaauggcagcauaccuaacgacaaaccauuucagaaugugaaccgaauuacauacggugcaugucccagauaugugaagcagaauacccugaaacuugccacugggaugaggaacgucccugagaagcaaacacggggaaucuucggcgcuaucgccggcuuuauugaaaaugggugggagggaaugguugaugguugguacggcuuccgucaccagaacuccgaggggaccggacaggcagcugaccugaaaucuacgcaagccgcgaucaaucagauuaacggcaaguugaaucgccucauagguaagaccaacgaaaaauuucaccagaucgagaaggaguucagcgaaguggaagggaggauucaggaucuggagaaauauguagaggacacaaagaucgauuuauggucauacaaugccgaacugcucguggcacuugagaaccaacauacuaucgaccugaccgauagugaaaugaacaaauuguucgagagaacaaagaagcagcuacgggaaaaugcugaggacaugggcaacggaugcuuuaaaauuuaucacaagugugauaaugccugcauaggcuccauccgaaacgggacuuacgaccaugacgucuaccgcgaugaggcucugaauaacagauuccagauuaaaggaguggaacucaagagcgguuauaaagacuggauccuguggauuucuuuugccaucucaugcuuccuucuguguguugcauugcucggcuuuauaaugugggccugccagaaggggaauaucagguguaacauuugcaucuga

SEQ ID NO: 123923 - RNA, 1698 nt, Artificial Sequence
  derived and/or modified sequence opt3 from hemagglutinin__InfluenzaA__ABV29579
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccacgaaguuacggauggugacuggacugcgcaauauuccaucaauccagagucgaggccucuucggcgccaucgcaggguuuauugaaggagguuggacaggcauggucgacgggugguacggauaucaucaccagaacgagcaaggcagcgguuacgcugccgaucagaaauccacccagaaugcgauaaacgggaucacuaauaaggugaacucuguuauugaaaagaugaauacacaguucaccgccgugggcaaagaguucaacaaacuugagaagagaauggaaaaucugaacaagaaagucgacgauggauuuuuggacaucuggacguacaacgcagagcuacuggugcuccuggaaaaugagaggacccuugacuuccacgauagcaacguaaagaaucuguaugaaaaaguuaagucacaauugaaaaacaaugcuaaggagauaggcaacgggugcuuugaguucuaccauaaguguaaugacgaaugcauggagagugugaaaaacggaacauaugauuaccccaaguauuccgaagagagcaaacucaaucgggagaagauugacggugucaaacuggaaucuaugggcguguaccagaucuuagccaucuauucaacugucgcuaguagccuggugcuacucguuucccugggggccauuucuuuuuggaugugcucgaacggaagccuucagugucguaucugcauuuga

SEQ ID NO: 123924 - RNA, 1698 nt, Artificial Sequence
  derived and/or modified sequence opt3 from hemagglutinin__InfluenzaA__ABV29612
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagguggcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccacgaaguuacggauggugacuggacugcgcaauauuccaucaauccagagucgaggccucuucggcgccaucgcaggguuuauugaaggagguuggacaggcauggucgacgggugguacggauaucaucaccagaacgagcaaggcagcgguuacgcugccgaucagaaauccacccagaaugcgauaaacgggaucacuaauaaggugaacucuguuauugaaaagaugaauacacaguucaccgccgugggcaaagaguucaacaaacuugagagaaggauggaaaaucugaacaagaaggucgacgauggauuuuuggacaucuggacguacaacgcagagcuacuggugcuccuggaaaaugagcggacccuugacuuccacgauagcaacguuaaaaaucuguaugaaaagguaaaaucacaauugaagaacaaugcuaaagagauaggcaacgggugcuuugaguucuaccauaaguguaaugacgaaugcauggagagugugaagaacggaacauaugauuaccccaaauauuccgaagagagcaagcucaaucgugagaaaauugacggugucaagcuggaaucuaugggcguguaccagaucuuagccaucuauucaacugucgcuaguagccuggugcuacucguuucccugggggccauuucuuuuuggaugugcucgaacggaagccuucagugucgcaucugcauuuga

SEQ ID NO: 123925 - RNA, 1698 nt, Artificial Sequence
  derived and/or modified sequence opt3 from hemagglutinin__InfluenzaA__ABV29634
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaagcuccaucuccggagaauggaaccuguuaucccggcuacuuugccgacuaugaggaacugagagagcaacucucgucagugagcaguuucgaaagguuugagauuuucccuaaggaguccucuuggccaaaccauacugucacaggugugagcgcauccugcucacacaaugggaagaguagcuuuuaccggaacuuacuguggcuuaccggcaaaaauggauuguaucccaaccugucuaaguccuacgccaauaacaaagaaaaggagguucuaguacucuggggcgugcaucacccuccaaauaucggggaucagcgcgcucuguaccacacggaaaacgcauaugucucaguggugagcagucauuacucucgacguuucacucccgagauagccaaaagaccuaaggucagggaccaggaaggacggaucaacuauuacuggacccuucuggagccaggugauacaauuaucuuugaggcuaauggcaacuugauugccccgcgcuucgcguuugcacucuccagaggguucggaagcggcaucauaacuucgaaugcccccaugggugaaugugacgcuaagugccagaccccucaaggggccauuaacucuucccugccauuucagaauguucaccccgugacaaucggagaguguccuaaauauguaaggucagcaaaguuacggauggugaccggccugcgcaacauuccaaguauccagagccgaggccucuucggggcuaucgccggauuuauugaagguggcuggacggggauggucgauggaugguacggcuaucaucaccagaaugagcaagguuccggguacgcggccgaccagaaaucuacucagaacgcaauaaauggcaucacaaacaaggugaauagcguuauugaaaagaugaacacccaguucacugcugugggaaaagaguucaauaaacuugagagaaggauggaaaaccugaauaagaaggucgaugacggcuuuuuggauaucuggacauacaacgccgagcuacuggugcuccuggaaaacgagcggacccuugacuuccacgacucaaauguuaaaaaccuguaugaaaagguaaaaagucaauugaagaauaacgcuaaagagauagggaauggaugcuuugaguucuaccauaaguguaacgaugaaugcauggaguccgugaagaaugguacguaugacuaccccaaauauagcgaagagucuaagcucaaccgugagaaaauugauggcgucaagcuggaaucaauggggguguaccagaucuuagccaucuauaguaccgucgcaagcucccuggugcuacucguuucucugggagccauuucguuuuggaugugcagcaauggcucccuucagugucgcaucugcauuuga

SEQ ID NO: 123926 - RNA, 1698 nt, Artificial Sequence
  derived and/or modified sequence opt3 from hemagglutinin__InfluenzaA__ABV29645
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccacgaaguuacggaugguaacuggacugcgcaauaucccaucaauccagagucgaggccucuucggcgccauugcaggguuuauagaaggagguuggacaggcaugguggacgggugguacggauaucaucaccagaacgagcaaggcagcgguuacgcugccgaucagaaauccacccagaaugcgaucaacgggauuacuaauaaggucaacucugugaucgaaaagaugaauacacaguucaccgccguuggcaaagaguucaacaaacuugagagaaggauggaaaaucugaacaagaagguggacgauggauuuuuggacauauggacguacaacgcagagcuacugguccuccuggaaaaugagcggacccuugacuuccacgauagcaacgugaaaaaucuguaugaaaagguaaaaucacaauugaagaacaaugcuaaagagauuggcaacgggugcuuugaguucuaccauaaguguaaugacgaaugcauggagaguguuaagaacggaacauaugauuaccccaaauauuccgaagagagcaagcucaaucgugagaaaaucgacggugugaagcuggaaucuaugggcgucuaccagaucuuagccauuuauucaacuguggcuaguagccugguccuacucgugucccugggggccaucucuuuuuggaugugcucgaacggaagccuucagugucgcauuugcauauga

SEQ ID NO: 123927 - RNA, 1698 nt, Artificial Sequence; identical to SEQ ID NO: 123926
  derived and/or modified sequence opt3 from hemagglutinin__InfluenzaA__ABV29667

SEQ ID NO: 123928 - RNA, 1698 nt, Artificial Sequence
  derived and/or modified sequence opt3 from hemagglutinin__InfluenzaA__ABV29678
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccgucgacgaaugugaugccaagugccagacaccucaaggugcuaucaauucgucucugccauuucagaacguucaccccgugaccauuggggaguguccuaaauauguaagguccacgaaguuacggauggugacuggacugcgcaauaucccaucaauccagagucgaggccucuucggcgccauugcaggguuuauagaaggagguuggacaggcauggucgacgggugguacggauaucaucaccagaacgagcaaggcagcgguuacgcugccgaucagaaauccacccagaaugcgaucaacgggauuacuaauaaggugaacucuguuaucgaaaagaugaauacacaguucaccgccgugggcaaagaguucaacaaacuugagagaaggauggaaaaucugaacaagaaggucgacgauggauuuuuggacauauggacguacaacgcagagcuacuggugcuccuggaaaaugagcggacccuugacuuccacgauagcaacguuaaaaaucuguaugaaaagguaaaaucacaauugaagaacaaugcuaaagagauuggcaacgggugcuuugaguucuaccauaaguguaaugacgaaugcauggagagugugaagaacggaacauaugauuaccccaaauauuccgaagagagcaagcucaaucgugagaaaaucgacggugucaagcuggaaucuaugggcguguaccagaucuuagccauuuauucaacugucgcuaguagccuggugcuacucguuucccugggggccaucucuuuuuggaugugcucgaacggaagccuucagugucgcauuugcauauga

SEQ ID NO: 123929 - RNA, 1698 nt, Artificial Sequence
  derived and/or modified sequence opt3 from hemagglutinin__InfluenzaA__ABV29689
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccacgaaguuacggauggugacuggacugcgcaauauuccaucaauccagagucgaggccucuucggcgccaucgcaggguuuauugaaggagguuggauaggcauggucgacgggugguacggauaucaucaccagaacgagcaaggcagcgguuacgcugccgaucagaaauccacacagaaugcgaucaacgggauuaccaauaaggugaacucuguuaucgaaaagaugaauacucaguucacagccgugggcaaagaguucaacaaacuugagagaaggauggaaaaucugaacaagaaggucgacgauggauuuuuggacauauggaccuacaacgcagagcuacuggugcuccuggaaaaugagcggacgcuugacuuccacgauagcaacguuaaaaaucuguaugaaaagguaaaaucacaauugaagaacaaugcuaaagagauuggcaacgggugcuuugaguucuaccauaaguguaaugacgaaugcauggagagugugaagaacggaaccuaugauuaccccaaauauuccgaagagagcaagcucaaucgugagaaaaucgacggugucaagcuggaaucuaugggcguguaccagaucuuagccauuuauucaacagucgcuaguagccuggugcuacucguuucccugggggccaucucuuuuuggaugugcucgaacggaagccuucagugucgcauuugcauauga

SEQ ID NO: 123930 - RNA, 1698 nt, Artificial Sequence
  derived and/or modified sequence opt3 from hemagglutinin__InfluenzaA__ABV29700
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccacgaaguuacggauggugacuggacugcgcaauauuccaucaauccagagucgaggccucuucggcgccaucgcaggguuuauugaaggagguuggacaggcauggucgacgggugguacggauaucaucaccagaacgagcaaggcagcgguuacgcugccgaucagaaauccacccagaaugcgauaaacgggaucacuaauaaggugaacucuguuauugaaaagaugaauacacaguucaccgccgugggcaaagaguucaacaaacuugagagaaggauggaaaaucugaacaagaaggucgacgauggauuuuuggacaucuggacguacaacgcagagcuacuggugcuccuggaaaaugagcggacccuugacuuccacgauagcaacguuaaaaaucuguaugaaaagguaaaaucacaauugaagaacaaugcuaaagagauaggcaacgggugcuuugaguucuaccauaaguguaaugacgaaugcauggagagugugaagaacggaacauaugauuaccccaaauauuccgaagagagcaagcucaaucgugagaaaauugacggugucaagcuggaaucuaugggcguguaccagaucuuagccaucuauucaacugucgcuaguagccuggugcuacucguuucccugggggccauuucuuuuuggaugugcucgaacggaagccuucagugucgcaucugcauuuga

SEQ ID NO: 123931 - RNA, 1701 nt, Artificial Sequence
  derived and/or modified sequence opt3 from hemagglutinin__InfluenzaA__ABV29711
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccaguccggaaagagcucgauuaugcggucugacgcgcccaucgggaaguguaacuccgaaugcauaacuccuaauggcucaauuccaaacgacaaacccuuucagaaugucaaccgcaucacauauggugcauguccucgauacgugaagcaaaauacccugaaacuugccacugggaugagaaacgugccagagaagcagacaaggggaaucuucggcgcuauugccggcuuuaucgaaaaugggugggagggaauggucgaugguugguauggcuuccggcaccagaacagugaggggauuggacaagcagcugaccugaaaagcacccaggccgcgauagaucagaucaauggcaaguugaaccgucucauugguaaaacgaacgaaaaguuccaccagaucgagaaggaauuuuccgagguugaagggcgcauccaagaccuggagaaauacguggaggauaccaagauugacuuauggucuuauaaugccgaacugcucguagcacuugagaaccagcauacaauagaucugacugacagcgaaaugaauaaauuguucgagaagaccaaaaagcagcuaagagaaaacgcugaggauaugggcaauggaugcuuuaagaucuaccacaaaugugacaacgccugcauuggcucaaucaggaaugggacauaugaucaugacguguaccgggacgaggcucugaacaaucgauuccagauuaagggagucgaacucaaaagugguuacaaggauuggauccuguggauauccuuugccaucagcugcuuccuucuguguguggcauugcucggcuuuauuaugugggccugccaaaaagggaacauccgcuguaauauuugcaucuga

SEQ ID NO: 123932 - RNA, 1701 nt, Artificial Sequence
  derived and/or modified sequence opt3 from hemagglutinin__InfluenzaA__ABV29722
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuucuggagguugaagggagaauccaggacuuagagaaauacguggaggauaccaagauugaccugugguccuauaaugccgaacuccuuguagcacuggagaaccaacauacaauagauuugacugacucugaaaugaauaaacuauucgagaagaccaaaaagcagcugagggaaaacgcugaggauaugggcaauggaugcuuuaagaucuaccacaaaugugacaacgccugcauuggcagcauccggaaugggacauaugaucaugacguguaccgagacgaggcucucaacaaucgcuuccagauuaagggagucgaacugaaaucagguuacaaggauuggauccuuuggauaaguuuugccaucuccugcuuccuguuguguguggcacuccugggcuuuauuaugugggccugccagaaagggaacaucagauguaauauuugcaucuga

SEQ ID NO: 123933 - RNA, 1698 nt, Artificial Sequence
  derived and/or modified sequence opt3 from hemagglutinin__InfluenzaA__ABV29733
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacggggaaucaaguuuuuaccggaauuuacuguggcuuacgggaaagaacggcuuguaucccaaucugagcaaaucuuacgcaaacaauaaggagaaagaaguucuaguacucuggggcgugcaucacccuccaaacaucggggaucagcgcgcccuguaccacacugagaacgcuuaugucuccguggugucaagccauuacagucgacguuucacccccgaaauagcaaagagaccuaaagucagggaccaggagggacggaucaauuauuacuggacacuucuggagccaggugauacuauuaucuuugaagccaacggcaauuugauugcuccgcgcuucgccuuugcgcucucuagaggguucggauccggcaucauaaccagcaacgcacccauggacaagugugaugccaagugccagacaccucaaggugcuauuaauucgucucugccauuucagaacguucaccccgugaccaucggggaguguccuaaauauguaagguccacgaaguuacggauggugacuggacugcgcaauauuccaucaauccagagucgaggccucuucggcgccaucgcaggguuuauugaaggagguuggacaggcauggucgacgggugguacggauaucaucaccagaacgagcaaggcagcgguuacgcugccgaucagaaauccacccagaaugcgauaaacgggaucacuaauaaggugaacucuguuauugaaaagaugaauacacaguucaccgccgugggcaaagaguucaacaaacuugagagaaggauggaaaaucugaacaagaaggucgacgauggauuuuuggacaucuggacguacaacgcagagcuacuggugcuccuggaaaaugagcggacccuugacuuccacgauagcaacguuaaaaaucuguaugaaaagguaaaaucacaauugaagaacaaugcuaaagagauaggcaacgggugcuuugaguucuaccauaagugugacgaugaaugcauggagagugugaagaauggaacauaugacuaccccaaauauuccgaagagagcaagcucaaccgugagaaaauugauggugucaagcuggaaucuaugggcguguaccagaucuuagccaucuauucaacugucgcuaguagccuggugcuacucguuucccugggggccauuucuuuuuggaugugcucgaauggaagccuucagugucgcaucugcauuuga

SEQ ID NO: 123934 - RNA, 1698 nt, Artificial Sequence; identical to SEQ ID NO: 123926
  derived and/or modified sequence opt3 from hemagglutinin__InfluenzaA__ABV29744

SEQ ID NO: 123935 - RNA, 1698 nt, Artificial Sequence
  derived and/or modified sequence opt3 from hemagglutinin__InfluenzaA__ABV29755
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaucuccggagaauggaacuuguuaucccggcuacuuugcugacuaugaggaacugagagagcaacucucgucagugagcaguuucgaaagguuugagauuuucccuaaggaguccucuuggccaaaccauacagucaccggugugagcgccuccugcucacacaaugggaagaguagcuuuuaccggaacuuacuguggcuuacgggaaagaauggcuuguaucccaaccugucuaaguccuacgcaaauaacaaagaaaaggagguucuaguacucuggggcgugcaucacccuccaaauaucggggaucagcgcgcccuguaccacacugaaaacgcuuaugucucaguggugagcagucauuacucucgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucuccagaggguucggaagcggcaucauaaccucgaaugcacccauggguaagugugacgccaaaugccagacaccucaaggggcuauuaacucuucccugccauuucagaauguucaccccgugaccaucggagaauguccuaaguauguaaggucagccaaauuacggauggugacgggccugcgcaacauuccaaguauccagagccgaggccucuucggggcaaucgcuggauuuauugaggguggcuggacugggauggucgauggaugguacggcuaucaucaccagaaugaacaagguuccggguacgccgcggaccagaagucuacacagaacgccauaaauggcaucaccaacaaagugaauagcguuauugagaagaugaacacucaguucacagcagugggaaaagaguucaauaaacuugaaagaaggauggagaaccugaauaagaaagucgaugacggcuuuuuggauaucuggaccuacaacgcugaacuacuggugcuccuggagaacgaacggacgcuugacuuccacgacucaaauguaaagaaccuguaugagaaaguuaagagucaauugaaaaauaacgccaaggaaauagggaauggaugcuuugaguucuaccauaaguguaacgaugagugcauggaauccgugaaaaaugguaccuaugacuaccccaaguauagcgaggaaucuaaacucaaccgugagaagauugauggcgucaaacuggagucaauggggguguaccagaucuuagcuaucuauaguacagucgccagcucccuggugcuacucguuucucugggagcaauuucguuuuggaugugcagcaauggcucccuucagugucgcaucugcauuuga

SEQ ID NO: 123936 - RNA, 1698 nt, Artificial Sequence; identical to SEQ ID NO: 123926
  derived and/or modified sequence opt3 from hemagglutinin__InfluenzaA__ABV29766

SEQ ID NO: 123937 - RNA, 1698 nt, Artificial Sequence
  derived and/or modified sequence opt3 from hemagglutinin__InfluenzaA__ABV29777
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacggggaaucaaguuuuuaccggaauuuacuguggcuuacgggaaagaacggcuuguaucccaaucugagcaaaucuuacgcaaacaauaaggagaaagaaguucuaguacucuggggcgugcaucacccuccaaacaucggggaucagcgcgcccuguaccacacugagaacgcuuaugucuccguggugucaagccauuacagucgacguuucacccccgaaauagcaaagagaccuaaagucagggaccaggagggacggaucaauuauuacuggacacuucuggagccaggugauacuauuaucuuugaagccaacggcaauuugauugcuccgcgcuucgccuuugcgcucucuagaggguucggauccggcaucauaaccagcaacgcacccauggacaagugugaugccaagugccagacaccucaaggugcuauuaauucgucucugccauuucagaacguucaccccgugaccaucggggaguguccuaaauauguaagguccacgaaguuacggauggugacuggacugcgcaauauuccaucaauccagagucgaggccucuucggcgccaucgcaggguuuauugaaggagguuggacaggcauggucgacgggugguacggauaucaucaccagaacgagcaaggcagcgguuacgcugccgaucagaaauccacccagaaugcgauaaacgggaucacuaauaaggugaacucuguuauugaaaagaugaauacacaguucaccgccgugggcaaagaguucaacaaacuugagagaaggauggaaaaucugaacaagaaggucgacgauggauuuuuggacaucuggacguacaacgcagagcuacuggugcuccuggaaaaugagcggacccuugacuuccacgauagcaacguuaaaaaucuguaugaaaagguaaaaucacaauugaagaacaaugcuaaagagauaggcaacgggugcuuugaguucuaccauaaguguaaugacgaaugcauggagagugugaagaacggaacauaugauuaccccaaauauuccgaagagagcaagcucaaucgugagaaaauugacggugucaagcuggaaucuaugggcguguaccagaucuuagccaucuauucaacugucgcuaguagccuggugcuacucguuucccugggggccauuucuuuuuggaugugcucgaacggaagccuucagugucgcaucugcauuuga

SEQ ID NO: 123938 - RNA, 1698 nt, Artificial Sequence; identical to SEQ ID NO: 123926
  derived and/or modified sequence opt3 from hemagglutinin__InfluenzaA__ABV29788

SEQ ID NO: 123939 - RNA, 1698 nt, Artificial Sequence; identical to SEQ ID NO: 123930
  derived and/or modified sequence opt3 from hemagglutinin__InfluenzaA__ABV29799

SEQ ID NO: 123940 - RNA, 1701 nt, Artificial Sequence
  derived and/or modified sequence opt3 from hemagglutinin__InfluenzaA__ABV29821
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagguguuuuuguaugcccaggcuagcggccguaucacuguaucuaccaagagaucccaacagacaguuauuccaaacaucgggucaaggccccgggugcgcaauauaccuagcagaauuaguaucuacuggaccauugucaagccaggagauauccugcuaaucaacucuacggguaaucucauugccccgaggggcuacuucaaaauacgguccggaaagagcucgaucaugcgcucugacgcgcccauugggaaguguaacuccgaaugcaucacuccuaauggcucaauaccaaacgacaaacccuuucagaaugugaaccgaauuacauauggugcauguccuagauacgugaagcagaauacccugaaacuugccacugggaugaggaacgucccagagaagcaaacacggggaaucuucggcgcuaucgccggcuuuauugaaaaugggugggagggaaugguugaugguugguauggcuuccgucaccagaacagugaggggaucggacaggcagcugaccugaaaagcacccaagccgcgauugaucagauaaauggcaaguugaaccgccucaucgguaaaacgaacgaaaaguuccaccagauugagaaggaauuuuccgagguggaagggagaauccaggaccuggagaaauacguagaggauaccaagaucgacuuauggucuuauaaugccgaacugcucguggcacuugagaaccaacauacaauugaucugacugacagcgaaaugaauaaauuguucgagaagaccaaaaagcagcuaagggaaaacgcugaggauaugggcaauggaugcuuuaagauauaccacaaaugugacaacgccugcaucggcucaauucggaaugggacauaugaucaugacgucuaccgagacgaggcucugaacaaucgcuuccagaucaagggaguggaacucaaaagugguuacaaggauuggauucuguggaucuccuuugccauaagcugcuuccuucuguguguugcauugcucggcuuuaucaugugggccugccagaaagggaacauuaaguguaauaucugcauuuga

SEQ ID NO: 123941 - RNA, 1698 nt, Artificial Sequence; identical to SEQ ID NO: 123930
  derived and/or modified sequence opt3 from hemagglutinin__InfluenzaA__ABV29832

SEQ ID NO: 123942 - RNA, 1698 nt, Artificial Sequence; identical to SEQ ID NO: 123926
  derived and/or modified sequence opt3 from hemagglutinin__InfluenzaA__ABV29865

SEQ ID NO: 123943 - RNA, 1698 nt, Artificial Sequence; identical to SEQ ID NO: 123926
  derived and/or modified sequence opt3 from hemagglutinin__InfluenzaA__ABV29876

SEQ ID NO: 123944 - RNA, 1701 nt, Artificial Sequence
  derived and/or modified sequence opt3 from hemagglutinin__InfluenzaA__ABV29898
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacagcgaaaugaauaaauuguucgagaagaccaaaaagcagcuaagggaaaacgcugaggauaugggcaauggaugcuuuaagaucuaccacaaaugugacaacgccugcauuggcucaauccggaaugggacauaugaucaugacguguaccgagacgaggcucugaacaaucgcuuccagauuaagggagucgaacucaaaagugguuacaaggauuggauccuguggauauccuuugccaucagcugcuuccuucuguguguggcauugcucggcuuuauuaugugggccugccagaaagggaacaucagauguaauauuugcaucuga

SEQ ID NO: 123945 - RNA, 1701 nt, Artificial Sequence
  derived and/or modified sequence opt3 from hemagglutinin__InfluenzaA__ABV29909
augaagaccaucauugcccugagcuacauacucugccuuguguucgcucagaaacugcccggcaacgacaauuccacagcaacuuuguguuuagggcaccaugccgucccuaacggaacgaucguuaagaccauuacaucugaucaaaucgaggugacuaaugcgaccgaacugguacagaacucaaguauugguggcaucugcaauagcccacaccagauacuagacggggagaacuguacacucaucgaugcucugcuuggagacccgcagugcgauggcuuucaaaauaaaaagugggaccuguucguggaaagauccaaagccuauucuaacuguuaccccuaugaugucccugacuacgcaucguugaggucacucauugccagcagugguacccuggaguuuaauaacgaauccuucaauuggacuggggugacacagaacggaaccucuagcgcuugcaagcggcgcuccaauaacucauuuuucagucgacugaauuggcucacgcauuuaaaguuuaaauauccagcacugaacguuacuaugcccaacaaugaggaguucgauaaacuuuacaucuggggcgugcaccauccuggcaccgacaacgaucagauuagcuuguaugcccaggcuccagggcguaucacagucucuacuaagagaucccaacagaccgugauacccaauauuggaucaaggccucggguacgcgacaucccaagcagaauuaguaucuacuggacaaucguuaagccgggugauauucugcuaauaaacucuaccggcaaucucaucgcccccaggggguacuuuaaaauucgguccggaaagagcucgaucaugcgcucugacgcgccuauagacaaguguaacuccgaaugcauuacgccaaauggcucaauccccaacgauaaaccuuuccagaaugugaaccgaaucacuuauggugcauguccaagauacgucaagcagaauacacugaaacuugccaccgggaugaggaacgugcccgagaagcaaacucggggaauuuuuggcgcuaucgccggcuucauugaaaaugggugggagggaaugguggacgguugguauggcuuucgucaccagaacagugaggggauaggacaggcagcugaucugaaaagcacacaagccgcgaucgaccagauuaauggcaaguugaaccgccucaucgguaaaaccaacgaaaaguuccaccagaucgagaaggaguucuccgaagucgaagggaggauucaggaucuggagaaauacguugaggacacgaagauagauuuauggucuuauaaugccgaacugcucguggcacuugagaaccaacauaccaucgaccugacagauagcgaaaugaauaaauuguuugagagaacuaagaaacagcuacgggaaaacgcugaggacaugggcaauggaugcuucaagauuuaccacaagugugauaacgccugcaucggcucaauucgaaaugggaccuaugaccaugacguauaccgcgaugaggcucugaacaauagauuucagaucaaaggaguggaacucaagagugguuacaaagacuggauacuguggaucuccuucgccauuagcugcuuucuucugugugucgcauugcucggcuucaucaugugggccugccagaaggggaacauuagguguaauaucugcauauga

SEQ ID NO: 123946 - RNA, 1698 nt, Artificial Sequence
  derived and/or modified sequence opt3 from hemagglutinin__InfluenzaA__ABV29920
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccaugggugaaugugacgccaagugccagacaccucaaggggcuauuaauucgucucugccauuucagaacguucaccccgugaccaucggagaguguccuaaauauguaagguccgccaaguuacggauggugacgggccugcgcaauauuccaucaauccagagucgaggccucuucggggcaaucgcuggauuuauugaagguggcuggacugggauggucgauggaugguacggcuaucaucaccagaacgagcaagguagcggguacgccgcggaccagaaauccacacagaaugccauaaacggcaucaccaauaaggugaacucuguuauugaaaagaugaauacucaguucacagcagugggaaaagaguucaacaaacuugagagaaggauggaaaaucugaacaagaaggucgaugacggcuuuuuggauaucuggaccuacaacgcugagcuacuggugcuccuggaaaaugagcggacgcuugacuuccacgacagcaacguuaaaaaucuguaugaaaagguaaaaucacaauugaagaacaaugccaaagagauagggaacggaugcuuugaguucuaccauaaguguaaugaugaaugcauggagagugugaagaacgguaccuaugacuaccccaaauauuccgaagagagcaagcucaaucgugagaaaauugauggcgucaagcuggaaucuauggggguguaccagaucuuagcuaucuauucaacagucgccaguagccuggugcuacucguuucccugggagcaauuucuuuuuggaugugcucgaacggcagccuucagugucgcaucugcauuuga

SEQ ID NO: 123947 - RNA, 1698 nt, Artificial Sequence; identical to SEQ ID NO: 123937
  derived and/or modified sequence opt3 from hemagglutinin__InfluenzaA__ABV29942

SEQ ID NO: 123948 - RNA, 1698 nt, Artificial Sequence; identical to SEQ ID NO: 123930
  derived and/or modified sequence opt3 from hemagglutinin__InfluenzaA__ABV29953

SEQ ID NO: 123949 - RNA, 1698 nt, Artificial Sequence; identical to SEQ ID NO: 123930
  derived and/or modified sequence opt3 from hemagglutinin__InfluenzaA__ABV29964

SEQ ID NO: 123950 - RNA, 1698 nt, Artificial Sequence; identical to SEQ ID NO: 123926
  derived and/or modified sequence opt3 from hemagglutinin__InfluenzaA__ABV29986

SEQ ID NO: 123951 - RNA, 1698 nt, Artificial Sequence; identical to SEQ ID NO: 123930
  derived and/or modified sequence opt3 from hemagglutinin__InfluenzaA__ABV29997

SEQ ID NO: 123952 - RNA, 1698 nt, Artificial Sequence; identical to SEQ ID NO: 123926
  derived and/or modified sequence opt3 from hemagglutinin__InfluenzaA__ABV30008

SEQ ID NO: 123953 - RNA, 1698 nt, Artificial Sequence; identical to SEQ ID NO: 123930
  derived and/or modified sequence opt3 from hemagglutinin__InfluenzaA__ABV30019

SEQ ID NO: 123954 - RNA, 1698 nt, Artificial Sequence; identical to SEQ ID NO: 123930
  derived and/or modified sequence opt3 from hemagglutinin__InfluenzaA__ABV30030

SEQ ID NO: 123955 - RNA, 1698 nt, Artificial Sequence
  derived and/or modified sequence opt3 from hemagglutinin__InfluenzaA__ABV30041
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaaccgcgccccuucagcuggguaauuguucaguggccggcuggauauuggggaacccugagugcgaacuccugaucaguaaagagagcugguccuacauuguugaaacuccaaauccggagaacggaacauguuaucccggcuacuuugcugacuaugaggaacugagagagcaacucucuucggugagcucauucgaaagguuugagaucuucccuaaggagaguuccuggccaaaucauaccgucacgggugugucugccagcugcucccacaacgggaagucaaguuuuuaccggaauuuacuguggcuuacuggcaaaaacggauuguaucccaaucugagcaagucuuacgcaaacaauaaagaaaaggagguucuaguacucuggggcgugcaucacccuccaaacauuggggaucagcgcgcccuguaccacaccgaaaacgcuuaugucuccguggugucaagccauuacagucgacguuucacacccgagaucgcaaaaagaccuaaggucagggaccaggaaggacggauaaauuauuacuggacucuucuggagccaggugauaccaucauuuuugaggccaacggcaauuugaucgcuccgcgcuucgccuuugcgcucucuagaggguucggauccggcauuaucacaagcaacgcacccaugggugaaugugacgccaagugccagaccccucaaggggcuauaaauucgucucugccauuucagaacguucaccccgugacgauuggagaguguccuaaauauguaagguccgccaaguuacggauggugacuggccugcgcaauaucccaucaauucagagucgaggccucuucggggcaaucgcuggauuuaucgaagguggcuggacagggauggucgauggaugguacggcuaucaucaccagaacgagcaagguagcggguacgccgcggaccagaaauccacccagaaugccauuaacggcauaacuaauaaggugaacucuguuaucgaaaagaugaauacacaguucaccgcagugggaaaagaguucaacaaacuugagagaaggauggaaaaucugaacaagaaggucgaugacggcuuuuuggauauuuggacguacaacgcugagcuacuggugcuccuggaaaaugagcggacccuugacuuccacgacagcaacguaaagaaucuguaugaaaaaguuaaaaaccaauugaagaauaacgccaaagagaucgggaauggaugcuuugaguucuaccauaaguguaacgaugaaugcauggagucagugaagaaugguacauaugacuaccccaaauauagugaagaguccaagcucaaccgugagaaaauagauggcgucaagcuggaaagcauggggguguaccagauuuuagcuaucuauucuacugucgccucaagucuggugcuacucaucagccugggagcaauuuccuuuuggaugugcucuaauggcucgcuucagugucgcaucugcauuuga

SEQ ID NO: 123956 - RNA, 1701 nt, Artificial Sequence; identical to SEQ ID NO: 123944
  derived and/or modified sequence opt3 from hemagglutinin__InfluenzaA__ABV30063

SEQ ID NO: 123957 - RNA, 1701 nt, Artificial Sequence; identical to SEQ ID NO: 123944
  derived and/or modified sequence opt3 from hemagglutinin__InfluenzaA__ABV30074

SEQ ID NO: 123958 - RNA, 1698 nt, Artificial Sequence; identical to SEQ ID NO: 123930
  derived and/or modified sequence opt3 from hemagglutinin__InfluenzaA__ABV30085

SEQ ID NO: 123959 - RNA, 1698 nt, Artificial Sequence; identical to SEQ ID NO: 123930
  derived and/or modified sequence opt3 from hemagglutinin__InfluenzaA__ABV30096

SEQ ID NO: 123960 - RNA, 1698 nt, Artificial Sequence; identical to SEQ ID NO: 123926
  derived and/or modified sequence opt3 from hemagglutinin__InfluenzaA__ABV30107

SEQ ID NO: 123961 - RNA, 1698 nt, Artificial Sequence
  derived and/or modified sequence opt3 from hemagglutinin__InfluenzaA__ABV30129
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcaauuuugcugacuacgaggaacugagagagcaacucucuucggugagcucauucgaaagguuugagauuuucccuaaggagaguuccuggccaaaccauacagucaccggugugucugccagcugcucccacaaugggaagucaaguuuuuaucggaacuuacuguggcuuacgggcaaaaauggauuguaccccaaccugagcaagucuuaugcaaauaacaaagaaaaggaggugcuaguucucuggggcgugcaucacccuccaaacaucggggaucagcgcgcccuguaccacacugaaaaugcuuacgucuccguggugucaagccauuauagucgacguuucacccccgagauagcaaaaagaccuaaggucagggaccaggaaggacggaucaacuacuauuggacacuucuggagccaggugauacuauuaucuuugaggccaauggcaacuugauugcuccgcgcuucgccuuugcgcucucuagaggguucggauccggcaucauaaccagcaaugcacccauggacgaaugugaugccaagugccagacaccucaaggugcuauuaacucgucucugccauuucagaauguucaccccgugaccaucggggaguguccuaaauacguaagguccgccaaguuacggauggugacgggacugcgcaacauuccaucaauccagagucgaggccucuucggcgcaaucgcuggguuuauugaaggagguuggacuggcauggucgacgggugguauggauaccaucaccagaaugagcaaggcagcgguuaugccgcggaucagaaauccacacagaacgccauaaaugggaucaccaacaagguaaauucuguuauugaaaagaugaacacucaguucacagcagugggcaaagaguucaauaaacuugagagaaggauggaaaaccugaacaagaaggucgacgauggauuuuuggacaucuggaccuacaaugcugagcuacuggugcuccuggaaaacgagcggacgcuugacuuccacgauagcaauguuaaaaaccuguacgaaaagguaaaaucacaauugaagaauaacgccaaagagauaggcaaugggugcuuugaguucuaucauaaguguaacgacgaaugcauggagagugugaagaauggaaccuacgauuaucccaaauacuccgaagagagcaagcucaaccgugagaaaauugacggugucaagcuggaaucuaugggcguguaucagaucuuagcuaucuacucaacagucgccaguagccuggugcuacucguuucccugggggcaauuucuuuuuggaugugcucgaauggaagccuucagugucgcaucugcauuuga

SEQ ID NO: 123962 - RNA, 1698 nt, Artificial Sequence
  derived and/or modified sequence opt3 from hemagglutinin__InfluenzaA__ABV30140
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuuaaacuggguaauuguucuguggccggcuggaucuuggggaacccugagugcgaacuccugauuucaaaggagaguuggagcuacaucguugaaaccccaaauccggagaacggaacuuguuaucccggcuacuuugcugacuaugaggaacugagggagcagcucuccucugugucgucauucgaacgguuugagauuuucccuaaggagagcaguuggccaaaucauacagucaccgguguguccgccucuugcagccacaacgggaaauccucauuuuaccgcaauuuacuguggcuuacgggaaagaacggcuuguaucccaaucugagucgaagcuacgcaaacaauaaagaaaaggagguucuaguacucuggggcgugcaucacccuccaaacaucggggaucaacgugcccuguaccacacugaaaacgcuuaugucucugugguguccucacauuacagcagaagguucacccccgagauagcaaaacggccuaagguccgcgaccaggaaggaagaaucaauuauuacuggacacuucuggagccaggugauacuauuaucuuugaggccaacggcaauuugauugcuccgagguucgccuuugcgcucagucggggguucggaucuggcaucauaaccuccaacgcacccauggacgaaugugaugccaagugccagacaccucagggugcuauuaauagcucgcugccauuucaaaacguucaccccgugaccaucggggaguguccuaaauauguacgcucugccaaguuacgaauggugacgggacugagaaauauuccauccauccagucaaggggccucuucggcgcaaucgcuggguuuauugaaggagguuggacuggcauggucgacgggugguacggauaucaucaccagaacgagcagggcagugguuacgccgcggaucagaaaagcacacaaaaugccauaaacgggaucaccaauaaggugaacuccguuauugaaaagaugaauacucaguucacagcagugggcaaagaguucaacaaacuugagcggcguauggaaaaucugaacaagaaggucgacgauggauuuuuggacaucuggaccuacaacgcugagcuacuggugcuccuggaaaaugagcgcacgcuugacuuccacgauucuaacguuaaaaaucuguaugaaaagguaaaaagccaguugaagaacaaugccaaagagauaggcaacgggugcuuugaguucuaccauaaguguaaugacgaaugcauggagucagugaagaacggaaccuaugauuaccccaaauauagugaagaguccaagcucaauagagagaaaauugacggugucaagcuggaaagcaugggcguguaccaaaucuuagcuaucuauucuacagucgccucaagucuggugcuacucguuagccugggggcaauuuccuuuuggaugugcucuaacggaucgcuucaguguaggaucugcauuuga

SEQ ID NO: 123963 - RNA, 1698 nt, Artificial Sequence
  derived and/or modified sequence opt3 from hemagglutinin__InfluenzaA__ABV30151
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacucagggaagaguagcuuuuaccggaacuuacuguggcuuacgggcaaaaauggauuguaucccaaccugucuaaguccuacgcaaauaacaaagaaaaggagguucuaguacucuggggcgugcaucacccuccaaauaucggggaucagcgcgcccuguaccacacugaaaacgcuuaugucucaguggugagcagucauuacucucgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucuccagaggguucggaagcggcaucauaaccucgaaugcacccaugggugaaugugacgccaagugccagacaccucaaggggcuauuaacucuucccugccauuucagaauguucaccccgugaccaucggagaguguccuaaauauguaaggucagccaaguuacggauggugacgggccugcgcaacauuccaaguauccagagccgaggccucuucggggcaaucgcuggauuuauugaagguggcuggacugggauggucgauggaugguacggcuaucaucaccagaaugagcaagguuccggguacgccgcggaccagaaaucuacacagaacgccauaaauggcaucaccaacaaggugaauagcguuauugaaaagaugaacacucaguucacagcagugggaaaagaguucaauaaacuugagagaaggauggaaaaccugaauaagaaggucgaugacggcuuuuuggauaucuggaccuacaacgcugagcuacuggugcuccuggaaaacgagcggacgcuugacuuccacgacucaaauguuaaaaaccuguaugaaaagguaaaaagucaauugaagaauaacgccaaagagauagggaauggaugcuuugaguucuaccauaaguguaacgaugaaugcauggaguccgugaagaaugguaccuaugacuaccccaaauauagcgaagagucuaagcucaaccgugagaaaauugauggcgucaagcuggaaucaauggggguguaccagaucuuagcuaucuauaguacagucgccagcucccuggugcuacucguuucucugggagcaauuucguuuuggaugugcagcaauggcucccuucagugucgcaucugcauuuga

SEQ ID NO: 123964 - RNA, 1698 nt, Artificial Sequence
  derived and/or modified sequence opt3 from hemagglutinin__InfluenzaA__ABV30162
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaccccaaauccggagaacggaacuuguuaucccggcuacuuugcugacuaugaggaacugagggagcaacucucuucggugagcucauucgaacgguuugagauuuucccuaaagagaguuccuggccaaaucauacagucaccggugugucugccagcugcucccacaacgggaagucaaguuuuuaccgcaauuuacuguggcuuacgggaaagaacggcuuguaucccaaucugagcaaaucuuacgcaaacaauaaggaaaaagagguacuuguucucuggggcgugcaucacccuccaaacaucggggaucagcgagcccuguaccacacugaaaacgcuuaugucuccguggugucaagccauuacagucguagauucacccccgagauagcaaagaggccuaaaguccgggaccaggaaggacgcaucaauuauuacuggacacuucuggagccaggugauacuauuaucuuugaggccaacggcaauuugauugcuccgagauucgccuuugcgcucucuaggggguucggauccggcaucauaaccagcaacgcacccauggacgaaugugaugccaagugccagacaccucaaggugcuauuaauucgucucugccauuucagaacguucaccccgugaccaucggggaguguccuaaguauguacgguccacgaaauuacgcauggugacuggacugcgaaauauuccaucaauccagaguagaggccucuucggcgccaucgcaggguuuauugaaggagguuggacaggcauggucgacgggugguacggauaucaucaccagaacgagcaaggcagcgguuacgcugccgaucagaaguccacccagaaugcgauaaacgggaucacuaauaaagugaacucuguuauugaaaagaugaauacacaguucaccgccgugggcaaagaguucaacaagcuagagaggcggauggaaaaucugaacaaaaaggucgacgauggauuuuuggacaucuggacguacaacgcagagcuacuggugcuccuggaaaaugagcguacccuugacuuccacgauagcaacguaaagaaucuguaugaaaaaguuaagucacaauugaaaaacaaugcuaaggagauaggcaacgggugcuuugaguucuaccauaaauguaaugacgaaugcauggagagugugaagaacggaacauaugauuaccccaaguauuccgaagagagcaaacucaaucgcgagaagauugacggugucaaacuggaaucuaugggcguguaccagaucuuagccaucuauucaacugucgcuaguagccuggugcuacucguuucccugggggccauuucuuuuuggaugugcucgaacggaagccuucaguguagaaucugcauuuga

SEQ ID NO: 123965 - RNA, 1698 nt, Artificial Sequence; identical to SEQ ID NO: 123930
  derived and/or modified sequence opt3 from hemagglutinin__InfluenzaA__ABV30173

SEQ ID NO: 123966 - RNA, 1698 nt, Artificial Sequence; identical to SEQ ID NO: 123930
  derived and/or modified sequence opt3 from hemagglutinin__InfluenzaA__ABV30184

SEQ ID NO: 123967 - RNA, 1701 nt, Artificial Sequence; identical to SEQ ID NO: 123944
  derived and/or modified sequence opt3 from hemagglutinin__InfluenzaA__ABV30217

SEQ ID NO: 123968 - RNA, 1701 nt, Artificial Sequence; identical to SEQ ID NO: 123944
  derived and/or modified sequence opt3 from hemagglutinin__InfluenzaA__ABV30228

SEQ ID NO: 123969 - RNA, 1701 nt, Artificial Sequence
  derived and/or modified sequence opt3 from hemagglutinin__InfluenzaA__ABV30261
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaguggagguaacuaaugcgaccgaacuggugcagucuucaaguacagguggcauuugcgacagcccacaccagauccuagauggggagaacuguacccucauagacgcucugcuuggagauccgcagugcgacggcuuucaaaauaaaaagugggaucuguucgucgaaagauccaaagccuauucuaacuguuaccccuaugacgugccugauuacgcaucguugaggucacucguugccagcagugguacucuggaguuuaauaacgaauccuucaauugggcuggggugacacagaacggaaccucuagcgcaugcaagcggggcuccaauaacucauuuuucagucgccugaauuggcucacgcauagcaaguuuaaauauccagccuuaaacgucacuaugcccaauaacgaggaguucgacaagcuguacaucuggggcgugcaccauccugggaccgauaacgaccagauuuuucuuuaugcucaggccucuggacgaaucacaguauccacuaaacguucacaacagaccguuauuccaaauaucgguagcagacccagggugcggaacauaccuagucgcauuucuaucuacuggacaauugucaagccaggcgauaucuugcugaucaauuccaccgggaaccuaauugcgccgagaggauacuucaaaauaaggagcggcaagucgucuaucaugcgguccgacgcacccauugguaaguguaauucagaaugcaucacgccuaacgggaguauaccaaaugacaaacccuuucagaacgugaaucgcauuacuuauggagccuguccucgauacgugaagcagaacacacucaaacuggcuaccggcaugagaaaugucccagagaagcaaacuaggggcaucuucggggccaucgcaggauuuauugaaaacgguugggagggcaugguugaugggugguauggauuccggcaccagaauagcgagggcaugggucaggcugccgaccuuaaauccacacaagcggccaucgaucagauuaacgggaagcugaaucguuugauaggcaaaaccaacgaaaaguuccaccagaucgagaaggaauuuucugagguggaaggacgcauucaggaccucgagaaauacguagaggauacgaagaucgaccuguggagcuauaacgcagaauuacugguggcucucgagaaucaacauaccaucgaucuuacagacucagaaaugaacaaacuguucgagaagacuaaaaagcaguugagagaaaaugccgaggauaugggcaacgggugcuuuaagauuuaccacaaaugugacaaugcuugcauaggaaguaucaggaacgguaccuaugaucaugacgucuaccgggccgaggcacuaaauaaccgauuccagauuaagggcguggaacugaaauccggguacaaggacuggauccucuggauuagcuuugccaucucuugcuuccugcuuuguguugcucuguugggauuuauaaugugggcgugccagaaaggcaauauccgcuguaacauuugcaucuga

SEQ ID NO: 123970 - RNA, 1701 nt, Artificial Sequence
  derived and/or modified sequence opt3 from hemagglutinin__InfluenzaA__ABV30272
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucaguaagcugaacuggcucacucauuuaaaguuuaaauauccagcacugaaugugaccaugcccaacaacgagaaguucgacaaacuuuacauuuggggaguccaccauccuggcacagauaaugaccagaucuuuuuguaugcccaggcuagcggccgaauuacugugucuaccaagcguucccaacagacaguaaucccaaacauagggucaagacccaggguucggaauauuccuagccgcaucaguauuuacuggaccaucgugaaaccaggagauauccugcuaauuaacucuacggguaaucucauagccccgagaggcuacuucaagaucagguccggaaagagcucgauuaugcggucugacgcgcccaucgggaaauguaacuccgaaugcauaacuccuaauggcucaauuccaaacgacaagcccuuucagaaugucaaccgcaucacauauggugcauguccucgauacgugaaacagaauacccugaagcuggccacugggaugagaaacgugccagagaaacaaacaaggggaaucuucggcgcuauugccggcuuuaucgaaaaugggugggagggaauggucgaugguugguauggcuuccggcaccagaacagugaggggauuggacaggcagcugaccuuaagagcacccaagccgcgauagaucagaucaauggcaaauugaaccgucucauugguaagacgaacgaaaaguuccaccagaucgagaaagaauuuuccgagguugaagggcgcauccaggaccuggagaaguacguggaggauaccaaaauugacuuauggucuuauaaugccgaacugcucguagcacuugagaaccaacauacaauagaucugacugacagcgaaaugaauaaguuguucgagaaaaccaagaagcagcuaagagaaaacgcugaggauaugggcaauggaugcuuuaaaaucuaccacaagugugacaacgccugcauuggcucaaucaggaaugggacauaugaucaugacguguaccgggacgaggcucugaacaaucgauuccagauuaaaggagucgaacucaagagugguuacaaagauuggauccuguggauauccuuugccaucagcugcuuccuucuguguguggcauugcucggcuuuauuaugugggccugccagaaggggaacauccgcuguaauauuugcaucuga

SEQ ID NO: 123971 - RNA, 1698 nt, Artificial Sequence
  derived and/or modified sequence opt3 from hemagglutinin__InfluenzaA__ABV30283
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcaauuuugcugacuacgaggaacugagagagcaacucucuucggugagcucauucgaaagguuugagauuuucccuaaggagaguuccuggccaaaccauacagucaccggugugucugccagcugcucccacaaugggaagucaaguuuuuaucggaacuuacuguggcuuacgggcaaaaauggauuguaccccaaccugagcaagucuuaugcaaauaacaaagaaaaggagguucuaguacucuggggcgugcaucacccuccaaacaucggggaucagcgcgcccuguaccacacugaaaaugcuuacgucuccguggugucaagccauuauagucgacguuucacccccgagauagcaaaaagaccuaaggucagggaccaggaaggacggaucaacuacuauuggacacuucuggagccaggugauacuauuaucuuugaggccaauggcaacuugauugcuccgcgcuucgccuuugcgcucucuagaggguucggauccggcaucauaaccagcaaugcacccauggacgaaugugaugccaagugccagacaccucaaggugcuauuaacucgucucugccauuucagaauguucaccccgugaccaucggggaguguccuaaauacguaagguccgccaaguuacggauggugacgggacugcgcaacauuccaucaauccagagucgaggccucuucggcgcaaucgcuggguuuauugaaggagguuggacuggcauggucgacgggugguauggauaccaucaccagaaugagcaaggcagcgguuaugccgcggaucagaaauccacacagaacgccauagacgggaucaccaauaaggugaacucuguuauugaaaagaugaauacucaguucacagcagugggcaaagaguucaacaaacuugagagaaggauggaaaaucugaacaagaaggucgaugacggauuuuuggacaucuggaccuacaacgcugagcuacuggugcuccuggaaaaugagcggacgcuugauuuccacgacagcaacguuaaaaaucuguacgaaaagguaaaaucacaauugaagaacaaugccaaagagauaggcaacgggugcuuugaguucuaucauaaguguaaugaugaaugcauggagagugugaagaacggaaccuacgacuaucccaaauacuccgaagagagcaagcucaaucgugagaaaauugauggugucaagcuggaaucuaugggcguguaucagaucuuagcuaucuacucaacagucgccaguagccuggugcuacucguuucccugggggcaauuucuuuuuggaugugcucgaacggaagccuucagugucgcaucugcauuuga

SEQ ID NO: 123972 - RNA, 1698 nt, Artificial Sequence
  derived and/or modified sequence opt3 from hemagglutinin__InfluenzaA__ABV30294
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugauuucaaaagagaguuggagcuacaucguugaaaccccaaauccggagaacggaacuuguuaucccggcuacuuugcugacuaugaggaacugagggagcaacucuccucugugucgucauucgaacgguuugagauuuucccuaaggagagcaguuggccaaaucauacagucaccgguguguccgccucuugcagccacaacgggaaguccucauuuuaccgcaauuuacuguggcuuacgggaaagaacggcuuguaucccaaucugagucgaagcuacgcaaacaauaaggaaaaagagguacuuguucucuggggcgugcaucacccuccaaacaucggggaucagcgugcccuguaccacacugaaaacgcuuaugucucugugguguccucacauuacagcagaagguucacccccgagauagcaaagcggccuaaaguccgcgaccaggaaggaagaaucaauuauuacuggacacuucuggagccaggugauacuauuaucuuugaggccaacggcaauuugauugcuccgagguucgccuuugcgcucagucggggguucggaucuggcaucauaaccuccaacgcacccauggacgaaugugaugccaagugccagacaccucaaggugcuauuaauagcucgcugccauuucagaacguucaccccgugaccaucggggaguguccuaaguauguacgcucugccaaauuacgaauggugacgggacugagaaauauuccauccauccagucaaggggccucuucggcgcaaucgcuggguuuauugaaggagguuggacuggcauggucgacgggugguacggauaucaucaccagaacgagcaaggcagugguuacgccgcggaucagaaaagcacacagaaugccauaaacgggaucaccaauaaagugaacuccguuauugaaaagaugaauacucaguucacagcagugggcaaagaguucaacaagcuagagcggcguauggaaaaucugaacaaaaaggucgacgauggauuuuuggacaucuggaccuacaacgcugagcuacuggugcuccuggaaaaugagcgcacgcuugacuuccacgauucuaacguaaagaaucuguaugaaaaaguuaagagccaauugaaaaacaaugccaaggagauaggcaacgggugcuuugaguucuaccauaaauguaaugacgaaugcauggagucagugaagaacggaaccuaugauuaccccaaguauagugaagaguccaaacucaauagagagaagauugacggugucaaacuggaaagcaugggcguguaccagaucuuagcuaucuauucuacagucgccucaagucuggugcuacucguuagccugggggcaauuuccuuuuggaugugcucuaacggaucgcuucaguguaggaucugcauuuga

SEQ ID NO: 123973 - RNA, 1698 nt, Artificial Sequence
  derived and/or modified sequence opt3 from hemagglutinin__InfluenzaA__ABV30305
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugggucugccagcugcucccacaacggaaagucaaguuuuuaccggaauuuacuguggcuuacgggcaaaaacggcuuguaucccaaucugagcaagucuuacgcaaacaauaaagaaaaggaggugcuaguacucuggggaguucaucacccuccaaacaucggggaucagcgcgcccuguaccacacugaaaacgcuuauguguccgucgugucaagccauuacagucgacguuucacccccgagauagcaaaaagaccuaaggugagggaccaggaaggucggaucaauuauuacuggacacuucuggagccaggcgauacuauuaucuuugaggccaacgggaauuugauugcuccgcgcuucgccuuugcgcucucuagaggauucggcuccgguaucauaaccagcaacgcacccauggacgaaugugaugccaagugccagacaccucaaggggcuauuaauucgucucugccauuucagaacguccaccccguuaccaucggagaguguccuaaauaugugagguccacgaaguuacggaugguaacuggccugcgcaauauuccaucaauccagagucgaggccucuucggggccaucgcaggauuuauugaagguggcuggacagggaugguggacggaugguacggcuaucaucaccagaacgagcaagguagcggguacgcugccgaucagaaauccacccagaaugcgauaaacggcaucacuaauaaggucaacucugugauugaaaagaugaauacacaguucaccgccguuggaaaagaguucaacaaacuugagagaaggauggaaaaucugaacaagaagguggacgauggcuuuuuggacaucuggacguacaacgcagagcuacugguccuccuggaaaaugagcggacccuugacuuccacgauagcaacgugaaaaaucuguaugaaaagguaaaaucacaauugaagaacaaugcuaaagagauagggaacggaugcuuugaguucuaccauaaguguaauaacgaaugcauggagaguguuaagaaugguacauaugacuaccccaaauauuccgaagagagcaagcucaaccgugagaaaauugauggcgugaagcuggaaucuaugggggucuaccagaucuuagccaucuauucaacuguggcuaguagccugguccuacucgugucccugggagccauuucuuuuuggaugugcucgaauggcagccuucagugucgcaucugcauuuga

SEQ ID NO: 123974 - RNA, 1698 nt, Artificial Sequence; identical to SEQ ID NO: 123926
  derived and/or modified sequence opt3 from hemagglutinin__InfluenzaA__ABV30316

SEQ ID NO: 123975 - RNA, 1698 nt, Artificial Sequence; identical to SEQ ID NO: 123972
  derived and/or modified sequence opt3 from hemagglutinin__InfluenzaA__ABV30327

SEQ ID NO: 123976 - RNA, 1698 nt, Artificial Sequence; identical to SEQ ID NO: 123926
  derived and/or modified sequence opt3 from hemagglutinin__InfluenzaA__ABV30338

SEQ ID NO: 123977 - RNA, 1698 nt, Artificial Sequence; identical to SEQ ID NO: 123930
  derived and/or modified sequence opt3 from hemagglutinin__InfluenzaA__ABV30349

SEQ ID NO: 123978 - RNA, 1698 nt, Artificial Sequence
  derived and/or modified sequence opt3 from hemagglutinin__InfluenzaA__ABV30360
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcaauuuugcugacuacgaggaacugagagagcaacucucuucggugagcucauucgaaagguuugagauuuucccuaaggagaguuccuggccaaaccauacagucaccggugugucugccagcugcucccacaaugggaagucaaguuuuuaucggaacuuacuguggcuuacgggcaaaaauggauuguaccccaaccugagcaagucuuaugcaaauaacaaagaaaaggagguucuaguacucuggggcgugcaucacccuccaaacaucggggaucagcgcgcccuguaccacacugaaaaugcuuacgucuccguggugucaagccauuauagucgacguuucacccccgagauagcaaaaagaccuaaggucagggaccaggaaggacggaucaacuacuauuggacacuucuggagccaggugauacuauuaucuuugaggccaauggcaacuugauugcuccgcgcuucgccuuugcgcucucuagaggguucggauccggcaucauaaccagcaaugcacccauggacgaaugugaugccaagugccagacaccucaaggugcuauuaacucgucucugccauuucagaauguucaccccgugaccaucggggaguguccuaaauacguaagguccgccaaguuacggauggugacgggacugcgcaacauuccaucaauccagagucgaggccucuucggcgcaaucgcuggguuuauugaaggagguuggacuggcauggucgacgggugguauggauaccaucaccagaaugagcaaggcagcgguuaugccgcggaucagaaauccacacagaacgccauagacgggaucaccaauaaggugaacucuguuauugaaaagaugaauacucaguucacagcagugggcaaagaguucaacaaacuugagagaaggauggaaaaucugaacaagaaggucgaugacggauuuuuggacaucuggaccuacaacgcugagcuacuggugcuccuggaaaaugagcggacgcuugauuuccacgacagcaacguuaaaaaucuguacgaaaagguaaaaucacaauugaagaacaaugccaaagagauaggcaacgggugcuuugaguucuaucauaaguguaaugaugaaugcauggagagugugaagaacggaaccuacgacuaucccaaauacuccgaagagagcaagcucaaucgugagaaaauugaugguaucaagcuggaaucuaugggcgucuaucagaucuuagcuauuuacucaacaguggccaguagccugguccuacucgugucccugggggcaaucucuuuuuggaugugcucgaacggaagccuucagugucgcauuugcauauga

SEQ ID NO: 123979 - RNA, 1698 nt, Artificial Sequence; identical to SEQ ID NO: 123930
  derived and/or modified sequence opt3 from hemagglutinin__InfluenzaA__ABV30371

SEQ ID NO: 123980 - RNA, 1701 nt, Artificial Sequence; identical to SEQ ID NO: 123745
  derived and/or modified sequence opt3 from hemagglutinin__InfluenzaA__ABV30382

SEQ ID NO: 123981 - RNA, 1701 nt, Artificial Sequence; identical to SEQ ID NO: 122646
  derived and/or modified sequence opt3 from hemagglutinin__InfluenzaA__ABV30393

SEQ ID NO: 123982 - RNA, 1701 nt, Artificial Sequence
  derived and/or modified sequence opt3 from hemagglutinin__InfluenzaA__ABV30404
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaaguguuaccccuaugacgucccugauuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaaguuuaaauauccagcacugaacgugaccaugcccaauaacgagaaguucgacaaacuuuacauuuggggaguccaccauccuggcacagauaacgaccagaucuuuuuguaugcccaggcuagcggccguauuacugugucuaccaagagaucccaacagacaguaaucccaaauauagggucaaggccccggguucgcaacauuccuagcagaaucaguauuuacuggaccaucgugaaaccaggagauauccugcuaauuaauucuacggguaaccucauagccccgaggggcuacuucaagauccgguccgggaaaagcucgauuaugcgcucugacgcgcccaucggaaaauguaauuccgaaugcauaacuccuaacggcucaauuccaaaugacaagcccuuucagaacgucaaucgaaucacauauggugcauguccuagauacgugaaacagaacacccugaagcuggccacugggaugaggaaugugccagagaaacaaacacggggaaucuucggcgcuauugccggcuuuaucgaaaacgggugggagggaauggucgaugguugguauggcuuccgucaccagaauagugaggggauuggacaggcagcugaccuuaagagcacccaagccgcgauagaucagaucaacggcaaauugaaucgccucauugguaagacgaacgaaaaguuccaccagaucgagaaagaauuuuccgagguugaagggagaauccaggaccuggagaaguacguggaggauaccaaaauugacuuauggucuuauaacgccgaucugcucguagcacuugaaaaucaacauacaauagaccugacugauagcgagaugaacaaguuguucgaaaagaccaagaagcagcuaagggagaaugcugaagacaugggcaacggaugcuuuaaaaucuaccacaagugugauaaugccugcauuggcucaauccggaacgggacauaugaccaugacguguaccgagaugaggcucugaauaaccgcuuccagauuaaaggagucgagcucaagagugguuacaaagacuggauccuguggauauccuuugccaucagcugcuuccuucuguguguggcauugcucggcuuuauuaugugggccugccagaaggggaauaucagauguaacauuugcaucuga

SEQ ID NO: 123983 - RNA, 1701 nt, Artificial Sequence
  derived and/or modified sequence opt3 from hemagglutinin__InfluenzaA__ABV30415
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacagguggcaucugcgacagcccacaccagauacuagauggggagaacuguacccucaucgacgcucugcuuggagauccgcagugcgacggcuuucaaaauaaaaagugggaucuguucguggaaagauccaaagccuauucuaacuguuaccccuaugacgucccugauuacgcaucguugaggucacucguggccagcagugguacucuggaguuuaauaacgaauccuucaauugggcugggguuacacagaacggaaccucuagcgcaugcaagcggggcuccaauaacucauuuuucagucgccugaauuggcucacgcauagcaaguuuaaauauccagccuuaaacgugacuaugcccaauaacgaggaguucgacaagcuguacauuuggggcguccaccauccugggaccgauaacgaccagaucuuucuuuaugcucaggccucuggacgaauuacaguguccacuaaacguucacaacagaccguaaucccaaauauagguagcagacccaggguucggaacauuccuagucgcaucucuauuuacuggacaaucgugaagccaggcgauaucuugcugauuaauuccaccgggaaccuaauagcgccgagaggauacuucaaaaucaggagcggcaagucgucuauuaugcgguccgacgcacccaucgguaaguguaauucagaaugcauaacgccuaacgggaguauuccaaaugacaaacccuuucagaacgucaaucgcaucacuuauggagccuguccucgauacgugaagcagaacacacucaaacuggcuaccggcaugagaaaugugccagagaagcaaacuaggggcaucuucggggccauugcaggauuuaucgaaaacgguugggagggcauggucgaugggugguauggauuccggcaccagaauagcgagggcauuggucaggcugccgaccuuaaauccacacaagcggccauagaucagaucaacgggaagcugaaucguuugauuggcaaaaccaacgaaaaguuccaccagaucgagaaggaauuuucugagguugaaggacgcauccaggaccucgagaaauacguggaggauacgaagauugaccuguggagcuauaacgcagaauuacugguagcucucgagaaucaacauaccauagaucuuacagacucagaaaugaacaaacuguucgagaagacuaaaaagcaguugagagaaaaugccgaggauaugggcaacgggugcuuuaagaucuaccacaaaugugacaaugcuugcauuggaaguaucaggaacgguaccuaugaucaugacguguaccgggacgaggcccuaaauaaccgauuccagauuaaguccgucgaacugaaaagcggcuacaaggauuggauccucuggauaucuuuugcaaucucaugcuuccugcuuuguguggcccuguugggguuuauuaugugggcuugccagaaaggaaauauccgcuguaacauuugcaucuga

SEQ ID NO: 123984 - RNA, 1701 nt, Artificial Sequence; identical to SEQ ID NO: 123944
  derived and/or modified sequence opt3 from hemagglutinin__InfluenzaA__ABV30426

SEQ ID NO: 123985 - RNA, 1701 nt, Artificial Sequence
  derived and/or modified sequence opt3 from hemagglutinin__InfluenzaA__ABV30437
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaaccauucauuuuucagucgacugaauuggcucacucacuuaaaguuuaaguauccagcacugaacgugaccaugcccaauaacgagaaauucgacaaacuuuacauuuggggaguccaucacccuggcacagauaacgaccagaucuuuuuguaugcccaggcuagcggccguauuacugugucuaccaagagaucccaacagacaguaaucccaaauauagggucaaggccccggguucgcaacauuccuagcagaaucaguauuuacuggaccaucgugaagccaggagauauccugcuaauuaauucuacggguaaccucauagccccgaggggcuacuucaaaauccgguccggaaagagcucgauuaugcgcucugacgcgcccaucgggaaguguaauuccgaaugcauaacuccuaacggcucaauuccaaaugacaaacccuuucagaacgucaaucgaaucacauauggugcauguccuagauacgugaagcagaacacccugaaacuugccacugggaugaggaaugugccagagaagcaaacacggggaaucuucggcgcuauugccggcuuuaucgaaaacgggugggagggaauggucgaugguugguauggcuuccgucaccagaauagugaggggauuggacaggcagcugaccugaaaagcacccaagccgcgauagaucagaucaacggcaaguugaaucgccucauugguaaaacgaacgaaaaguuccaucagaucgagaaggaauuuuccgagguugaagggagaauccaggaccuggagaaauacguggaggauaccaagauugacuuauggucuuauaacgccgaacugcucguagcacuugagaaucaacacacaauagaucugacugacagcgaaaugaacaaauuguucgagaagaccaaaaagcagcuaagggaaaaugcugaggauaugggcaacggaugcuuuaagaucuaccauaaaugugacaaugccugcauuggcucaauccggaacgggacauaugaucacgacguguaccgagacgaggcucugaauaaccgcuuccagauuaagggagucgaacucaaaagugguuacaaggauuggauccuguggauauccuuugccaucagcugcuuccuucuguguguggcauugcucggcuuuauuaugugggccugccagaaagggaauaucagauguaacauuugcaucuga

SEQ ID NO: 123986 - RNA, 1701 nt, Artificial Sequence; identical to SEQ ID NO: 123944
  derived and/or modified sequence opt3 from hemagglutinin__InfluenzaA__ABV30448

SEQ ID NO: 123987 - RNA, 1698 nt, Artificial Sequence
  derived and/or modified sequence opt3 from hemagglutinin__InfluenzaA__ABV30459
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaagcuccaaauccggagaacggaaccuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuaccggaauuuacuguggcuuaccggcaaaaacggauuguaucccaaucugagcaagucuuacgccaacaauaaagaaaaggaggugcuaguacucuggggcguucaucacccuccaaacauaggggaucagcgcgcucuguaccacacggaaaacgcauauguguccgucgugucaagccauuacagucgacguuucacucccgagaucgccaaaagaccuaaggugagggaccaggaaggacggauuaauuauuacuggacccuucuggagccaggugauacaaucauuuuugaggcuaacggcaauuugaucgccccgcgcuucgcguuugcacucucuagaggguucggauccggcauaauuacuagcaacgcccccauggacgaaugugaugcuaagugccagaccccucaaggugccaucaauucgucucugccauuucagaacguccaccccguuacaauuggggaguguccuaaauaugugagguccaccaaguuacggaugguaacgggacugcgcaauaucccaucaauccagagucgaggccucuucggcgcaauugcuggguuuauagaaggagguuggacuggcaugguggacgggugguacggauaucaucaccagaacgagcaaggcagcgguuacgccgcggaucagaaauccacacagaaugccaucaacgggauuaccaauaaggucaacucugugaucgaaaagaugaauacucaguucacagcaguuggcaaagaguucaacaaacuugagagaaggauggaaaaucugaacaagaagguggacgauggauuuuuggacauauggaccuacaacgcugagcuacugguccuccuggaaaaugagcggacgcuugacuuccacgauagcaacgugaaaaaucuguaugaaaagguaaaaucacaauugaagaacaaugccaaagagauuggcaacgggugcuuugaguucuaccauaaguguaaugacgaaugcauggagaguguuaagaacggaaccuaugauuaccccaaauauuccgaagagagcaagcucaaucgugagaaaaucgacggugugaagcuggaaucuaugggcgucuaccagaucuuagcuauuuauucaacaguggccaguagccugguccuacucgugucccugggggcaaucucuuuuuggaugugcucgaacggaagccuucagugucgcauuugcauauga

SEQ ID NO: 123988 - RNA, 1701 nt, Artificial Sequence; identical to SEQ ID NO: 123944
  derived and/or modified sequence opt3 from hemagglutinin__InfluenzaA__ABV30470

SEQ ID NO: 123989 - RNA, 1698 nt, Artificial Sequence; identical to SEQ ID NO: 123926
  derived and/or modified sequence opt3 from hemagglutinin__InfluenzaA__ABV30492

SEQ ID NO: 123990 - RNA, 1698 nt, Artificial Sequence
  derived and/or modified sequence opt3 from hemagglutinin__InfluenzaA__ABV30503
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacaauaaccggugugucugccagcugcucccacaacgggaagucaaguuuuuaccggaauuuacuguggcuuacgggcaaaaacggauuguaucccaaucugagcaagucuuacgcaaacaauaaagaaaaggagguccuagugcucuggggcguacaucacccuccaaacaucggggaucagcgcgcccuguaccacacugaaaacgcuuauguuuccguggucucaagccauuacagucgacguuucacccccgagauugcaaaaagaccuaaggugagggaccaggaaggacggaucaauuauuacuggacacuucuggagccaggugauacuauuaucuuugaggccaacggcaauuugauagcuccgcgcuucgccuuugcgcucucuagaggguucggauccggcauuaucaccagcaacgcacccauggacgaaugugaugccaagugccagacaccucaaggugcuauuaauucgucucugccauuucagaacgugcaccccgucaccaucggggaguguccuaaauauguuagguccacgaaguuacggauggugacuggacugcgcaauaucccaucaauucagagucgaggccucuucggcgccauagcaggguuuaucgaaggagguuggacaggcaugguagacgggugguacggauaucaucaccagaacgagcaaggcagcgguuacgcugccgaucagaaauccacccagaaugcgauuaacgggaucacuaauaaggugaacucugucauagaaaagaugaauacacaguucaccgccgugggcaaagaguucaacaaacuugagagaaggauggaaaaucugaacaagaagguugacgauggauuuuuggacauuuggacguacaacgcagagcuacuggugcuccuggaaaaugagcggacccuugacuuccacgauagcaacgucaaaaaucuguaugaaaaggugaaaucacaauugaagaacaaugcuaaagagaucggcaacgggugcuuugaguucuaccauaaguguaaugacgaaugcauggagaguguaaagaacggaacauaugauuaccccaaauauuccgaagagagcaagcucaaucgugagaaaaucgacgguguuaagcuggaaucuaugggcguguaccagauuuuagccaucuauucaacugucgcuaguagccuggugcuacucgucucccugggggccauuucuuuuuggaugugcucgaacggaagccuucagugucgcauaugcaucuga

SEQ ID NO: 123991 - RNA, 1701 nt, Artificial Sequence; identical to SEQ ID NO: 123944
  derived and/or modified sequence opt3 from hemagglutinin__InfluenzaA__ABV30514

SEQ ID NO: 123992 - RNA, 1698 nt, Artificial Sequence
  derived and/or modified sequence opt3 from hemagglutinin__InfluenzaA__ABV30525
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacucagggaagaguagcuuuuaccggaacuuacuguggcuuacgggcaaaaauggauuguaucccaaccugucuaaguccuacgcaaauaacaaagaaaaggagguucuaguacucuggggcgugcaucacccuccaaauaucggggaucagcgcgcccuguaccacacugaaaacgcuuaugucucaguggugagcagucauuacucucgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucuccagaggguucggaagcggcaucauaaccucgaauacacccaugggugaaugugacgcaaagugccagaccccucaaggggccauuaacucuucccugccauuucagaauguucaccccgugacgaucggagaguguccuaaauauguaaggucagcuaaguuacggauggugacuggccugcgcaacauuccaaguauccagagccgaggccucuucggggccaucgcaggauuuauugaagguggcuggacagggauggucgauggaugguacggcuaucaucaccagaaugagcaagguuccggguacgcugccgaccagaaaucuacccagaacgcgauaaauggcaucacuaacaaggugaauagcguuauugaaaagaugaacacacaguucaccgccgugggaaaagaguucaauaaacuugagagaaggauggaaaaccugaauaagaaggucgaugacggcuuuuuggauaucuggacguacaacgcagagcuacuggugcuccuggaaaacgagcggacccuugacuuccacgacucaaauguuaaaaaccuguaugaaaagguaaaaagucaauugaagaauaacgcuaaagagauagggaauggaugcuuugaguucuaccauaaguguaacgaugaaugcauggaguccgugaagaaugguacauaugacuaccccaaauauagcgaagagucuaagcucaaccgugagaaaauugauggcgucaagcuggaaucaauggggguguaccagaucuuagccaucuauaguacugucgcuagcucccuggugcuacucguuucucugggagccauuucguuuuggaugugcagcaauggcucccuucagugucgcaucugcauuuga

SEQ ID NO: 123993 - RNA, 1698 nt, Artificial Sequence; identical to SEQ ID NO: 123930
  derived and/or modified sequence opt3 from hemagglutinin__InfluenzaA__ABV30536

SEQ ID NO: 123994 - RNA, 1698 nt, Artificial Sequence; identical to SEQ ID NO: 123937
  derived and/or modified sequence opt3 from hemagglutinin__InfluenzaA__ABV30547

SEQ ID NO: 123995 - RNA, 1698 nt, Artificial Sequence; identical to SEQ ID NO: 123930
  derived and/or modified sequence opt3 from hemagglutinin__InfluenzaA__ABV30558

SEQ ID NO: 123996 - RNA, 1698 nt, Artificial Sequence
  derived and/or modified sequence opt3 from hemagglutinin__InfluenzaA__ABV30569
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauaaccacaaugggaaacuaugccuccugaagggaaucgcgccccuucagcuggguaacuguucugucgccggcuggauuuuggggaauccugagugcgaacuccugaucucaaaagagaguuggagcuacauuguggaaaccccaaacccggagaauggaacuuguuaucccggcuacuuugcugacuaugaggaacugagagagcaacucuccucuguuucgucauucgaaagguuugagaucuucccuaaggagagcaguuggccaaaccauacagugaccggugucuccgccucuugcagccacaaugggaaguccucauuuuaccggaacuuacuguggcuuacgggcaaaaauggauuguaucccaaccugaguaagagcuacgcaaauaacaaagaaaaggaggugcuaguacucuggggcguucaucacccuccaaacauaggggaucagcgcgcccuguaccacacugaaaaugcuuaugugucugucguguccucacauuacagccgacguuucacccccgagaucgcaaaaagaccuaaggugagggaccaggaaggacggauuaacuauuacuggacacuucuggagccaggugauacuaucauuuuugaggccaauggcaacuugaucgcuccgcgcuucgccuuugcgcucaguagaggguucggaucuggcauaauuaccuccaaugcacccauggacgaaugugaugccaagugccagacaccucaaggugcuaucaacagcucgcugccauuucagaauguccaccccguuaccauuggggaguguccuaaauaugugaggucuacgaaguuacggaugguaacuggacugcgcaacaucccauccauccagucacgaggccucuucggcgccauugcaggguuuauagaaggagguuggacaggcaugguggacgggugguacggauaucaucaccagaaugagcaaggcagugguuacgcugccgaucagaaaagcacccagaacgcgaucaaugggauuacuaacaaggucaauuccgugaucgaaaagaugaacacacaguucaccgccguuggcaaagaguucaauaaacuugagagaaggauggaaaaccugaacaagaagguggacgauggauuuuuggacauauggacguacaaugcagagcuacugguccuccuggaaaacgagcggacccuugacuuccacgauucuaaugugaaaaaccuguaugaaaagguaaaaagccaauugaagaauaacgcuaaagagauuggcaaugggugcuuugaguucuaccauaaguguaacgacgaaugcauggagucaguuaagaauggaacauaugauuaccccaaauauagugaagaguccaagcucaaccgugagaaaaucgacggugugaagcuggaaagcaugggcgucuaccagaucuuagccauuuauucuacuguggcuucaagucugguccuacucgugagccugggggccaucuccuuuuggaugugcucuaauggaucgcuucagugucgcauuugcauauga

SEQ ID NO: 123997 - RNA, 1698 nt, Artificial Sequence; identical to SEQ ID NO: 123930
  derived and/or modified sequence opt3 from hemagglutinin__InfluenzaA__ABV30580

SEQ ID NO: 123998 - RNA, 1698 nt, Artificial Sequence; identical to SEQ ID NO: 123926
  derived and/or modified sequence opt3 from hemagglutinin__InfluenzaA__ABV30591

SEQ ID NO: 123999 - RNA, 1698 nt, Artificial Sequence; identical to SEQ ID NO: 123926
  derived and/or modified sequence opt3 from hemagglutinin__InfluenzaA__ABV30602

SEQ ID NO: 124000 - RNA, 1698 nt, Artificial Sequence
  derived and/or modified sequence opt3 from hemagglutinin__InfluenzaA__ABV30613
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccacgaaguuacggaugguaacuggacugcgcaauaucccaucaauccagagucgaggccucuucggcgccauugcaggguuuauagaaggagguuggacaggcaugguggacgggugguacggauaucaucaccagaacgagcaaggcagcgguuacgcugccgaucagaaauccacccagaaugcgaucaacgggauuacuaauaaggucaacucugugaucgaaaagaugaauacacaguucaccgccguuggcaaagaguucaacaaacuugagagaaggaugaagaaucugaacaagaaaguggacgauggauuuuuggacauauggacguacaacgcagaacuacugguccuccuggagaaugaacggacccuugacuuccacgauagcaacgugaagaaucuguaugagaaaguaaagucacaauugaaaaacaaugcuaaggaaauuggcaacgggugcuuugaguucuaccauaaguguaaugacgagugcauggaaaguguuaaaaacggaacauaugauuaccccaaguauuccgaggaaagcaaacucaaucgugagaagaucgacggugugaaacuggagucuaugggcgucuaccagaucuuagccauuuauucaacuguggcuaguagccugguccuacucgugucccugggggccaucucuuuuuggaugugcucgaacggaagccuucagugucgcauuugcauauga

SEQ ID NO: 124001 - RNA, 1698 nt, Artificial Sequence; identical to SEQ ID NO: 123926
  derived and/or modified sequence opt3 from hemagglutinin__InfluenzaA__ABV30624

SEQ ID NO: 124002 - RNA, 1701 nt, Artificial Sequence
  derived and/or modified sequence opt3 from hemagglutinin__InfluenzaA__ABV30646
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacauauaaugaucagaucuuuuuguacgcccaggcuagcggccguauuacugugucuaccaagagaucccaacagacaguaaucccaaacauagggucaaggccccggguucgcaauauuccuagcagaaucaguauuuacuggaccaucgugaagccaggagacauccugcuaauuaacucuacggguaaucucauagccccgaggggcuauuucaaaauccgguccggaaagagcucgauuaugcgcucugaugcgcccaucgggaaguguaacuccgaaugcauaacuccuaauggcucaauuccaaacgacaaacccuuucagaaugucaaccgaaucacauacggugcauguccuagauaugugaagcagaauacccugaaacuugccacugggaugaggaacgugccagagaagcaaacacggggaaucuucggcgcuauugccggcuuuaucgaaaaugggugggagggaauggucgacgguugguacggcuuccgucaccagaacagugaggggauuggacaggcagcugaucugaaaagcacccaagccgcgauagaccagaucaauggcaaguugaaccgccucauugguaaaacgaacgaaaaguuccaccagaucgagaaggaauuuuccgagguugaagggagaauccaggaucuggagaaauauguggaggacaccaagauugauuuauggucuuacaaugccgaacugcucguagcacuugagaaccaacauacaauagaccugacugauagcgaaaugaauaaauuguucgagaagaccaaaaagcagcuaagggaaaacgcugaggacaugggcaauggaugcuuuaagaucuaucacaaaugugauaacgccugcauuggcucaauccggaaugggacauacgaccaugauguguaccgagacgaggcucugaacaaucgcuuccagauuaagggagucgaacucaaaagugguuauaaggacuggauccuguggauauccuuugccaucagcugcuuccuucuguguguggcauugcucggcuuuauuaugugggccugccagaaagggaacaucagauguaauauuugcaucuga

SEQ ID NO: 124003 - RNA, 1701 nt, Artificial Sequence
  derived and/or modified sequence opt3 from hemagglutinin__InfluenzaA__ABV30657
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagguguuuuuguaugcccaggcuagcggccguaucacuguaucuaccaagagaucccaacagacaguuauuccaaacaucgggucaaggccccgggugcgcaauauaccuagcagaauuaguaucuacuggaccauugucaagccaggagauauccugcuaaucaacucuacggguaaucucauugccccgaggggcuacuucaaaauacgguccggaaagagcucgaucaugcgcucugacgcgcccauugggaaguguaacuccgaaugcaucacuccuaauggcucaauaccaaacgacaaacccuuucagaaugugaaccgaauuacauauggugcauguccuagauacgugaagcagaauacccugaaacuugccacugggaugaggaacgucccagagaagcaaacacggggaaucuucggcgcuaucgccggcuuuauugaaaaugggugggagggaaugguugaugguugguauggcuuccgucaccagaacagugaggggaucggacaggcagcugaccugaaaagcacccaagccgcgauugaucagauaaauggcaaguugaaccgccucaucgguaaaacgaacgaaaaguuccaccagauugagaaggaauuuuccgagguggaagggagaauccaggaccuggagaaauacguagaggauaccaagaucgacuuauggucuuauaaugccgaacugcucguggcacuugagaaccaacauacaauugaucugacugacagcgaaaugaauaaauuguucgagaagaccaaaaagcagcuaagggaaaacgcugaggauaugggcaauggaugcuuuaagauauaccacaaaugugacaacgccugcaucggcucaauucggaaugggacauaugaucaugacgucuaccgagacgaggcucugaacaaucgcuuccagaucaagggaguggaacucaaaagugguuacaaggauuggauucuguggaucuccuuugccauaagcugcuuccuucuguguguugcauugcucggcuuuaucaugugggccugccagaaagggaacauuagauguaauaucugcauuuga

SEQ ID NO: 124004 - RNA, 1701 nt, Artificial Sequence; identical to SEQ ID NO: 124003
  derived and/or modified sequence opt3 from hemagglutinin__InfluenzaA__ABV45860

SEQ ID NO: 124005 - RNA, 1698 nt, Artificial Sequence; identical to SEQ ID NO: 123971
  derived and/or modified sequence opt3 from hemagglutinin__InfluenzaA__ABV45871

SEQ ID NO: 124006 - RNA, 1698 nt, Artificial Sequence; identical to SEQ ID NO: 123930
  derived and/or modified sequence opt3 from hemagglutinin__InfluenzaA__ABV45882

SEQ ID NO: 124007 - RNA, 1698 nt, Artificial Sequence; identical to SEQ ID NO: 123937
  derived and/or modified sequence opt3 from hemagglutinin__InfluenzaA__ABV45893

SEQ ID NO: 124008 - RNA, 1701 nt, Artificial Sequence; identical to SEQ ID NO: 123745
  derived and/or modified sequence opt3 from hemagglutinin__InfluenzaA__ABV45904

SEQ ID NO: 124009 - RNA, 1698 nt, Artificial Sequence; identical to SEQ ID NO: 123937
  derived and/or modified sequence opt3 from hemagglutinin__InfluenzaA__ABV45926

SEQ ID NO: 124010 - RNA, 1698 nt, Artificial Sequence
  derived and/or modified sequence opt3 from hemagglutinin__InfluenzaA__ABV45937
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugagaccaacggcaauuugauugccccgcgcuucgcuuuugcccucucuagaggguucggauccggcaucauaacaagcaacgcgcccaugggugaaugugacgcaaagugccagaccccucaaggggccauuaauucgucucugccauuucagaacguucaccccgugacgaucggagaguguccuaaauauguaagguccgcuaaguuacggauggugacuggccugcgcaauauuccaucaauccagagucgaggccucuucggggccaucgcaggauuuauugaagguggcuggacagggauggucgauggaugguacggcuaucaucaccagaacgagcaagguagcggguacgcugccgaccagaaauccacccagaaugcgauaaacggcaucacuaauaaggugaacucuguuauugaaaagaugaauacacaguucaccgccgugggaaaagaguucaacaaacuugagagaaggauggaaaaucugaacaagaaggucgaugacggcuuuuuggauaucuggacguacaacgcagagcuacuggugcuccuggaaaaugagcggacccuugacuuccacgacagcaacguuaaaaaucuguaugaaaagguaaaaucacaauugaagaacaaugcuaaagagauagggaacggaugcuuugaguucuaccauaaguguaaugaugaaugcauggagagugugaagaacgguacauaugacuaccccaaauauuccgaagagagcaagcucaaucgugagaaaauugauggcgucaagcuggaaucuauggggguguaccagaucuuagccaucuauucaacugucgcuaguagccuggugcuacucguuucccugggagccauuucuuuuuggaugugcucgaacggcagccuucagugucgcaucugcauuuga

SEQ ID NO: 124011 - RNA, 1698 nt, Artificial Sequence; identical to SEQ ID NO: 123963
  derived and/or modified sequence opt3 from hemagglutinin__InfluenzaA__ABV45948

SEQ ID NO: 124012 - RNA, 1698 nt, Artificial Sequence; identical to SEQ ID NO: 123930
  derived and/or modified sequence opt3 from hemagglutinin__InfluenzaA__ABV45959

SEQ ID NO: 124013 - RNA, 1701 nt, Artificial Sequence
  derived and/or modified sequence opt3 from hemagglutinin__InfluenzaA__ABV45970
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugaucaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucacuuaaaguuuaaguacccagcacugaaugugaccaugcccaacaacgagaaauucgacaaacuuuauauuuggggaguccaucacccuggcacagauaaugaccagaucuuuuuguacgcccaggcuagcggccguauuacugugucuaccaagagaucccaacagacaguaaucccaaacauagggucaaggccccggguucgcaauauuccuagcagaaucaguauuuauuggaccaucgugaagccaggagauauccugcuaauuaacucuacggguaaucucauagccccgaggggcuacuucaaaauccaguccggaaagagcucgauuaugcggucugacgcgcccaucgggaaguguaacuccgaaugcauaacuccuaauggcucaauuccaaacgacaaacccuuucagaaugucaaccgcaucacauacggugcauguccucgauaugugaagcaaaauacccugaaacuugccacugggaugagaaacgugccagagaagcagacaaggggaaucuucggcgcuauugccggcuuuaucgaaaaugggugggagggaauggucgaugguugguacggcuuccggcaccagaacagugaggggauuggacaagcagcugaccugaaaagcacccaggccgcgauagaucagaucaauggcaaguugaaccgucucauugguaaaacgaacgaaaaguuccaucagaucgagaaggaauuuuccgagguugaagggcgcauccaagaccuggagaaauauguggaggauaccaagauugacuuauggucuuacaaugccgaacugcucguagcacuugagaaccagcacacaauagaucugacugacagcgaaaugaauaaauuguucgagaagaccaaaaagcagcuaagagaaaacgcugaggauaugggcaauggaugcuuuaagaucuaucauaaaugugacaacgccugcauuggcucaaucaggaaugggacauacgaucacgacguguaucgggacgaggcucugaacaaucgauuccagauuaagggagucgaacucaaaagugguuacaaggauuggauccuguggauauccuuugccaucagcugcuuccuucuguguguggcauugcucggcuuuauuaugugggccugccaaaaagggaacauccgcuguaauauuugcaucuga

SEQ ID NO: 124014 - RNA, 1701 nt, Artificial Sequence
  derived and/or modified sequence opt3 from hemagglutinin__InfluenzaA__ABV45981
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacagcgaaaugaauaaauuguucgagaagaccaaaaagcagcuaagggaaaacgcugaggauaugggcaauggaugcuuuaagaucuaccacaaaugugacaacgccugcauuggcucaauccggaaugggacauaugaucaugacguguaccgagacgaggcucugaacaaucgcuuccagauuaagggagucgaacucaaaagugguuacaaggauuggaucauauggaucuccuuugccauuagcugcuuccugcuuuguguggcacuguugggcuuuaucaugugggccugccagaaagggaacauuagauguaauaucugcauauga

SEQ ID NO: 124015 - RNA, 1698 nt, Artificial Sequence
  derived and/or modified sequence opt3 from hemagglutinin__InfluenzaA__ABV82551
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacggggaaucaaguuuuuaccggaauuuacuguggcuuacggagaagaacggauuguaucccaaucugagcaaaucuuacgcaaacaauaaggaaaaagagguucuaguacucuggggcgugcaucacccuccaaacaucggcgaucagcgcgcccuguaccacacugaaaacgcuuaugucuccguggugucaagccauuacagucgacguuucacccccgagauagcaaagagaccuaaagucagggaccaggaggggcggaucaauuauuacuggacacuucuggaaccaggagauacuauuaucuuugaggccaacgguaauuugauugcuccgcgcuucgccuuugcgcucucuagaggcuucggguccggaaucauaaccagcaacgcacccauggacaagugugaugccaagugccagacaccucaaggcgcuauuaauucgucucugccauuucagaacguucaccccgugaccaucggugaauguccuaaauauguaagguccacgaaguuacggauggugacugggcugcgcaauauuccaucaauccagagucgaggacucuucggcgccaucgcaggcuuuauugaagggggauggacagguauggucgacggcugguacggguaucaucaccagaacgaacaaggaagcggcuacgcugccgaucagaaauccacccagaaugcgauaaacgguaucacuaauaaggugaacucuguuauugagaaaaugaauacacaguucaccgccguggggaaggaguucaacaaacuugaaagaaggauggagaaucugaacaagaaggucgacgauggcuuuuuggacaucuggacguacaacgcagaacuacuggugcuccuggagaaugaacggacccuugacuuccacgauagcaacguuaaaaaucuguaugagaagguaaaaucacaauugaagaacaaugcuaaagagauaggaaacggcugcuuugaguucuaccauaaguguaaugacgagugcauggaaagugugaagaacgggacauaugauuaccccaaauauuccgaggagagcaagcucaaucgugagaaaauugacggagucaagcuggaaucuauggguguguaccagaucuuagccaucuauucaacugucgcuaguagccuggugcuacucguuucccugggcgccauuucuuuuuggaugugcucgaacgggagccuucagugucgcaucugcauuuga

SEQ ID NO: 124016 - RNA, 1701 nt, Artificial Sequence; identical to SEQ ID NO: 123944
  derived and/or modified sequence opt3 from hemagglutinin__InfluenzaA__ABV82562

SEQ ID NO: 124017 - RNA, 1701 nt, Artificial Sequence; identical to SEQ ID NO: 123944
  derived and/or modified sequence opt3 from hemagglutinin__InfluenzaA__ABW36168

SEQ ID NO: 124018 - RNA, 1698 nt, Artificial Sequence; identical to SEQ ID NO: 123930
  derived and/or modified sequence opt3 from hemagglutinin__InfluenzaA__ABW36179

SEQ ID NO: 124019 - RNA, 1698 nt, Artificial Sequence; identical to SEQ ID NO: 123973
  derived and/or modified sequence opt3 from hemagglutinin__InfluenzaA__ABW36190

SEQ ID NO: 124020 - RNA, 1698 nt, Artificial Sequence; identical to SEQ ID NO: 123930
  derived and/or modified sequence opt3 from hemagglutinin__InfluenzaA__ABW36201

SEQ ID NO: 124021 - RNA, 1698 nt, Artificial Sequence
  derived and/or modified sequence opt3 from hemagglutinin__InfluenzaA__ABW36212
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugucaucauucgaaagguuugagauuuucccuaaggagaauaguuggccaaaccauacagucaccgguguguccgccucuugcagccacaaugggaaguccucauuuuaccggaacuuacuguggcuuacgggcaaaaauggauuguaucccaaccugaguaagagcuacgcaaauaacaaagaaaaggaggugcuaguucucuggggcgugcaucacccuccaaacaucggggaucagcgcgcccuguaccacacugaaaaugcuuaugucucugugguguccucacauuacagccgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucaguagagggcugggaucuggcaucauaaccuccaaugcacccauggacgaaugugaugccaagugccagacaccucaaggugcuauuaacagcucguuaccauuccagaauguucaccccgugaccaucggggaguguccuaaauauguaaggucugccaagcugcggauggugacgggacuccgcaacauuccauccauccagucacgaggccuuuuuggcgcaaucgcuggguucauugaaggagguuggacuggcauggucgacgggugguacggauaucaucaccagaaugagcaaggcagugguuacgccgcggaucagaaaagcacacagaacgccauaaaugggaucaccaacaagguaaauuccguuauugaaaagaugaacacucaguuuacagcagugggcaaagaguucaauaaacuggagagaaggauggaaaacuugaacaagaaggucgacgauggauuccuagacaucuggaccuacaaugcugagcugcucgugcugcuugaaaacgagcggacgcuggacuuucacgauucuaauguuaaaaacuuguaugaaaagguaaaaggccaacucaagaauaacgccaaagagauagggaauggaugcuucgaguuuuaccauaaguguaacgacgaaugcauggagagcgugaagaaugguaccuaugauuaccccaaauauucagaagagaguaagcugaaccgugagaaaauugacggcgucaaguuagaauccauggggguguaccagauccuggcuaucuauagcacagucgccucuagccuagugcuccugguuagucuuggagcaauuagcuucuggaugugcuccaauggcucuuugcagugucgcaucugcauuuga

SEQ ID NO: 124022 - RNA, 1698 nt, Artificial Sequence; identical to SEQ ID NO: 123926
  derived and/or modified sequence opt3 from hemagglutinin__InfluenzaA__ABW36223

SEQ ID NO: 124023 - RNA, 1698 nt, Artificial Sequence; identical to SEQ ID NO: 123926
  derived and/or modified sequence opt3 from hemagglutinin__InfluenzaA__ABW36245

SEQ ID NO: 124024 - RNA, 1698 nt, Artificial Sequence; identical to SEQ ID NO: 123926
  derived and/or modified sequence opt3 from hemagglutinin__InfluenzaA__ABW36267

SEQ ID NO: 124025 - RNA, 1698 nt, Artificial Sequence; identical to SEQ ID NO: 123930
  derived and/or modified sequence opt3 from hemagglutinin__InfluenzaA__ABW36278

SEQ ID NO: 124026 - RNA, 1698 nt, Artificial Sequence
  derived and/or modified sequence opt3 from hemagglutinin__InfluenzaA__ABW36289
augaagcugaaacuccuugugcuguugugcaccuucacagccacuuacgcugacacgaucuguauuggcuaucacgcaaacaauagcaccgauacagucgacacuguuuuagagaagaacgugaccguaacacauuccgugaaucugcuagaagauucucacaacgggaaacucugccugcuuaagggaauagcgccccugcaguuggguaauuguucagucgccggcuggauccucgggaacccugagugcgaacugcugauuaguaaagagagcugguccuacaucguggaaaccccaaauccggagaacggaacuuguuaucccggcuacuuugcugacuaugaggaacucagagagcaauuaucuucgguuagcagcuucgaaagguuugagauuuucccuaaggagaguuccuggccaaaucauacagugaccggugucucugccagcugcucccacaacgggaagucaaguuuuuaccggaaucugcuuugguugacgggcaaaaacggacuguaucccaaucuaagcaagucuuacgcaaacaauaaagaaaaggaggugcucguacuguggggcguucaucacccuccaaacaucggggaucagcgcgcccuuuaccacacugaaaacgcuuauguguccgucgugucaagccauuacagucgacguuucacccccgagauagcaaaaagaccuaaggugagggaccaggaaggacggaucaauuauuacuggacacuguuggagccaggugauacuauuaucuuugaggccaacggcaaucucauugcuccgcgcuucgccuuugcgcugucuagaggguucggauccggcaucauaaccagcaacgcacccauggacgaaugugaugccaagugccagacaccucaaggugcuauuaauucgucuuuaccauuucagaacguccaccccguuaccaucggggaguguccuaaauaugugagguccacgaagcugcggaugguaacuggacuccgcaauauuccaucaauccagagucgaggccuuuucggcgccaucgcaggguuuauugaaggagguuggacaggcaugguggacgggugguacggauaucaucaccagaacgagcaaggcagcgguuacgcugccgaucagaaauccacccagaaugcgauaaacgggaucacuaauaaggucaacucugugauugaaaagaugaauacacaguucaccgccguuggcaaagaguucaacaaacuggagagaaggauggaaaauuugaacaagaagguggacgauggauuucuagacaucuggacguacaacgcagagcugcucguccugcuugaaaaugagcggacccuggacuuccacgauagcaacgugaaaaauuuguaugaaaagguaaaaucacaacucaagaacaaugcuaaagagauaggcaacgggugcuuugaguucuaccauaaguguaaugacgaaugcauggagaguguuaagaacggaacauaugauuaccccaaauauuccgaagagagcaagcugaaucgugagaaaauugacggugugaaguuagaaucuaugggcgucuaccagauccuggccaucuauucaacuguggcuaguagccuaguccuccuggugucccuuggggccauuucuuuuuggaugugcucgaacggaucauugcagugucgcaucugcauuuga

SEQ ID NO: 124027 - RNA, 1698 nt, Artificial Sequence; identical to SEQ ID NO: 123937
  derived and/or modified sequence opt3 from hemagglutinin__InfluenzaA__ABW36300

SEQ ID NO: 124028 - RNA, 1701 nt, Artificial Sequence
  derived and/or modified sequence opt3 from hemagglutinin__InfluenzaA__ABW36311
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcauaacgugacccgagguguuacugcuuccugcucacacaaagggaagaguagcuuuuaucguaaucucuuauggcugacagagaaaaacggaucuuacccaaaucuuuccaagucauaugugaacaauaaggaaaaagaggucuuggugcuguggggcguacaucaccccagcaacaucgaagaccagaagaccauauacagaaaagagaaugcauacguuaguguggucucuuccaacuauaacaggcgguucacgccugaaaucgccaagcgcccaaaagugagagaucaggagggcaggauuaauuacuauuggacucuacucgagcccggggacaccaucauuuuugaagcuaacggaaaucugaucgccccuugguacgcguucgcacuuagccgggguuuuggcucggggauaauuacaucuaacgccuccauggaugagugugacacuaagugccagaccccacaaggagcuaucaauucaagucugccguuccagaacgugcaccccgucacaauuggcgaauguccuaaauauguucgcagcaccaaguugcgaauggugacgggucucagaaauaucccauccauccagucuagggggcuguuuggagccauugcaggcuucauagagggcggguggacuggaaugaucgaugguugguacggcuaucaucaccagaacgaacaagggagcggauacgcugccgaccagaagucaacacagaaugcgauuaacggcaucaccaauaaaguaaacagugugauagagaagaugaauacucaguuuacagccgucgguaaagaguucaacaaguuagaaaaacggauggagaaucugaacaagaagguggaugacggguuccucgacauuuggaccuacaacgcagaacuucugguuuugcuagagaaugaacguacgcuggauucccaugacagcaacgugaaaaaucucuaugagaaggucaaaucucaacugaagaacaaugcuaaagagaucggcaacggaugcuuugaguucuaccacaaguguaauaacgaaugcauggaaucagugaagaauggcaccuaugauuaccccaaauauagugaggagagcaaacuuaaccgcgaaaagaucgacgggguaaagcuggaguccaugggaguuuaccagauuuuggccaucuauucuacaguggcuucgagccucguccuguuagugucccugggugccauuucauuuuggaugugcaguaauggcucucuacaguguagaauaugcaucuga

SEQ ID NO: 124029 - RNA, 1701 nt, Artificial Sequence
  derived and/or modified sequence opt3 from hemagglutinin__InfluenzaA__ABW38363
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauuacauauggugcauguccuagauacgugaaacagaauacccugaagcuggccacugggaugaggaacgugccagagaaacaaacacggggaaucuucggcgcuaucgccggcuuuauugaaaaugggugggagggaauggucgaugguugguauggcuuccgucaccagaacagugaggggaucggacaggcagcugaccuuaagagcacccaagccgcgauugaucagauaaauggcaaauugaaccgccucaucgguaagacgaacgaaaaguuccaccagauugagaaagaauuuuccgagguugaagggagaauccaggaccuggagaaguacguggaggauaccaaaaucgacuuauggucuuauaaugccgaacugauuguagcacucgagaaccaacauacaauagaucuuacugacagcgaaaugaauaagcuguucgagaggaccaaaaagcaguugcgggaaaacgcugaggauaugggcaauggaugcuuuaagaucuaccacaaaugugacaacgccugcauuggcucaauccgaaaugggacauaugaucaugacguguaccgcgacgaggcucuaaacaauagauuccagauuaagggagucgaacugaaaagugguuacaaggauuggauccucuggauauccuuugccaucagcugcuuccugcuuuguguggcacuguugggcuuuauuaugugggccugccagaaagggaacaucagguguaauauuugcaucuga

SEQ ID NO: 124030 - RNA, 1698 nt, Artificial Sequence
  derived and/or modified sequence opt3 from hemagglutinin__InfluenzaA__ABW39777
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaauaguuggccaaaccauacagucaccgguguguccgccucuugcagccacaaugggaaguccucauuuuaccggaacuuacuguggcuuacgggcaaaaauggauuguaucccaaccugaguaagagcuacgcaaauaacaaagaaaaggaggugcuaguucucuggggcgugcaucacccuccaaacaucggggaucagcgcgcccuguaccacacugaaaaugcuuaugucucugugguguccucacauuacagccgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucaguagagggcugggaucuggcaucauaaccuccaaugcacccauggacgaaugugaugccaagugccagacaccucaaggugcuauuaacagcucguuaccauuccagaauguucaccccgugaccaucggggaguguccuaaauauguaaggucugccaagcugcggauggugacgggacuccgcaacauuccauccauccagucacgaggccuuuuuggcgcaaucgcuggguucauugaaggagguuggacuggcauggucgacgggugguacggauaucaucaccagaaugagcaaggcagugguuacgccgcggaucagaaaagcacacagaacgccauaaaugggaucaccaacaagguaaauuccguuauugaaaagaugaacacucaguuuacagcagugggcaaagaguucaauaaacuggagagaaggauggaaaacuugaacaagaaggucgacgauggauuccuagacaucuggaccuacaaugcugagcugcucgugcugcuugaaaacgagcggacgcuggacuuucacgauucuaauguuaaaaacuuguaugaaaagguaaaaagccaacucaagaauaacgccaaagagauaggcaaugggugcuucgaguuuuaccauaaguguaacgacgaaugcauggagucagugaagaauggaaccuaugauuaccccaaauauagugaagaguccaagcugaaccgugagaaaauugacggugucaaguuagaaagcaugggcguguaccagauccuggcuaucuauucuacagucgccucaagucuagugcuccugguuagccuuggggcaauuuccuucuggaugugcucuaauggaucguugcagugucgcaucugcauuuga

SEQ ID NO: 124031 - RNA, 1698 nt, Artificial Sequence; identical to SEQ ID NO: 123930
  derived and/or modified sequence opt3 from hemagglutinin__InfluenzaA__ABW39806

SEQ ID NO: 124032 - RNA, 1698 nt, Artificial Sequence; identical to SEQ ID NO: 123937
  derived and/or modified sequence opt3 from hemagglutinin__InfluenzaA__ABW39817

SEQ ID NO: 124033 - RNA, 1698 nt, Artificial Sequence
  derived and/or modified sequence opt3 from hemagglutinin__InfluenzaA__ABW39828
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaagccaaacccggagaauggaaccuguuaucccggccauuuugcugacuacgaggaacugagagagcaacucuccucugugucgucauucgaaagguuugagauuuucccuaaggagagcaguuggccaaaccacacugucacagguguguccgccucuugcagccauaauggggaauccucauuuuauaaaaacuuacuguggcuuaccggaaagaauggcuuguaccccaaccugaguaaaagcuaugcaaauaacaaggagaaagaaguucuaguacucuggggcgugcaccacccuccaaacaucggggaucagaugacgcuguaccauaaggagaaugccuacgucucugugguguccucacacuauagccggaaguucacucccgaaauagcuaaacgcccuaagguccgagaccaggagggacguaucaacuacuauuggacccuucuggagccaggugauacaauuaucuuugaagcaaauggcaacuugauugccccgagauacgcuuucgcccucaguaggggguuuggaucuggcaucauaaauuccaacgcgcccauggacgagugugaugcaaaaugccagacuccucaaggugccauuaauagcucgcugccauuccagaacguucaucccgugaccaucggggaauguccuaaguauguacggucugcuaaauuacgcauggugacaggacugagaaauauuccauccauccagucaaggggccucuuuggcgccaucgcaggguucauugagggagguuggaccggcauggucgacgggugguacggauaucaccaccagaacgaacaaggcagugguuacgcugccgaucaaaagagcacgcagaaugcgauaaacgggaucacuaauaaagugaacuccguuauugagaagaugaauacacaguuuaccgccgugggcaaggaguucaacaaacuugaacggcgcauggagaaccugaauaagaaagucgacgauggauucaucgacguguggacuuacaacgcagaauugcuaguacugcucgagaaugaacgaacacuggacuuucaugauucuaacguuaagaaucuuuaugagaaagugaagaaccagcugaagaauaacgcuaaagagauaggcaaugggugcuucgaauuuuaccacaaguguaacgacgagugcauggaaagcgucaaaaauggaaccuaugauuaccccaaguauucagaggagaguaaauuguccagagaaaagauugacggugugaagcucgagagcaugggcgucuaccagauccuggccaucuauucuacgguggcuucaaguuuaguucugcuagugagccucggggccauuuccuucuggaugugcucuaacggaucgcugcaguguaggaucugcauuuga

SEQ ID NO: 124034 - RNA, 1698 nt, Artificial Sequence
  derived and/or modified sequence opt3 from hemagglutinin__InfluenzaA__ABW39839
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacuccaacaauaaagaaaaggagguucuaguacucuggggcgugcaucacccuccaaacaucggggaucagcgcgcacuguaccacacugaaaacgccuaugucucaguggugagcagucauuacucucgacguuucacccccgagauagcuaaaagaccuaaggucagggaccaggaaggacggaucaauuauuacuggacacuucuggagccaggugauacuauuaucuuugaggcaaacggcaauuugauugccccgcgcuucgcuuuugcccucuccagaggguucggaagcggcaucauaaccucgaacgcgcccaugggugaaugugacgcaaagugccagacaccucaaggggccauuaauucuucccugccauuucagaacguucaccccgugaccaucggagaguguccuaaauauguaaggucagcuaaguuacggauggugacgggccugcgcaauauuccaaguauccagagccgaggccucuucggggccaucgcaggauuuauugaagguggcuggacugggauggucgauggaugguacggcuaucaucaccagaacgagcaagguuccggguacgcugccgaccagaaaucuacacagaaugcgauaaacggcaucaccaauaaggugaacagcguuauugaaaagaugaauacucaguucacagccgugggaaaagaguucaacaaacuugagagaaggauggaaaaucugaacaagaaggucgaugacggcuuuuuggauaucuggaccuacaacgcagagcuacuggugcuccuggaaaaugagcggacgcuugacuuccacgacucaaacguuaaaaaucuguaugaaaagguaaaaagucaauugaagaacaaugcuaaagagauagggaacggaugcuuugaguucuaccauaaguguaaugaugaaugcauggaguccgugcguaacgguaccuaugacuaccccaaguauagcgaagagucuaaacucaaucgcgagaagauugauggcgucaaacuggaaucaauggggguguaccagaucuuagccaucuauaguacagucgcuagcucccuggugcuacucguuucucugggagccauuucguuuuggaugugcagcaacggcucccuucaguguagaaucugcauuuga

SEQ ID NO: 124035 - RNA, 1698 nt, Artificial Sequence
  derived and/or modified sequence opt3 from hemagglutinin__InfluenzaA__ABW39850
augaaggugaaacugcucguccuucugugcaccuucacagccacuaacgcugacacgaucuguauuggcuaccacgcaaauaacagcaccgauacaguugacacuguguuggagaagaauguaaccgugacacauuccgucaacuuacuggaaaauucucacaacgggaaacuaugccuccugaagggaauagcgccccuucagcuggguaauuguucaguggccggcuggaucuuggggaacccugagugcgaacuccugauuaguaaagagagcugguccuauaucguugaaaagccaaauccggagaacggaaccuguuaccccggccauuuugcugauuaugaggaacugagagagcaacucucuucggugagcucauucgaaagguuugagauuuucccuaaggagaguuccuggccaaaucacacugucacaggugugucugccagcugcucccauaacggggaaucaaguuuuuaccggaauuuacuguggcuuaccggcaaaaacggauuguaucccaaucugagcaagucuuacgcaaacaacaaagagaaggaagugcuaguucucuggggcgugcaccacccuccaaauaucggggaccagaaagcccuguaucauacggagaacgcuuacgucuccguggugucaagccacuacagucgcaaguucacucccgaaauagcaaagcgaccuaaaguccgugaucaggagggaagaaucaauuauuacuggacccuucuggagccaggugacacaauuaucuuugaagccaacggcaauuugauugcuccgagguaugccuucgcgcucucucggggguuuggauccggcaucauaaacagcaaugcacccauggauaagugugacgccaaaugccagacuccucaaggugcuauuaacucgucucugccauuccagaauguucaucccgugaccaucggggaguguccuaaguacguacgcuccgccaaauuaagaauggugacaggacugaggaacauuccaucaauccagagucggggccucuuuggcgcaaucgcuggguucauugaaggagguuggaccggcauggucgaugggugguauggauaccaccaccagaaugagcaaggcagcgguuaugccgcggaccagaaguccacgcagaacgccauaaaugggaucacuaacaaaguaaauucuguuauugaaaagaugaacacacaguuuaccgcagugggcaaggaguucaacaaacuugagcgccgaauggaaaaucugaacaagaaagucgaugacggauucaucgauauauggacuuacaaugcugaguugcuagugcugcucgaaaacgagagaacacuggacuuucaugacagcaauguaaagaaccuuuacgaaaaaguuaagggccaacugaagaauaacgccaaagagauugggaauggaugcuucgaguuuuaucacaaguguaacgaugaaugcauggagucagugaaaaaugguaccuacgacuaucccaaguacagugaagaguccaaauugaacagggagaagaucgauggcgucaagcucgaaagcauggggguguaucagauccuggcuauuuacucuacggucgccucaaguuuagugcugcuaguuagccucggagcaaucuccuucuggaugugcucuaauggcucgcugcagugucggauuugcauauga

SEQ ID NO: 124036 - RNA, 1698 nt, Artificial Sequence; identical to SEQ ID NO: 123961
  derived and/or modified sequence opt3 from hemagglutinin__InfluenzaA__ABW39861

SEQ ID NO: 124037 - RNA, 1701 nt, Artificial Sequence; identical to SEQ ID NO: 123944
  derived and/or modified sequence opt3 from hemagglutinin__InfluenzaA__ABW39872

SEQ ID NO: 124038 - RNA, 1698 nt, Artificial Sequence
  derived and/or modified sequence opt3 from hemagglutinin__InfluenzaA__ABW39883
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccucacaacaucggggaucagcgcgcccuguaccauacugaaaacgcuuaugucuccguggugucaagccacuacagucgacguuucaccccagagauagcaaaaagacccaaggucagggaccaggaaggacggaucaauuauuacuggacacuucuggagccuggugauacuauuaucuuugaggccaacggcaauuugauugcuccacgcuucgccuuugcgcucucuagaggguucggauccggcaucauaaccagcaacgcaccgauggacgaaugugaugccaagugccagacaccccaaggugcuauuaauucgucucugccuuuucagaacguucauccagugaccaucggggagugucccaaauauguaagguccacgaaguuacggauggugacuggacugcgcaauauuccuucaauccagagucgaggccucuucggcgccaucgcaggguuuauugaaggagguuggacaggcauggucgacgggugguacggauaucaccaccagaacgagcaaggcagcgguuacgcugccgaucagaaauccacccagaaugcgauaaacgggaucacuaauaaggugaacucuguuauugaaaagaugaauacacaguucaccgccgugggcaaagaguucaacaaacuugagagaaggauggaaaaucugaacaagaaggucgacgauggauuuuuggacaucuggacguacaacgcagagcuacuggugcuccuggaaaaugagcggacccuugacuuccaugauagcaacguuaaaaaucuguaugaaaagguaaaaucacaauugaagaacaaugcuaaagagauaggcaacgggugcuuugaguucuaccacaaguguaaugacgaaugcauggagagugugaagaacggaacauaugauuacccaaaauauuccgaagagagcaagcucaaucgugagaaaauugacggugucaagcuggaaucuaugggcguguaccagaucuuagccaucuauucaacugucgcuaguagccuggugcuacucguuucccugggggccauuucuuuuuggaugugcucgaacggaagccuucagugucgcaucugcauuuga

SEQ ID NO: 124039 - RNA, 1698 nt, Artificial Sequence; identical to SEQ ID NO: 123971
  derived and/or modified sequence opt3 from hemagglutinin__InfluenzaA__ABW39894

SEQ ID NO: 124040 - RNA, 1698 nt, Artificial Sequence; identical to SEQ ID NO: 123926
  derived and/or modified sequence opt3 from hemagglutinin__InfluenzaA__ABW39905

SEQ ID NO: 124041 - RNA, 1698 nt, Artificial Sequence; identical to SEQ ID NO: 123930
  derived and/or modified sequence opt3 from hemagglutinin__InfluenzaA__ABW39927

SEQ ID NO: 124042 - RNA, 1701 nt, Artificial Sequence
  derived and/or modified sequence opt3 from hemagglutinin__InfluenzaA__ABW39938
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcgaaaauuguacccuaaucgacgcucuccugggggauccgcagugcgacggauuucaaaacaaaaagugggaucuuuucguggagagauccaaagccuauucuaauuguuaccccuaugacgucccugauuacgcaucgcugaggucauugguggccagcaguggcacucucgaauuuaacaaugaguccuucaacuggacagguguuacccagaaugggacgucuagcgcuugcauucggcgcuccaacaauucauuuuucagucgacugaacuggcugacucaucucaaguuuaaguauccagcauuaaaugugaccaugcccaacaacgagaaauucgacaagcuguacaucuggggaguccaccauccuggcacagauaaugaccagauuuuucuuuaugcccaggcuagcggccguaucacugugucuaccaaaagaucccaacagacaguaauaccaaacauugggucaaggccccggguucgcaauaucccuagcagaauuaguaucuacuggaccaucgugaagccaggagauauuuugcugauaaacucuacggguaaucuaaucgccccgaggggcuacuucaaaauucgguccggaaagagcucgaucaugcgcucugacgcgcccauagggaaguguaacuccgaaugcauuacuccuaauggcucaaucccaaacgacaaacccuuucagaaugucaaccgaaucacauauggugcauguccuagauacgugaagcagaauacccucaaacuggccacugggaugaggaacgugccagagaagcaaacacggggaauuuucggcgcuaucgccggcuuuauugaaaaugggugggagggaauggucgaugguugguauggcuuccgucaccagaacagugaggggauaggacaggcagcugaccuuaaaagcacccaagccgcgaucgaucagauuaauggcaagcugaaccgcuugaucgguaaaacgaacgaaaaguuccaccagaucgagaaggaauuuuccgagguugaagggaggauucaggaccucgagaaauacguggaggauaccaagauagaccuguggucuuauaaugccgaauuacugguagcacucgagaaccaacauacaaucgaucuuacugacagcgaaaugaauaaacuguucgagaagaccaaaaagcaguugagagaaaacgcugaggauaugggcaauggaugcuuuaagauuuaccacaaaugugacaacgccugcaucggcucaauucggaaugggacauaugaucaugacgcuuaccgagacgaggcccuaaacaaucgcuuccagaucaagggaguggaacugaaaagugguuacaaggauuggauacucuggaucuccuuugcaauuagcugcuuccugcuuugugucgcccuguugggcuuuaucaugugggcuugccagaaagggaacauuagauguaauaucugcauauga

SEQ ID NO: 124043 - RNA, 1698 nt, Artificial Sequence; identical to SEQ ID NO: 123930
  derived and/or modified sequence opt3 from hemagglutinin__InfluenzaA__ABW39949

SEQ ID NO: 124044 - RNA, 1698 nt, Artificial Sequence; identical to SEQ ID NO: 123971
  derived and/or modified sequence opt3 from hemagglutinin__InfluenzaA__ABW39960

SEQ ID NO: 124045 - RNA, 1698 nt, Artificial Sequence; identical to SEQ ID NO: 123926
  derived and/or modified sequence opt3 from hemagglutinin__InfluenzaA__ABW39982

SEQ ID NO: 124046 - RNA, 1698 nt, Artificial Sequence; identical to SEQ ID NO: 123946
  derived and/or modified sequence opt3 from hemagglutinin__InfluenzaA__ABW39993

SEQ ID NO: 124047 - RNA, 1698 nt, Artificial Sequence; identical to SEQ ID NO: 123926
  derived and/or modified sequence opt3 from hemagglutinin__InfluenzaA__ABW40004

SEQ ID NO: 124048 - RNA, 1698 nt, Artificial Sequence; identical to SEQ ID NO: 123972
  derived and/or modified sequence opt3 from hemagglutinin__InfluenzaA__ABW40015

SEQ ID NO: 124049 - RNA, 1701 nt, Artificial Sequence; identical to SEQ ID NO: 124003
  derived and/or modified sequence opt3 from hemagglutinin__InfluenzaA__ABW40026

SEQ ID NO: 124050 - RNA, 1698 nt, Artificial Sequence; identical to SEQ ID NO: 123926
  derived and/or modified sequence opt3 from hemagglutinin__InfluenzaA__ABW40037

SEQ ID NO: 124051 - RNA, 1698 nt, Artificial Sequence
  derived and/or modified sequence opt3 from hemagglutinin__InfluenzaA__ABW40048
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagaaagcccuguaccacacugaaaacgcuuaugucuccguggugucaagccauuacagucgccgauucacccccgagauagcaaagcguccuaaggucagagaccaggaaggaaggaucaauuauuacuggacacuucuggagccaggugauacuauuaucuuugaggccaacggcaauuugauugcuccgcgguucgccuuugcgcucucucgcggguucggauccggcaucauaaccagcaacgcacccauggacgaaugugaugccaaaugccagacaccucaaggugcuauuaauucgucucugccauuucagaacguucaccccgugaccaucggggaguguccuaaguauguaagauccacgaaauuaaggauggugacuggacugcggaauauuccaucaauccagagucgcggccucuucggcgccaucgcaggguuuauugaaggagguuggacaggcauggucgacgggugguacggauaucaucaccagaacgagaagggcagcgguuacgcugccgaucaaaaauccacccagaaugcgauaaacgggaucacuaauaaggugaacucuguuauugaaaagaugaauacacaguucaccgccgugggcaaggaguucaacaaacuugagcgaagaauggaaaaucugaacaaaaaggucgacgauggauuuuuggacaucuggacguacaacgcagagcuacuggugcuccuggaaaaugagaggacccuugacuuccacgauagcaacguuaaaaaucuguaugaaaagguaaaaucacaguugaagaacaaugcuaaggagauaggcaacgggugcuuugaguucuaccauaaauguaaugacgaaugcauggagagugugaagaacggaacauaugauuaccccaaauauuccgaagagagcaagcucaaucgggagaaaauugacggugucaagcuggaaucuaugggcguguaccaaaucuuagccaucuauucaacugucgcuaguagccuggugcuacucguuucccugggggccauuucuuuuuggaugugcucgaacggaagccuucagugucguaucugcauuuga

SEQ ID NO: 124052 - RNA, 1698 nt, Artificial Sequence; identical to SEQ ID NO: 123930
  derived and/or modified sequence opt3 from hemagglutinin__InfluenzaA__ABW40059

SEQ ID NO: 124053 - RNA, 1698 nt, Artificial Sequence
  derived and/or modified sequence opt3 from hemagglutinin__InfluenzaA__ABW40070
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucaagagguuugaaauuuucccuaaagagaguuccuggccaaaccacacugucacaggugugucugccagcugcucccauaauggggagucaaguuuuuaucggaacuuacuguggcuuaccggaaagaauggcuuguaccccaaccugagcaaaucuuaugcaaauaacaaggaaaaagagguucuaguacucuggggcgugcaccacccuccaaacaucggggaccagaaggcccuguaccauacggaaaaugcuuacgucuccguggugucaagccacuauagucgcaaguucacucccgagauagcaaaacgaccuaagguccgugaucaggaaggaagaaucaacuacuauuggacccuucuggagccaggugacacaauuaucuuugaggccaauggcaacuugauugcuccgagguacgccuucgcgcucucucggggguuuggauccggcaucauaaauagcaacgcacccauggauaaaugugacucgaagugccagacuccucaaggugccauuaauucuucccugccauuccagaacguucaucccgugaccaucggggaauguccuaaauauguacgcucagcuaaguuaagaauggugacaggacugaggaauauuccaaguauccagagccggggccucuuuggcgccaucgcaggguucauugagggagguuggaccggcauggucgaugggugguacggauaucaccaccagaacgaacaaggcuccgguuacgcugccgaccagaaaucuacgcagaaugcgauaaacgggaucacuaauaaggugaacagcguuauugagaagaugaauacacaguuuaccgccgugggcaaagaguucaacaaacuugaacgccgaauggagaaccugaauaaaaaggucgaugacggauucaucgauauauggacuuacaacgcagaauugcuagugcugcucgagaaugaaagaacacuggacuuucaugacucaaacguaaagaaucuuuaugagaagguuaagagucaacugaaaaacaaugcuaaggaaauuggcaacgggugcuucgaguuuuaccacaaauguaaugaugagugcauggaauccgugaagaacggaaccuaugacuaccccaaauauagcgaggaaucuaaguugaauagggagaagaucgauggugucaaacucgagucaaugggcguguaccagauccuggccauuuauaguacggucgcuagcuccuuagugcugcuaguuucucucggggccaucucguucuggaugugcagcaacggaucccugcagugucggauuugcauauga

SEQ ID NO: 124054 - RNA, 1701 nt, Artificial Sequence; identical to SEQ ID NO: 123944
  derived and/or modified sequence opt3 from hemagglutinin__InfluenzaA__ABW40081

SEQ ID NO: 124055 - RNA, 1698 nt, Artificial Sequence
  derived and/or modified sequence opt3 from hemagglutinin__InfluenzaA__ABW40092
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucaagagguuugaaaucuucccuaaggagaguuccuggccaaaucauacagugaccggugucucugccagcugcucccacaacgggaaaucaaguuuuuaccggaauuuacuguggcuuacgggaaagaacggcuuguaucccaaucugagcaaaucuuacgcaaacaauaaggagaaagaagugcuaguacucuggggcguucaucacccuccaaacauaggggaucagcgcgcccuguaccacacugagaacgcuuauguguccgucgugucaagccauuacagucgacguuucacccccgaaaucgcaaagagaccuaaggugagggaccaggagggacggauuaauuauuacuggacacuucuggaaccaggugauacuaucauuuuugaggccaacggcaauuugaucgcuccgcgcuucgccuuugcgcucucuagaggguucggauccggcauaauuaccagcaacgcacccauggacgagugugaugccaaaugccagacaccucaaggugcuaucaauucgucucugccauuucagaacguccaccccguuaccauuggggaauguccuaaguaugugagguccacgaaauuacggaugguaacuggacugcgcaauaucccaucaauccagagucgaggccucuucggcgccauugcaggguuuauagagggagguuggacaggcaugguggacgggugguacggauaucaucaccagaacgaacaaggcagcgguuacgcugccgaucagaaguccacccagaaugcgaucaacgggauuacuaauaaagucaacucugugaucgagaagaugaauacacaguucaccgccguuggcaaagaguucaacaaacuugaaagaaggauggagaaucugaacaagaagguggacgauggauuuuuggacauauggacguacaacgcagaacuacugguccuccuggagaaugaacggacccuugacuuccacgauagcaacgugaagaaucuguaugagaaaguaaagucacaauugaaaaacaaugcuaaggaaauuggcaacgggugcuuugaguucuaccauaaguguaaugacgagugcauggaaaguguuaaaaacggaacauaugauuaccccaaguauuccgaggaaagcaaacucaaucgugagaagaucgacggugugaaacuggagucuaugggcgucuaccagaucuuagccauuuauucaacuguggcuaguagccugguccuacucgugucccugggggccaucucuuuuuggaugugcucgaacggaagccuucagugucgcauuugcauauga

SEQ ID NO: 124056 - RNA, 1698 nt, Artificial Sequence; identical to SEQ ID NO: 123973
  derived and/or modified sequence opt3 from hemagglutinin__InfluenzaA__ABW40103

SEQ ID NO: 124057 - RNA, 1698 nt, Artificial Sequence
  derived and/or modified sequence opt3 from hemagglutinin__InfluenzaA__ABW40114
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucuacgagcugcucccacaacgggaagucaaguuuuuaccggaauuuacuguggcuuacuggcaaaaacggauuguaucccaaucugagcaagucuuacgccaacaauaaagaaaaggaggugcuaguacucuggggcguucaucacccuccaaacauagggaaccagcgcgcacuguaccacaccgaaaaugccuauguguccgucgugucaagccauuacagucgacguuucacacccgagaucgcuaaaagaccuaaggugagggaucaggaaggacggauuaacuauuacuggacucuucuggagccaggugacaccaucauuuuugaggcaaauggcaacuugaucgccccgcgcuucgcuuuugcccucucuagaggguucggauccggcauaauuacaagcaaugcgcccauggaugaaugugacgcaaagugccagaccccucaaggugccaucaacucgucucugccauuucagaauguccaccccguuacgauuggggaguguccuaaauaugugagguccacuaaguuacggaugguaacaggacugcgcaacaucccaucaauccagagucgaggccucuucggcgcuauugccggguuuauagaaggagguuggaccggcaugguggaugggugguacggauaucaucaccagaaugagcaaggcagcgguuacgcagcugaccagaaauccacucagaacgccaucaaugggauuacaaacaaggucaauucugugaucgaaaagaugaacacccaguucacggcgguuggcaaagaguucaauaaacuugagagaaggauggaaaaccugaacaagaagguggaugacggauuuuuggauauauggaccuacaaugccgagcuacugguccuccuggaaaacgagcggacacuugacuuccacgacagcaaugugaaaaaccuguaugaaaagguaaaaucacaauugaagaauaacgcaaaagagauuggcaaugggugcuuugaguucuaccauaaguguaacgaugaaugcauggagaguguuaagaauggaacuuaugacuaccccaaauauuccgaagagagcaagcucaaccgugagaaaaucgauggugugaagcuggaaucuaugggcgucuaccagaucuuagcuauuuauucaaccguggccaguagccugguccuacucgugucccugggggcuaucucuuuuuggaugugcucgaauggaagccuucagugucgcauuugcauauga

SEQ ID NO: 124058 - RNA, 1698 nt, Artificial Sequence; identical to SEQ ID NO: 123926
  derived and/or modified sequence opt3 from hemagglutinin__InfluenzaA__ABW40125

SEQ ID NO: 124059 - RNA, 1701 nt, Artificial Sequence; identical to SEQ ID NO: 123944
  derived and/or modified sequence opt3 from hemagglutinin__InfluenzaA__ABW40136

SEQ ID NO: 124060 - RNA, 1698 nt, Artificial Sequence; identical to SEQ ID NO: 123961
  derived and/or modified sequence opt3 from hemagglutinin__InfluenzaA__ABW40147

SEQ ID NO: 124061 - RNA, 1698 nt, Artificial Sequence; identical to SEQ ID NO: 123930
  derived and/or modified sequence opt3 from hemagglutinin__InfluenzaA__ABW40158

SEQ ID NO: 124062 - RNA, 1698 nt, Artificial Sequence; identical to SEQ ID NO: 123930
  derived and/or modified sequence opt3 from hemagglutinin__InfluenzaA__ABW40180

SEQ ID NO: 124063 - RNA, 1701 nt, Artificial Sequence; identical to SEQ ID NO: 123944
  derived and/or modified sequence opt3 from hemagglutinin__InfluenzaA__ABW40191

SEQ ID NO: 124064 - RNA, 1698 nt, Artificial Sequence; identical to SEQ ID NO: 123946
  derived and/or modified sequence opt3 from hemagglutinin__InfluenzaA__ABW40202

SEQ ID NO: 124065 - RNA, 1698 nt, Artificial Sequence; identical to SEQ ID NO: 123926
  derived and/or modified sequence opt3 from hemagglutinin__InfluenzaA__ABW40213

SEQ ID NO: 124066 - RNA, 1698 nt, Artificial Sequence; identical to SEQ ID NO: 123926
  derived and/or modified sequence opt3 from hemagglutinin__InfluenzaA__ABW40224

SEQ ID NO: 124067 - RNA, 1698 nt, Artificial Sequence; identical to SEQ ID NO: 123930
  derived and/or modified sequence opt3 from hemagglutinin__InfluenzaA__ABW40235

SEQ ID NO: 124068 - RNA, 1701 nt, Artificial Sequence
  derived and/or modified sequence opt3 from hemagglutinin__InfluenzaA__ABW40246
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaagcuguacauuuggggaguccaccauccuggcacagauaaugaccagguguuuuuguaugcccaggcuagcggccguaucacuguaucuaccaaaagaucccaacagacaguuauuccaaacaucgggucaaggccccgggugcgcaauauaccuagcagaauuaguaucuacuggaccauugucaagccaggagauauccugcuaaucaacucuacggguaaucucauugccccgaggggcuacuuccggauacgcuccgggaaaagcucgaucaugcgaucugacgcgcccauuggaaaguguaacuccgaaugcaucacuccuaauggcucaauaccaaacgacaagcccuuucagaaugugaacagaauuacauauggugcauguccuagguacgugaaacagaauacccugaaacuugccacugggaugcggaacgucccagagaagcaaacacguggaaucuucggcgcuaucgccggcuuuauugaaaaugggugggagggaaugguugaugguugguauggcuuccgccaccagaacagugaggggaucggacaggcagcugaccuuaagagcacccaagccgcgauugaucagauaaauggcaaauugaacagacucaucgguaagacgaacgaaaaauuccaccagauugagaaggaauuuuccgagguggaagggaggauccaggaccuggagaaguacguagaggauaccaaaaucgacuuauggucuuauaaugccgaacugcucguggcacuugagaaccaacauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucaugacgucuaccgcgacgaggcucugaacaauagauuccagaucaaaggaguggaacucaagagugguuacaaagauuggauucuguggaucuccuuugccauaagcugcuuccuucuguguguugcauugcucggcuuuaucaugugggccugccagaaggggaacauuagguguaauaucugcauuuga

SEQ ID NO: 124069 - RNA, 1698 nt, Artificial Sequence
  derived and/or modified sequence opt3 from hemagglutinin__InfluenzaA__ABW40257
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccacgaaguuacggaugguaacuggacugcgcaauaucccaucaauccagagucgaggccucuucggcgccauugcaggguuuauagaaggagguuggacaggcaugguggacgggugguacggauaucaucaccagaacgagcaaggcagcgguuacgcugccgaucagaaauccacccagaaugcgaucaacgggauuacuaauaaggucaacucuaucauagaaaagaugaauacacaguucaccgccgugggcaaagaguucaacaaacuugagagaaggauggaaaaucugaacaagaagguugacgauggauuuuuggacauuuggacguacaacgcagagcuacuggugcuccuggaaaaugagcggacccuugacuuccacgauagcaacgucaaaaaucuguaugaaaaggugaaaucacaauugaagaacaaugcuaaagagaucggcaacgggugcuuugaguucuaccauaaguguaaugacgaaugcauggagaguguaaagaacggaacauaugauuaccccaaauauuccgaagagagcaagcucaaucgugagaaaaucgacgguguuaagcuggaaucuaugggcguguaccagauuuuagccaucuauucaacugucgcuaguagccuggugcuacucgucucccugggggccauuucuuuuuggaugugcucgaacggaagccuucagugucgcauaugcaucuga

SEQ ID NO: 124070 - RNA, 1701 nt, Artificial Sequence; identical to SEQ ID NO: 124003
  derived and/or modified sequence opt3 from hemagglutinin__InfluenzaA__ABW40268

SEQ ID NO: 124071 - RNA, 1698 nt, Artificial Sequence
  derived and/or modified sequence opt3 from hemagglutinin__InfluenzaA__ABW40312
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggcggucaaguuuuuaccgcaauuuacuguggcuuacgggaaagaacggcuuguaucccaaucugagcaaaucuuacgcaaacaauaaggaaaaagagguacuuguucucuggggcgugcaucacccuccaaacaucggggaucagcgagcccuguaccacacugaaaacgcuuaugucuccguggugucaagccauuacagucguagauucacccccgagauagcaaagaggccuaaaguccgggaccaggaaggacgcaucaauuauuacuggacacuucuggagccaggugauacuauuaucuuugaggccaacggcaauuugauugcuccgagauucgccuuugcgcucucuaggggguucggauccggcaucauaaccagcaacgcacccauggacgaaugugaugccaagugccagacaccucaaggugcuauuaauucgucucugccauuucagaacguucaccccgugaccaucggggaguguccuaaguauguacgguccacgaaauuacgcauggugacuggacugcgaaauauuccaucaauccagaguagaggccucuucggcgccaucgcaggguuuauugaaggagguuggacaggcauggucgacgggugguacggauaucaucaccagaacgagcaaggcagcgguuacgcugccgaucagaaguccacccagaaugcgauaaacgggaucacuaauaaagugaacucuguuauugaaaagaugaauacacaguucaccgccgugggcaaagaguucaacaagcuagagaggcggauggaaaaucugaacaaaaaggucgacgauggauuuuuggacaucuggacguacaacgcagagcuacuggugcuccuggaaaaugagcguacccuugacuuccacgauagcaacguaaagaaucuguaugaaaaaguuaagucacaauugaaaaacaaugcuaaggagauaggcaacgggugcuuugaguucuaccauaaauguaaugacgaaugcauggagagugugaagaacggaacauaugauuaccccaaguauuccgaagagagcaaacucaaucgcgagaagauugacggugucaaacuggaaucuaugggcguguaccagaucuuagccaucuauucaacugucgcuaguagccuggugcuacucguuucccugggggccauuucuuuuuggaugugcucgaacggaagccuucaguguagaaucugcauuuga

SEQ ID NO: 124072 - RNA, 1701 nt, Artificial Sequence; identical to SEQ ID NO: 123944
  derived and/or modified sequence opt3 from hemagglutinin__InfluenzaA__ABW40323

SEQ ID NO: 124073 - RNA, 1698 nt, Artificial Sequence; identical to SEQ ID NO: 123972
  derived and/or modified sequence opt3 from hemagglutinin__InfluenzaA__ABW40334

SEQ ID NO: 124074 - RNA, 1698 nt, Artificial Sequence; identical to SEQ ID NO: 123972
  derived and/or modified sequence opt3 from hemagglutinin__InfluenzaA__ABW40345

SEQ ID NO: 124075 - RNA, 1698 nt, Artificial Sequence
  derived and/or modified sequence opt3 from hemagglutinin__InfluenzaA__ABW40356
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguaauguggggcgugcaucacccuccaaacaucggggaucagcgcgcccucuaccacacugaaaacgcuuaugucuccguggugucaagccauuacagucgacguuucacccccgagauagcaaaaagaccuaaggucagggaccaggaaggacggaucaauuauuacuggacacugcuugagccaggugauacuauuaucuuugaggccaacggcaaucugauugcuccgcgcuucgccuuugcguugucuagaggguucggauccggcaucauaaccagcaacgcacccaugggugaaugugacgccaagugccagacaccucaaggggcuauuaauucgucucucccauuucagaacguucaccccgugaccaucggagaguguccuaaauauguaagguccgccaagcugcggauggugacgggcuuacgcaauauuccaucaauccagagucgaggccuguucggggcaaucgcuggauuuauugaagguggcuggacugggauggucgauggaugguacggcuaucaucaccagaacgagcaagguagcggguacgccgcggaccagaaauccacacagaaugccauaaacggcaucaccaauaaggugaacucuguuauugaaaagaugaauacucaguucacagcagugggaaaagaguucaacaaacucgagagaaggauggaaaaucuuaacaagaaggucgaugacggcuuucuggauaucuggaccuacaacgcugaguugcuagugcugcucgaaaaugagcggacgcuggacuuccacgacagcaacguuaaaaaucuuuaugaaaagguaaaaucacaacugaagaacaaugccaaagagauagggaacggaugcuuugaguucuaccauaaguguaaugaugaaugcauggagagugugaagaacgguaccuaugacuaccccaaauauuccgaagagagcaaguugaaucgugagaaaauugauggcgucaagcucgaaucuauggggguguaccagauccuggcuaucuauucaacagucgccaguagcuuagugcugcuaguuucccucggagcaauuucuuuuuggaugugcucgaacggcagccugcagugucgcaucugcauuuga

SEQ ID NO: 124076 - RNA, 1698 nt, Artificial Sequence; identical to SEQ ID NO: 123930
  derived and/or modified sequence opt3 from hemagglutinin__InfluenzaA__ABW40367

SEQ ID NO: 124077 - RNA, 1701 nt, Artificial Sequence; identical to SEQ ID NO: 123944
  derived and/or modified sequence opt3 from hemagglutinin__InfluenzaA__ABW40378

SEQ ID NO: 124078 - RNA, 1698 nt, Artificial Sequence; identical to SEQ ID NO: 123930
  derived and/or modified sequence opt3 from hemagglutinin__InfluenzaA__ABW40389

SEQ ID NO: 124079 - RNA, 1698 nt, Artificial Sequence; identical to SEQ ID NO: 123926
  derived and/or modified sequence opt3 from hemagglutinin__InfluenzaA__ABW40400

SEQ ID NO: 124080 - RNA, 1698 nt, Artificial Sequence; identical to SEQ ID NO: 123926
  derived and/or modified sequence opt3 from hemagglutinin__InfluenzaA__ABW40411

SEQ ID NO: 124081 - RNA, 1698 nt, Artificial Sequence; identical to SEQ ID NO: 123926
  derived and/or modified sequence opt3 from hemagglutinin__InfluenzaA__ABW40422

SEQ ID NO: 124082 - RNA, 1698 nt, Artificial Sequence; identical to SEQ ID NO: 123972
  derived and/or modified sequence opt3 from hemagglutinin__InfluenzaA__ABW40433

SEQ ID NO: 124083 - RNA, 1698 nt, Artificial Sequence; identical to SEQ ID NO: 123946
  derived and/or modified sequence opt3 from hemagglutinin__InfluenzaA__ABW40444

SEQ ID NO: 124084 - RNA, 1698 nt, Artificial Sequence; identical to SEQ ID NO: 123963
  derived and/or modified sequence opt3 from hemagglutinin__InfluenzaA__ABW40455

SEQ ID NO: 124085 - RNA, 1698 nt, Artificial Sequence; identical to SEQ ID NO: 123930
  derived and/or modified sequence opt3 from hemagglutinin__InfluenzaA__ABW40466

SEQ ID NO: 124086 - RNA, 1698 nt, Artificial Sequence; identical to SEQ ID NO: 123930
  derived and/or modified sequence opt3 from hemagglutinin__InfluenzaA__ABW40477

SEQ ID NO: 124087 - RNA, 1698 nt, Artificial Sequence; identical to SEQ ID NO: 123926
  derived and/or modified sequence opt3 from hemagglutinin__InfluenzaA__ABW40488

SEQ ID NO: 124088 - RNA, 1698 nt, Artificial Sequence; identical to SEQ ID NO: 123930
  derived and/or modified sequence opt3 from hemagglutinin__InfluenzaA__ABW40499

SEQ ID NO: 124089 - RNA, 1698 nt, Artificial Sequence; identical to SEQ ID NO: 123972
  derived and/or modified sequence opt3 from hemagglutinin__InfluenzaA__ABW40510

SEQ ID NO: 124090 - RNA, 1698 nt, Artificial Sequence; identical to SEQ ID NO: 123926
  derived and/or modified sequence opt3 from hemagglutinin__InfluenzaA__ABW40521

SEQ ID NO: 124091 - RNA, 1698 nt, Artificial Sequence; identical to SEQ ID NO: 123930
  derived and/or modified sequence opt3 from hemagglutinin__InfluenzaA__ABW40532

SEQ ID NO: 124092 - RNA, 1698 nt, Artificial Sequence
  derived and/or modified sequence opt3 from hemagglutinin__InfluenzaA__ABW40543
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugaccucaaaagagaguuggagcuacauuguugaaacuccaaauccggagaacggaacauguuaucccggcuacuuugcugacuaugaggaacugagggagcaacucuccucugugucgucauucgaacgguuugagaucuucccuaaggagagcaguuggccaaaucauaccgucacggguguguccgccucuugcagccacaacgggaaguccucauuuuaccgcaauuuacuguggcuuacuggcaaaaacggauuguaucccaaucugaguaagagcuacgcaaacaauaaagaaaaggagguucuaguacucuggggcgugcaucacccuccaaacauuggggaucagcgagcccuguaccacaccgaaaacgcuuaugucucugugguguccucacauuacagccguagauucacacccgagaucgcaaaaaggccuaagguccgggaccaggaaggacgcauaaauuauuacuggacucuucuggagccaggugauaccaucauuuuugaggccaacggcaauuugaucgcuccgagauucgccuuugcgcucaguaggggguucggaucuggcauuaucacauccaacgcacccauggacgaaugugaugccaagugccagaccccucaaggugcuauaaauagcucgcugccauuucagaacguucaccccgugacgauuggggaguguccuaaauauguacggucugccaaguuacgcauggugacuggacugcgaaauaucccauccauucagucaagaggccucuucggcgcaaucgcuggguuuaucgaaggagguuggacaggcauggucgacgggugguacggauaucaucaccagaacgagcaaggcagugguuacgccgcggaucagaaaagcacccagaaugccauuaacgggauaacuaauaaggugaacuccguuaucgaaaagaugaauacacaguucaccgcagugggcaaagaguucaacaaacuugagaggcggauggaaaaucugaacaagaaggucgacgauggauuuuuggacauuuggacguacaacgcugagcuacuggugcuccuggaaaaugagcguacccuugacuuccacgauucuaacguuaaaaaucuguaugaaaagguaaaaagccaauugaagaacaaugccaaagagaucggcaacgggugcuuugaguucuaccauaaguguaaugacgaaugcauggagucagugaagaacggaacauaugauuaccccaaauauagugaagaguccaagcucaaucgcgagaaaauagacggugucaagcuggaaagcaugggcguguaccagauuuuagcuaucuauucuacugucgccucaagucuggugcuacucguuagccugggggcaaucuccuuuuggaugugcucuaacggaucgcuucaguguagaauuugcaucuga

SEQ ID NO: 124093 - RNA, 1698 nt, Artificial Sequence; identical to SEQ ID NO: 124071
  derived and/or modified sequence opt3 from hemagglutinin__InfluenzaA__ABW40554

SEQ ID NO: 124094 - RNA, 1698 nt, Artificial Sequence; identical to SEQ ID NO: 123930
  derived and/or modified sequence opt3 from hemagglutinin__InfluenzaA__ABW40565

SEQ ID NO: 124095 - RNA, 1698 nt, Artificial Sequence
  derived and/or modified sequence opt3 from hemagglutinin__InfluenzaA__ABW40576
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcagcuucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacaccuauguguccgucgugucaagccauuacagucgacguuucacacccgagaucgcuaaaagaccuaaggugagggaccaggaaggacggauuaauuauuacuggacucuucuggagccaggugauaccaucauuuuggaggcaaacggcaaucucaucgccccgcgcuuugcuuucgcccugucuagaggguuuggauccggcauaauuacaagcaacgcgcccauggacgaaugugaugcaaagugccagaccccucaaggugccaucaauucgucuuuaccauuccagaacguccaccccguuacgauuggggaguguccuaaauaugugagguccacuaagcugcggaugguaacaggacuccgcaauaucccaucaauccagagucgaggccuuuuuggcgcuauugccggguucauagaaggagguuggaccggcaugguggacgggugguacggauaucaucaccagaacgagcaaggcagcgguuacgcagcugaucagaaauccacucagaaugccaucaacgggauuacaaauaaggucaacucugugaucgaaaagaugaauacccaguuuacggcgguuggcaaagaguucaacaaacuggagagaaggauggaaaauuugaacaagaagguggacgauggauuccuagacauauggaccuacaacgccgagcugcucguccugcuugaaaaugagcggacacuggacuuucacgauagcaacgugaaaaauuuguaugaaaagguaaaaucacaacucaagaacaaugcaaaagagauuggcaacgggugcuucgaguuuuaccauaaguguaaugacgaaugcauggagaguguuaagaacggaacuuaugauuaccccaaauauuccgaagagagcaagcugaaucgugagaaaaucgacggugugaaguuagaaucuaugggcgucuaccagauccuggcuauuuauucaaccguggccaguagccuaguccuccuggugucccuuggggcuaucucuuucuggaugugcucgaacggaucauugcagugucgcauuugcauauga

SEQ ID NO: 124096 - RNA, 1701 nt, Artificial Sequence; identical to SEQ ID NO: 124003
  derived and/or modified sequence opt3 from hemagglutinin__InfluenzaA__ABW40587

SEQ ID NO: 124097 - RNA, 1698 nt, Artificial Sequence; identical to SEQ ID NO: 123972
  derived and/or modified sequence opt3 from hemagglutinin__InfluenzaA__ABW40598

SEQ ID NO: 124098 - RNA, 1698 nt, Artificial Sequence; identical to SEQ ID NO: 123946
  derived and/or modified sequence opt3 from hemagglutinin__InfluenzaA__ABW40609

SEQ ID NO: 124099 - RNA, 1698 nt, Artificial Sequence; identical to SEQ ID NO: 123961
  derived and/or modified sequence opt3 from hemagglutinin__InfluenzaA__ABW40620

SEQ ID NO: 124100 - RNA, 1701 nt, Artificial Sequence; identical to SEQ ID NO: 124003
  derived and/or modified sequence opt3 from hemagglutinin__InfluenzaA__ABW40631

SEQ ID NO: 124101 - RNA, 1698 nt, Artificial Sequence; identical to SEQ ID NO: 123926
  derived and/or modified sequence opt3 from hemagglutinin__InfluenzaA__ABW40642

SEQ ID NO: 124102 - RNA, 1701 nt, Artificial Sequence; identical to SEQ ID NO: 124003
  derived and/or modified sequence opt3 from hemagglutinin__InfluenzaA__ABW40653

SEQ ID NO: 124103 - RNA, 1698 nt, Artificial Sequence; identical to SEQ ID NO: 123972
  derived and/or modified sequence opt3 from hemagglutinin__InfluenzaA__ABW40664

SEQ ID NO: 124104 - RNA, 1698 nt, Artificial Sequence; identical to SEQ ID NO: 123946
  derived and/or modified sequence opt3 from hemagglutinin__InfluenzaA__ABW40675

SEQ ID NO: 124105 - RNA, 1698 nt, Artificial Sequence; identical to SEQ ID NO: 124075
  derived and/or modified sequence opt3 from hemagglutinin__InfluenzaA__ABW71294

SEQ ID NO: 124106 - RNA, 1698 nt, Artificial Sequence; identical to SEQ ID NO: 123972
  derived and/or modified sequence opt3 from hemagglutinin__InfluenzaA__ABW71305

SEQ ID NO: 124107 - RNA, 1698 nt, Artificial Sequence
  derived and/or modified sequence opt3 from hemagglutinin__InfluenzaA__ABW71316
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccacgcgauacuaucauuuuugaggccaacgguaauuugaucgcuccgagauucgccuuugcgcucucuaggggcuucggguccggaauaauuaccagcaacgcacccauggacgaaugugaugccaagugccagacaccucaaggcgcuaucaauucgucucugccauuucagaacguccaccccguuaccauuggugaguguccuaaauaugugcgguccacgaaguuacgcaugguaacugggcugcgaaauaucccaucaauccagaguagaggacucuucggcgccauugcaggcuuuauagaagggggauggacagguaugguggacggcugguacggguaucaucaccagaacgagcaaggaagcggcuacgcugccgaucagaaauccacccagaaugcgaucaacgguauuacuaauaaggucaacucugugaucgaaaagaugaauacacaguucaccgccguugggaaagaguucaacaaacuugagaggcggauggaaaaucugaacaagaagguggacgauggcuuuuuggacauauggacguacaacgcagagcuacugguccuccuggaaaaugagcguacccuugacuuccacgauagcaacgugaaaaaucuguaugaaaagguaaaaucacaauugaagaacaaugcuaaagagauuggaaacggcugcuuugaguucuaccauaaguguaaugacgaaugcauggagaguguuaagaacgggacauaugauuaccccaaauauuccgaagagagcaagcucaaucgcgagaaaaucgacggagugaagcuggaaucuaugggugucuaccagaucuuagccauuuauucaacuguggcuaguagccugguccuacucgugucccugggcgccaucucuuuuuggaugugcucgaacgggagccuucaguguagaauuugcauauga

SEQ ID NO: 124108 - RNA, 1698 nt, Artificial Sequence; identical to SEQ ID NO: 123926
  derived and/or modified sequence opt3 from hemagglutinin__InfluenzaA__ABW71327

SEQ ID NO: 124109 - RNA, 1698 nt, Artificial Sequence; identical to SEQ ID NO: 123930
  derived and/or modified sequence opt3 from hemagglutinin__InfluenzaA__ABW71338

SEQ ID NO: 124110 - RNA, 1701 nt, Artificial Sequence; identical to SEQ ID NO: 123944
  derived and/or modified sequence opt3 from hemagglutinin__InfluenzaA__ABW71349

SEQ ID NO: 124111 - RNA, 1698 nt, Artificial Sequence
  derived and/or modified sequence opt3 from hemagglutinin__InfluenzaA__ABW71360
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugauuucaaaagagaguuggagcuacaucguugaaaccccaaauccggagaacggaacuuguuaucccggcuacuuugcugacuaugaggaacugagggagcaacucuccucugugucgucauucgaacgguuugagauuuucccuaaggagagcaguuggccaaaucauacagucaccgguguguccgccucuugcagccacaacgggaaguccucauuuuaccgcaauuuacuguggcuuacgggaaagaacggcuuguaucccaaucugagucgaagcuacgcaaacaauaaggaaaaagagguacuuguucucuggggcgugcaucacccuccaaacaucggggaucagcgugcccuguaccacacugaaaacgcuuaugucucugugguguccucacauuacagcagaagguucacccccgagauagcaaagcggccuaaaguccgcgaccaggaaggaagaaucaauuauuacuggacacuucuggagccaggugauacuauuaucuuugaggccaacggcaauuugauugcuccgagguucgccuuugcgcucagucggggguucggaucuggcaucauaaccuccaacgcacccauggacgaaugugaugccaagugccagacaccucaaggugcuauuaauagcucgcugccauuucagaacguucaccccgugaccaucggggaguguccuaaguauguacgcucugccaaauuacgaauggugacgggacugagaaauauuccauccauccagucaaggggccucuucggcgcaaucgcuggguuuauugaaggagguuggacuggcauggucgacgggugguacggauaucaucaccagaacgagcaaggcagugguuacgccgcggaucagaaaagcacacagaaugccauaaacgggaucaccaauaaagugaacuccguuauugaaaagaugaauacucaguucacagcagugggcaaagaguucaacaagcuagagcggcguauggaaaaucugaacaaaaaggucgacgauggauuuuuggacaucuggaccuacaacgcugagcuacuggugcuccuggaaaaugagcgcacgcuugacuuccacgauucuaacguaaagaaucuguaugaaaaaguuaagagccaauugaaaaacaaugccaaggagauaggcaacgggugcuuugaguucuaccauaaaugugacgaugaaugcauggagucagugaagaauggaaccuaugacuaccccaaguauagugaagaguccaaacucaacagagagaagauugauggugucaaacuggaaagcaugggcguguaccagaucuuagcuaucuauucuacagucgccucaagucuggugcuacucguuagccugggggcaauuuccuuuuggaugugcucuaauggaucgcuucaguguaggaucugcauuuga

SEQ ID NO: 124112 - RNA, 1698 nt, Artificial Sequence; identical to SEQ ID NO: 123946
  derived and/or modified sequence opt3 from hemagglutinin__InfluenzaA__ABW71371

SEQ ID NO: 124113 - RNA, 1698 nt, Artificial Sequence
  derived and/or modified sequence opt3 from hemagglutinin__InfluenzaA__ABW71382
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggucuaaucauacaauaaccggugugagcgccuccugcucacacaacgggaagaguagcuuuuaccggaauuuacuguggcuuacgggcaaaaacggauuguauccaaaucugucuaaguccuacgcaaacaauaaagaaaaggagguccuagugcucuggggcguacaucaucccccuaacaucggggaucagcgcgcccuguaccacacugaaaacgcuuauguuucaguggucagcagucacuacucucgacguuucaccccagagauugcaaaaagacccaaggugagggaccaggaaggacggaucaauuauuacuggacacuucuggagccuggugauacuauuaucuuugaggccaacggcaauuugauagcuccacgcuucgccuuugcgcucuccagaggguucggaagcggcauuaucaccucgaacgcaccgauggacgaaugugaugccaagugccagacaccccaaggugcuauuaauucuucccugccuuuucagaacgugcacccagucaccaucggggagugucccaaauauguuaggucaacgaaguuacggauggugacuggacugcgcaauaucccuaguauucagagccgaggccucuucggcgccauagcaggguuuaucgaaggagguuggacaggcaugguagacgggugguacggauaucaucaccagaacgagcaaggcuccgguuacgcugccgaucagaaaucuacccagaaugcgauuaacgggaucacuaauaaggugaacagcgucauagaaaagaugaauacacaguucaccgccgugggcaaagaguucaacaaacuugagagaaggauggaaaaucugaacaagaagguugacgauggauuuuuggacauuuggacguacaacgcagagcuacuggugcuccuggaaaaugagcggacccuugacuuccacgauucaaacgucaaaaaucuguaugaaaaggugaaaagucaauugaagaacaaugcuaaagagaucggcaacgggugcuuugaguucuaccauaaguguaaugacgaaugcauggaguccguaaagaacggaacauaugauuacccaaaauauagcgaagagucuaagcucaaucgugagaaaaucgacgguguuaagcuggaaucaaugggcguguaccagauuuuagccaucuauaguacugucgcuagcucccuggugcuacucgucucucugggggccauuucguuuuggaugugcagcaacggaucccuucagugucgcauaugcaucuga

SEQ ID NO: 124114 - RNA, 1698 nt, Artificial Sequence
  derived and/or modified sequence opt3 from hemagglutinin__InfluenzaA__ABW71393
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuuacagacuaugaggaacugagagagcaacucucuucggugagcucauucgaaagguuugagauuuucccuaaggagaguuccuggccaaaucauaccgucacgggugugucugcuagcugcucccacaacgggaagucaaguuuuuaccggaauuuacuguggcuuacuggcaaaaacggauuguaucccaaucugagcaagucuuacgccaacaauaaagaaaaggagguucuaguacucuggggcgugcaucacccuccaaacaucggggaucagcgcgcacuguaccacaccgaaaacgccuaugucuccguggugucaagccauuacagucgacguuucacacccgagauagcuaaaagaccuaaggucagggaccaggaaggacggaucaauuauuacuggacucuucuggagccaggugauaccauuaucuuugaggcaaacggcaauuugauugccccgcgcuucgcuuuugcccucucuagaggguucggauccggcaucauaacaagcaacgcgcccaugggugaaugugacgcaaagugccagaccccucaaggggccauuaauucgucucugccauuucagaacguucaccccgugacgaucggagaguguccuaaauauguaagguccgcuaaguuacggauggugacuggccugcgcaauauuccaucaauccagagucgaggccucuucggggccaucgcaggauuuauugaagguggcuggacagggauggucgauggaugguacggcuaucaucaccagaacgagcaagguagcggguacgcugccgaccagaaauccacccagaaugcgauaaacggcaucacuaauaaggugaacucuguuauugaaaagaugaauacacaguucaccgccgugggaaaagaguucaacaaacuugagagaaggauggaaaaucugaacaagaaggucgaugacggcuuuuuggauaucuggacguacaacgcagagcuacuggugcuccuggaaaaugagcggacccuugacuuccacgacagcaacguuaaaaaucuguaugaaaagguaaaaucacaauugaagaacaaugcuaaagagauagggaacggaugcuuugaguucuaccauaaguguaaugaugaaugcauggagagugugaagaacgguacauaugacuaccccaaauauuccgaagagagcaagcucaaucgugagaaaauugauggcgucaagcuggaaucuauggggguguaccagaucuuagccaucuauucaacugucgcuaguagccuggugcuacucguuucccugggagccauuucuuuuuggaugugcucgaacggcagccuucagugucgcaucugcauuuga

SEQ ID NO: 124115 - RNA, 1698 nt, Artificial Sequence; identical to SEQ ID NO: 124075
  derived and/or modified sequence opt3 from hemagglutinin__InfluenzaA__ABW71404

SEQ ID NO: 124116 - RNA, 1698 nt, Artificial Sequence; identical to SEQ ID NO: 123963
  derived and/or modified sequence opt3 from hemagglutinin__InfluenzaA__ABW71415

SEQ ID NO: 124117 - RNA, 1698 nt, Artificial Sequence
  derived and/or modified sequence opt3 from hemagglutinin__InfluenzaA__ABW71426
augaaggccaaacugcucauccuucugugcaccuucacagcuacuuacgcagacacgauuuguauaggcuaucacgccaacaauagcaccgauacaguggacacugucuuggagaagaacguuaccgugacacauuccguaaauuuacuggaagauucucacaacgggaaacuaugccuccugaagggaaucgcgccccuucagcuggguaauuguucaguggcuggcuggauuuuggggaacccugagugcgaacuccugaucaguaaagagagcugguccuacauugucgaaaccccaaauccggagaacggaacuuguuaucccggcuacuuugccgacuaugaggaacugagagagcaacucucuucggugagcucauucgaaagguuugagaucuucccuaaggagaguuccuggccaaaucauacaguuaccggugugucugcaagcugcucccacaacgggaagucaaguuuuuaccggaauuuacuguggcuuacgggcaaaaacggauuguaucccaaucugagcaagucuuacgccaacaauaaagaaaaggagguccuagugcucuggggcguacaucacccuccaaacauaggggaucagcgcgcucuguaccacacugaaaacgcauauguuuccguggucucaagccauuacagucgacguuucacccccgagaucgccaaaagaccuaaggugagggaccaggaaggacggauuaauuauuacuggacacuucuggagccaggugauacuaucauuuuugaggcuaacggcaauuugaucgccccgcgcuucgcguuugcacucucuagaggguucggauccggcauaauuaccagcaacgcccccauggacgaaugugaugcuaagugccagacaccucaaggugccaucaauucgucucugccauuucagaacgugcaccccgucaccauuggggaguguccuaaauauguuagguccacgaaguuacggauggugacuggacugcgcaauaucccaucaauccagagucgaggccucuucggcgcaauugcuggguuuauagaaggagguuggacaggcaugguagacgggugguacggauaucaucaccagaacgagcaaggcagcgguuacgccgcggaucagaaauccacccagaaugccaucaacgggauuacuaauaaggugaacucugucaucgaaaagaugaauacacaguucaccgcagugggcaaagaguucaacaaacuugagagaaggauggaaaaucugaacaagaagguugacgauggauuuuuggacauauggacguacaacgcugagcuacuggugcuccuggaaaaugagcggacccuugacuuccacgauagcaacgucaaaaaucuguaugaaaaggugaaaucacaauugaagaacaaugccaaagagauuggcaacgggugcuuugaguucuaccauaaguguaaugacgaaugcauggagaguguaaagaacggaacauaugauuaccccaaauauuccgaagagagcaagcucaaucgugagaaaaucgacgguguuaagcuggaaucuaugggcguguaccagaucuuagcuauuuauucaacugucgccaguagccuggugcuacucgucucccugggggcaaucucuuuuuggaugugcucgaacggaagccuucagugucgcauuugcauauga

SEQ ID NO: 124118 - RNA, 1698 nt, Artificial Sequence
  derived and/or modified sequence opt3 from hemagglutinin__InfluenzaA__ABW71448
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccacgaaguuacggauggugacuggacugcgcaauauuccaucaauccagagucgaggccucuucggcgccaucgcaggguuuauugaaggagguuggacaggcauggucgacgggugguacggauaucaucaccagaacgagcaaggcagcgguuacgcugccgaucagaaauccacccagaaugcgauaaacgggaucacuaauaaggugaacucuguuauugaaaagaugaauacacaguucaccgccgugggcaaagaguucaacaaacuugagagaaggauggaaaaucugaacaagaaggucgacgauggauuuuuggacaucuggacguacaacgcagagcuacuggugcuccuggaaaaugagcggacccuugacuuccacgauagcaacguuaaaaaucuguaugaaaagguaaaaucacaauugaagaacaaugcuaaagagauaggcaacgggugcuuugaguucuaccauaaguguaaugacgaaugcauggagagugugaagaacggaacauaugauuaccccaaauauuccgaagagagcaagcucaaucgugagaaaauugacggugucaagcuggaaucuaugggcguguaccagaucuuagccaucuauucaacuauugcuaguagccugguccuacucgugucccugggggccaucucuuuuuggaugugcucgaacggaagccuucagugucgcauuugcauauga

SEQ ID NO: 124119 - RNA, 1698 nt, Artificial Sequence; identical to SEQ ID NO: 123946
  derived and/or modified sequence opt3 from hemagglutinin__InfluenzaA__ABW71459

SEQ ID NO: 124120 - RNA, 1698 nt, Artificial Sequence; identical to SEQ ID NO: 123930
  derived and/or modified sequence opt3 from hemagglutinin__InfluenzaA__ABW71470

SEQ ID NO: 124121 - RNA, 1707 nt, Artificial Sequence
  derived and/or modified sequence opt3 from hemagglutinin__InfluenzaA__ABW74702
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccgacaaaugaucugugcuaccccgggagcuuuaacgacuaugaggaauugaagcaucuccuguccaggaucaaucacuucgagaaaauucagaucauuccuaagucuucguggucagaucaugaagcuagcaguggagucuccucugccuguccauaccugggcagcuccucauuuuuccggaacgugguauggcucaucaaaaagaauaguacuuaucccaccauuaaaaagagcuacaacaauacaaaccaggaggacuuacugguucuuugggguauacaccacccuaaugaugcagccgagcaaacccgcuuguaucagaacccaacuacauacaucucuauugggaccuccacgcugaaccagcggcuagugcccaagaucgcuacucguucaaaagucaauggacagagcggcagaauggaauuuuucuggaccauccucaagccuaacgacgcaauuaauuuugagaguaacggcaauuucauagccccagaauacgcuuauaaaaucgugaagaaaggggauucugccauuaugaaguccgagcuggaauacggaaacugcaauacaaaaugucaaacuccgaugggugcgaucaacagcucgaugcccuuucauaauauacacccucuuaccauuggcgagugcccaaaguaugugaagucuaacaggcuggucuuggcaacagggcuccgaaauucaccccagcgcgaguccagaaggaaaaagcggggacuguucggcgccaucgcugguuuuaucgaagggggauggcagggcaugguugacggcugguacggguaucaucacaguaacgagcagggaagcgguuacgccgcagacaaagaauccacccaaaaggcuauugauggcgugacgaauaaaguaaacucuaucauugacaagaugaauacucaguucgaggccguggggcgcgaauuuaacaacuuagagcgaagaauagagaaucugaacaagaaaauggaagauggauuccucgacgucuggacauauaaugcggagcuucugguguugauggaaaacgagaggacccuagauuuccacgacagcaauguuaagaaccuguacgauaaagugcggcuccagcugcgugacaaugccaaggaacuuggcaacgguuguuuugaguucuaccauaaaugcgauaaugaguguaucgaaucaauucgcaacgggacuuauaauuacccucaauauagugaggaagcaagacugaagagggaggagaucuccggcgucaaguuggaaagcaucggaacauaccagauucucucuauauauucaaccguggcuaguagccuggccuuagcuaucaugauggccggccugucccuauggaugugcucuaacgggucgcuccagugccggauuuguaucuga

SEQ ID NO: 124122 - RNA, 1707 nt, Artificial Sequence
  derived and/or modified sequence opt3 from hemagglutinin__InfluenzaA__ABW74703
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucaaggauugcucaguggccgguuggcugcuuggcaacccuaugugugacgaguucaucaauguuccagaauggaguuauauaguggagaaggcgaacccgacaaaugaucugugcuaccccgggagcuuuaacgacuaugaggaauugaaacaucuccuguccagaaucaaucacuucgagaagauucagaucauuccuaaaucuucguggucagaucaugaagcuagcaguggagucuccucugccuguccauaccugggcagccccuccuuuuucaggaacgugguauggcucaucaagaaaaauucaacuuauccuaccauaaagaagaguuacaacaauacaaaccaggaggacuuacugguucuuugggguauucaccacccaaaugaugcagccgagcaaacccgguuguaucagaaccccacuacauacaucagcauugggaccucuacgcugaaccagcgccuagugccuaaaaucgcuacucgauccaaggucaauggacagucaggccguauggaauuuuucuggaccauccucaaaccaaacgacgcagugaauuuugagagcaacggcaauuucauugccccggaauacgcuuauaagauagugaaaaagggggauagugccaucaugaaaucugagcuggaauacggaaacugcaauacaaagugucaaacucccaugggugcgauuaacuccagcaugccuuuucauaauauccacccacuuaccauaggcgagugccccaaguaugucaaaucgaacagacugguuuuggcaacagggcucaggaacucuccucagcgggagucccgcagaaagaaaaggggacuguucggcgccauugcugguuuuaucgaagggggauggcagggcaugguggacggcugguacggguaucaucacucaaaugagcagggaagugguuacgccgcagacaaggaaagcacccaaaaagcuaucgauggcguaacgaauaaggugaacuccauuaucgacaagaugaauacucaguucgaggccgucgggcgggaauuuaacucuuuagagcgccgaauugagaaccugaauaaaaagauggaagauggauuccucgacguguggacauauaacgcggagcuucugguuuugauggaaaaugagagaacccuagauuuccacgacagcaacgugaaaaaucuguacgauaaggucaggcuccagcugcgggacaacgccaaagaacuuggcaaugguuguuuugaguucuaccauaagugcgauaacgaguguauggaaucaauacguaaugggacuuauaacuacccacaauauagugaggaagcacgccugaagagagaggagaucuccggcgugaaauuggaaagcauuggaacauaccagauccucucuaucuauucaaccguagcuaguagccuggccuuagcuauuaugauagccggccugucccuauggaugugcucuaaugggucgcuccagugcaggaucuguauuuga

SEQ ID NO: 124123 - RNA, 1707 nt, Artificial Sequence
  derived and/or modified sequence opt3 from hemagglutinin__InfluenzaA__ABW74705
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccgacaaaugaucugugcuaccccgggagcuuuaacgacuaugaggaauugaagcaucuccuguccaggaucaaucacuucgagaaaauucagaucauuccuaagucuucguggucagaucaugaagcuagcaguggagucuccucugccuguccauaccugggcagccccuccuuuuuccggaacgugguauggcucaucaaaaagaacucaacuuauccuaccauuaaaaagaguuacaauaauacaaaccaggaggacuuacugguucuuugggguauacaccacccaaaugaugcagccgagcaaacccgcuuguaucagaaccccacuacauacaucagcauugggaccucuacgcugaaccagcggcuagugccuaagaucgcuacucguuccaaagucaauggacagucaggcagaauggaauuuuucuggaccauccucaagccaaacgacgcaauuaauuuugagagcaacggcaauuucauagccccggaauacgcuuauaaaaucgugaagaaaggggauagugccauuaugaagucugagcuggaauacggaaacugcaauacaaaaugucaaacucccaugggugcgaucaacuccagcaugccuuuucauaauauacacccacuuaccauuggcgagugccccaaguaugugaagucgaacaggcuggucuuggcaacagggcuccgaaauucuccucagcgcgaguccagaaggaaaaagcggggacuguucggcgccaucgcugguuuuaucgaagggggauggcagggcaugguugacggcugguacggguaucaucacucaaacgagcagggaagugguuacgccgcagacaaagaaagcacccaaaaggcuauugauggcgugacgaauaaaguaaacuccaucauugacaagaugaauacucaguucgaggccguggggcgcgaauuuaacaacuuagagcgaagaauagagaaucugaacaagaaaauggaagauggauuccucgacgucuggacauauaaugcggagcuucugguguugauggaaaacgagaggacccuagauuuccacgacucuaauguuaagaaccuguacgauaaagugcggcuccagcugcgugacaaugccaaggaacuuggcaacgguuguuuugaguucuaccauaaaugcgauaaugaguguauggaaagcauccgcaacgggacuuauaauuacccacaauauucagaggaagcaagacugaagagggaggagauuaguggcgucaaguuggaauccaucggaacauaccagauccucagcauuuauucuaccguggcuucaagucuggccuuagcuauaaugaucgccggccugagccuauggaugugcuccaacgggucucuccagugccggauuuguaucuga

SEQ ID NO: 124124 - RNA, 1707 nt, Artificial Sequence
  derived and/or modified sequence opt3 from hemagglutinin__InfluenzaA__ABW74707
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccgacaaaugaucugugcuaccccgggagcuuuaacgacuaugaggaauugaagcaucuccuguccaggaucaaucacuucgagaaaauucagaucauuccuaagucuucguggucagaucaugaagcuagcaguggagucuccucugccuguccauaccugggcagccccuccuuuuuccggaacgugguauggcucaucaaaaagaacucaacuuauccuaccauuaaaaagaguuacaauaauacaaaccaggaggacuuacugguucuuugggguauacaccacccaaaugaugcagccgagcaaacccgcuuguaucagaaccccacuacauacaucagcauugggaccucuacgcugaaccagcggcuagugccuaagauggcuacucguuccaaagucaauggacagucaggcagaauggaauuuuucuggaccauccucaagccaaacgacgcaaucaauuuugagagcaacggcaauuucauugccccggaauacgcuuauaaaauagugaagaaaggggauagugccaucaugaagucugagcuggaauacggaaacugcaauacaaaaugucaaacucccaugggugcgauuaacuccagcaugccuuuucauaauauccacccacuuaccauaggcgagugccccaaguaugugaagucgaacaggcuggucuuggcaacagggcuccgaaauucuccucagcgcgaguccagaaggaaaaagcggggacuguucggcgccauugcugguuuuaucgaagggggauggcagggcaugguugacggcugguacggguaucaucacucaaacgagcagggaagugguuacgccgcagacaaagaaagcacccaaaaggcuaucgauggcgugacgaauaaaguaaacuccauuaucgacaagaugaauacucaguucgaggccguggggcgcgaauuuaacaacuuagagcgaagaauugagaaucugaacaagaaaauggaagauggauuccucgacgucuggacauauaaugcggagcuucugguguugauggaaaacgagaggacccuagauuuccacgacucuaauguuaagaaccuguacgauaaagugcggcuccagcugcgugacaaugccaaggaacuuggcaacgguuguuuugaguucuaccauaaaugcgauaaugaguguauggaaagcauacgcaacgggacuuauaauuacccacaauauucagaggaagcaagacugaagagggaggagaucaguggcgucaaguuggaauccauuggaacauaccagauccucagcaucuauucuaccguggcuucaagucuggccuuagcuauuaugauagccggccugagccuauggaugugcuccaacgggucucuccagugccggaucuguauuuga

SEQ ID NO: 124125 - RNA, 1707 nt, Artificial Sequence
  derived and/or modified sequence opt3 from hemagglutinin__InfluenzaA__ABW74708
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccgacaaaugaucugugcuaccccgggagcuuuaacgacuaugaggaauugaagcaucuccuguccaggaucaaucacuucgagaaaauucagaucauuccuaagucuucguggucagaucaugaagcuagcaguggagucuccucugccuguccauaccugggcagccccuccuuuuuccggaacgugguauggcucaucaaaaagaacucaacuuauccuaccauuaaaaagaguuacaauaauacaaaccaggaggacuuacugguucuuugggguauacaccacccaaaugaugcagccgagcaaacccgcuuguaucagaaccccacuacauacaucagcauugggaccucuacgcugaaccagcggcuagugccuaagaucgcuacucguuccaaagucaauggacagucaggcagaauggaauuuuucuggaccauccucaagccaaacgacgcaauuaauuuugagagcaacggcaauuucauagccccggaauacgcuuauaaaaucgugaagaaaggggauagugccauuaugaagucugagcuggaauacggaaacugcaauacaaaaugucaaacucccaugggugcgaucaacuccagcaugccuuuucauaauauacacccacuuaccauuggcgagugccccaaguaugugaagucgaacaggucuguccuggcaacaggguugcgaaauuccccucagcgcgagucaagaaggaaaaagcggggacucuucggcgccaucgcugguuuuaucgaagggggauggcagggcaugguugacggcugguacggguaucaucacaguaacgagcagggaagcgguuacgccgcagacaaagaauccacccaaaaggcuauugauggcgugacgaauaaaguaaacucuaucauugacaagaugaauacucaguucgaggccguggggcgcgaauuuaacaaccuggagcgaagaauagagaauuuaaacaagaaaauggaagauggauuccuggacgucuggacauauaaugcggagcuccuugugcugauggaaaacgagaggaccuuggauuuccacgacagcaauguuaagaaccuauacgauaaagugcggcugcagcuccgugacaaugccaaggaacugggcaacgguuguuuugaguucuaccauaaaugcgauaaugaguguauggaaucaauccgcaacgggacuuauaauuacccacaauauagugaggaagcaagacuuaagagggaggagauuuccggcgucaagcuggaaagcaucggaacauaccagaucuugucuauuuauucaaccguggcuaguagccucgcccuggcuauaaugauggccggcuuaucccuguggaugugcucuaacgggucgcuacagugccggaucuguauuuga

SEQ ID NO: 124126 - RNA, 1707 nt, Artificial Sequence; identical to SEQ ID NO: 124123
  derived and/or modified sequence opt3 from hemagglutinin__InfluenzaA__ABW74710

SEQ ID NO: 124127 - RNA, 1707 nt, Artificial Sequence; identical to SEQ ID NO: 124123
  derived and/or modified sequence opt3 from hemagglutinin__InfluenzaA__ABW74711

SEQ ID NO: 124128 - RNA, 1707 nt, Artificial Sequence
  derived and/or modified sequence opt3 from hemagglutinin__InfluenzaA__ABW74712
auggagaagaucgugcugcuccuuagcauugucucccugguuaaaucugaccagauaugcaucggcuaccacgccaacaauucaaccgaacaaguggauacaauuauggagaagaacguaacugugacgcaugcucaggacaucuuggagaaaacccacaaugggaaguuaugugaucuggacggagucaaaccccuaauucucagagauugcaguguggcagguuggcugcuuggcaacccuaugugugacgaguucaucaauguuccagaauggagcuauauaguggagaaggccaacccgacaaaugaucugugcuaccccggguccuuuaacgacuaugaggaauugaagcaucuccugucuaggaucaaucacuucgagaaaauucagaucauuccuaagucgucauggagcgaucaugaagcgaguuccggagucucuagcgcuuguccauaccugggcucccccucauuuuuccggaacgugguauggcucaucaaaaagaauaguacuuauccuaccauuaaaaagagcuacaacaauacaaaccaggaggacuuacugguucuuugggguauacaccacccaaauaacgaggaagaacaaacccgcuuguaucagaaccccacuacauacaucucuauugggaccuccacgcugaaucagcgucuagugccuaagaucgccacucgaucaaaagucaacggacagagcggcagaauggaauuuuucuggaccauccucaagccaaaugaugcaauuaacuuugagaguaauggcaacuucauagccccggaauacgcuuauaaaaucgugaagaaaggggacucugcaauuaugaaguccgagcuggaguacagcaauugcaacacaaaaugucaaacucccaugggagccaucaauucgucuaugccuuuucauaacauacacccacuuaccauuggugaaugccccaaguaugugaaguccucaaggcuggucuuggcuacaggccuccggaauaguccucagcgcgagagcagaaggaaaaagcgggggcuguucggagccaucgcgggcuuuaucgaagguggguggcagggaaugguugauggcugguacggcuaucaucacuccaacgagcaggggucuggauacgcagccgacaaagaaagcacccaaaaggcuauugacggugugacgaauaaaguaaacucaaucauugauaagaugaauacucaguucgaggccgugggccgcgaguuuaacaacuuagaacgaagaauagagaaucugaacaagaaaauggaagacggguuccucgaugucuggacauauaaugcagagcuucugguguugauggaaaacgagaggacccuagacuuccacgauaguaauguuaagaaccuguacgacaaagugcggcuccagcugcgugauaaugcuaaggagcuuggaaacggcuguuuugaguucuaccauaaaugcgacaaugaauguauggaauccauccgcaacgguacuuauaauuacccacaauauagcgaggaggccagacugaagagggaagagauuucuggggucaaguuggaaucaaucggcacauaccagauccucaguauuuauagcaccguggcguccucucuggccuuagcaauaaugaucgcuggacugucgcuauggaugugcagcaacggcucccuccagugccggauuuguaucuga

SEQ ID NO: 124129 - RNA, 1701 nt, Artificial Sequence
  derived and/or modified sequence opt3 from hemagglutinin__InfluenzaA__ABW80976
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcccuucugggcgauccgcauugcgacggguuucagaacaaagaaugggauuuguucguggagaggucuaaggcuuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugaaguauaaauacccagcacuuaaugucacgaugcccaacaaugagaaguuugauaaauuguauauauggggagugcaucacccugggacugacucugaucagaucuccauuuacgcccaggcuucaggcagaguaaccguuagcacaaagaggagucaacagacugugaucccaaacauuggcucucggcccuggguccgcgggguguccagcggaaucucgauauacuggaccauugugaaaccuggugacauccugcuaauuaacucuacaggcaaucucaucgccccaagaggguauuucaagaucagguccggaaagucaaguauuaugcggagcgacgcgccgauaggcaaauguaacuccgaaugcaucacccccaaugguucuauuccuaacgauaagccauuucagaaugucaaccgcaucacguacggggcauguccccgauauguuaaacagaauacucugaagcuagccacaggaaugagaaacgugccugagaaacaaaccaggggcauauucggcgcuauugccggguuuaucgaaaauggaugggaggguaugauggacggcugguacggguuccggcaccagaacagcgagggaacuggccaggcagcugaucugaagucaacacaagccgcgaucaaucagauuaacgguaaauugaaucgucucaucgaaaagaccaacgagaaguuucaucagauugaaaaagaguucagugaaguagaggggcgcauacaggaccuggagaaguauguggaagauacgaaaaucgacuuaugguccuacaaugccgagcugcucgucgcacuugaaaaccaacacaccauugaucugacagacagcgagaugaacaaguuguucgaaagaacuaaaaagcagcuaagggagaaugcugaggauaugggcaacggaugcuuuaagaucuaucauaaaugugacaaugccugcaucggcucuauucggaacgggaccuacgaucacgacguguaccgagacgaagcucugaauaaccgcuuccagauaaagggaguugagcucaaaucagguuauaaggauuggauccuguggauuaguuuugccaucagcugcuuccuucuguguauuguguugcucggcuuuaucaugugggcaugccagaaagggaauauaagauguaacaucugcauuuga

SEQ ID NO: 124130 - RNA, 1701 nt, Artificial Sequence
  derived and/or modified sequence opt3 from hemagglutinin__InfluenzaA__ABW80977
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuaauuuguaugcccaggcuagcgggcguaucacugugucuaccaagagaucccaacagacaguaauuccaaacaucggaucaaggccccggguucgcgaugugccuagcagaauaaguauuuacuggaccaucgucaagccaggugacauucugcuaaucucuuccacgggcaaucucaucgccccgaggggguacuuuaagauucggagcggaaaaucgucuauaaugcgcuccgacgcgcccaucggcaaguguaacucagagugcauuacuccuaaugguaguaucccaaacgauaaacccuuccagaaugugaaccgaauaacauauggggcauguccuagauacgugaagcagaauacccugaaacuugccacuggaaugaggaacgucccagaaaagcaaacacggggcauuuuuggcgcuaucgccggguucaucgagaauggaugggaagguaugguugacggcugguauggguuucgucaccagaacagcgagggaaccggccaggcagcugaucugaaauccacgcaagccgcgauuaaucagaucaacgguaaguugaaucgccucauugggaagaccaacgagaaauuccaccagauagaaaaggaguucucugaaguggagggcagaauccaggaccuggaaaaauacguagaggauacaaagauugacuuauggagcuauaacgccgagcugcucguggcacuugaaaaucaacauacuaucgaucugaccgacucagagaugaacaaauuguuugaaaggacaaagaagcagcuacgggagaaugcugaagauaugggaaacggcugcuucaaaaucuaccacaagugugacaaugccugcauugggaguauacgaaacggaacuuaugaucaugacgucuaccgcgacgaggcucugaauaacagauuucagaucaaagguguggagcucaaguccggcuacaaagauuggauucuguggaucagcuucgccauuucuugcuuucuucuguguguugcauugcucggguucaucaugugggccugccagaagggaaauauaagguguaacaucugcauuuga

SEQ ID NO: 124131 - RNA, 1698 nt, Artificial Sequence
  derived and/or modified sequence opt3 from hemagglutinin__InfluenzaA__ABW80979
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggagaguuccuggccaaaucauacagugaccggugucucugcaagcugcucccacaacgggaagucaaguuuuuaccggaauuuacuguggcuuacgggcaaaaacggauuguaucccaaucugagcaagucuuacgugaacaauaaagaaaaggaggugcuaguucucuggggcgugcaucacccuccaaacaucgggaaccagcgcgcccuguaccacacugaaaaugcuuaugucuccguggugucaagccauuacagucgacguuucacccccgagauagcaaaaagaccuaaggucagggaucaggaaggacggaucaacuauuacuggacacuucuggagccaggugacacuauuaucuuugaggccaauggcaacuugauugcuccgugguaugccuucgcgcucucucgcggguuuggauccggcaucauaaccagcaaugcacccauggaugaaugugacgccaagugccagacaccucaaggugcuauuaacucgucucugccauuccagaauguucaccccgugaccaucggggaguguccuaaauacguaagauccgccaaguuaaggauggugacgggacugcggaacauuccaucaauccagagucgcggccucuuuggcgcaaucgcuggguucauugaaggagguuggacuggcauggucgaugggugguauggauaccaucaccagaaugagcaaggcagcgguuacgccgcggaccagaaauccacacagaacgccauaaaugggaucaccaacaagguaaauucuguuauugaaaagaugaacacucaguuuacagcagugggcaaagaguucaauaaacuugagcgaagaauggaaaaccugaacaagaaggucgaugacggauucuuggauaucuggaccuauaaugcugagcuacuggugcuccuggaaaacgagaggacgcuugacuuucacgacagcaauguuaaaaaccuguacgaaaagguaaaaucacaauugaagaauaacgccaaagagauaggcaaugggugcuucgaguuuuaucauaaguguaacaaugaaugcauggagagugugaagaacggaaccuacgauuaucccaaauacuccgaagagagcaagcucaaucgggagaaaauugacggugucaagcuggaaucuaugggcguguaucagaucuuagcuaucuacucaacagucgccaguagccuggugcuacucguuucccugggggcaauuucuuucuggaugugcucgaacggaagccuucagugucguaucugcauuuga

SEQ ID NO: 124132 - RNA, 1701 nt, Artificial Sequence
  derived and/or modified sequence opt3 from hemagglutinin__InfluenzaA__ABW81505
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugcagacucaagggaaccgcgccccugcagcuugguaauuguucaauagcuggcuggauccuggggaacccugagugcgaaaguuuguuuagcaaagaguccuggucuuacauugccgaaacuccaaauccgaagaacggaacauguuaucccggcuacuucgcagacuaugaggagcucagggaacaacugucgucagucagcaguuuugagcgguucgaaaucuuuccuaaggauuccucuuggccaaaucauaccgugacgaaagguguuacugccagcugcucccacaacgggaagucaaguuucuacaaaaaucugcucugguuaaccgagaagaacggacuguaucccaaucuuagcaaaucuuacgugaacaagaagggcaaagaggucuuggugcuguggggcguacaucacccuuccaauaugggggaccagcgcgcuauuuaccacaaggaaaacgcauauguuucagugcuaagcagucauuacucucgacguuuuacaccagagaucgccaaaagacccaaggucagggaucaggaaggacggauaaacuauuacuggacucuccuggagccuggugacaccaucauuuucgaagcuaauggcaaccuuaucgccccaugguaugcguuugcacugucccgcggguucggaagcggcauuaucauaucgaaugccucuaugggugagugugaugcuaaaugccagacaccgcaaggggccauuaacuccucauugcccuuucagaaugugcacccugugaccaucggagaguguccaaaguacgucagaaguacgaaacucaggaugguuacuggccugcggaacgugcccagcauucagucccgcggcuuauucggggcaaucgcuggauuuaucgaagguggcuggacagggaugauugacggaugguauggcuaccaucaccagaaugagcaagguucuggguacgccgcggaucagaaaagcacccagaacgccauaaauggcaucacuaacaagguaaauucaauuaucgaaaagaugaacacacaguucaccgcagugggaaaggaguucaauaaacuggaacgaagaauggagaaccucaauaagaaagucgacgauggcuuucuugacauauggacguauaacgcugagcuguuggugcuacuggaaaacgagaggacccucgacuuccacgauaguaauguuaagaaccuguacgaaaaggugaaaacacaacuuaagaauaacgccaaagagauugggaauggaugcuuugaguucuaucauaaguguaacaaugaaugcauggaguccgucaaaaacgguacuuacgacuauccuaaguacagcaaggaaucuaaacugaaucgggagaagaucgauggcgugaaauuggaaucaauggggguauaucagauccucgcuauuuacaguaccguugccagcucccugguguuacuggucucucuaggagcaaucucguuuuggaugugcagcaacggcucccuccagugucguauuugcauauga

SEQ ID NO: 124133 - RNA, 1698 nt, Artificial Sequence
  derived and/or modified sequence opt3 from hemagglutinin__InfluenzaA__ABW81506
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggaggugcuaguucucuggggcgugcaucacccuccaaacaucgggaaccagcgcgcccuguaccacacugaaaaugcuuaugucuccguggugucaagccauuacagucgacguuucacccccgagauagcaaaaagaccuaaggucagggaucaggaaggacggaucaacuauuacuggacacuucuggagccaggugacacuauuaucuuugaggccaauggcaacuugauugcuccgugguaugccuucgcgcucucucgcggguuuggauccggcaucauaaccagcaaugcacccauggaugaaugugacgccaagugccagacaccucaaggugcuauuaacucgucucugccauuccagaauguucaccccgugaccaucggggaguguccuaaauacguaagauccgccaaguuaaggauggugacgggacugcggaacauuccaucaauccagagucgcggccucuuuggcgcaaucgcuggguucauugaaggagguuggacuggcauggucgaugggugguauggauaccaucaccagaaugagcaaggcagcgguuacgccgcggaccagaaauccacacagaacgccauaaaugggaucaccaacaagguaaauucuguuauugaaaagaugaacacucaguuuacagcagugggcaaagaguucaauaaacuugagcgaagaauggaaaaccugaacaagaaggucgaugacggauucuuggauaucuggaccuauaaugcugagcuacuggugcuccuggaaaacgagaggacgcuugacuuucacgacagcaauguuaaaaaccuguacgaaaagguaaaaucacaauugaagaauaacgccaaagagauaggcaaugggugcuucgaguuuuaucauaaguguaacaaugaaugcauggagagugugaagaacggaaccuacgauuaucccaaauacuccgaagagagcaagcucaaucgggagaaaauugacggugucaagcuggaaucuaugggcaucuaucagaucuuagcuauuuacucaacaguggccaguagccugguccuacucgugucccugggggcaaucucuuucuggaugugcucgaacggaagccuucagugucguauuugcauauga

SEQ ID NO: 124134 - RNA, 1701 nt, Artificial Sequence
  derived and/or modified sequence opt3 from hemagglutinin__InfluenzaA__ABW81507
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugcagacucaagggaaccgucccccugcagcuugguaauuguucaauagcgggcuggauccuggggaacccugagugcgaaaguuuguuuagcaaagaguccuggucuuacauugcugaaacuccaaauccgaagaacggaacauguuaucccggcuacuucgccgacuaugaggagcucagggaacaacugucgucagugagcaguuuugagcgguucgaaaucuuuccuaaggauuccucuuggccaaaucauaccguuacgaaaggugugacugcaagcugcucccacaacgggaagucaaguuucuacaaaaaucugcucugguuaaccgagaagaacggacuguaucccaaucuuagcaaaucuuacgucaacaagaagggcaaagagguguugguacuguggggcguucaucacccuuccaauaugggggaccagcgcgccauuuaccacaaggaaaacgcuuaugugucaguccuaagcagucauuacucucgacguuuuacaccagagaucgcaaaaagacccaaggugagggaucaggaaggacggauaaacuauuacuggacucuccuggagccuggugacaccaucauuuucgaagccaauggcaaccuuaucgcuccaugguaugccuuugcgcugucccgcggguucggaagcggcauuaucauaucgaaugcaucuaugggugagugugaugccaaaugccagacaccgcaaggggcuauuaacuccucauugcccuuucagaaugugcacccugucaccaucggagaguguccaaaguacguuagaaguacgaaacucaggauggugacuggccugcggaacguacccagcauucagucccgcggcuuauucggggccaucgcaggauuuaucgaagguggcuggacagggaugauugacggaugguauggcuaccaucaccagaaugagcaagguucuggguacgcugccgaucagaaaagcacccagaacgcgauaaauggcaucacuaacaaggucaauucaauuaucgaaaagaugaacacacaguucaccgccgugggaaaggaguucaauaaacuggaacgaagaauggagaaccucaauaagaaaguggacgauggcuuucuugacauauggacguauaacgcagagcuguugguucuacuggaaaacgagaggacccucgacuuccacgauaguaaugugaagaaccuguacgaaaaggucaaaacacaacuuaagaauaacgcuaaagagauugggaauggaugcuuugaguucuaucauaaguguaacaaugaaugcauggaguccgugaaaaacgguacuuacgacuauccuaaguacagcaaggaaucuaaacugaaucgggagaagaucgauggcguaaaauuggaaucaauggggguuuaucagauccucgccauuuacaguaccguggcuagcucccuggucuuacuggugucucuaggagccaucucguuuuggaugugcagcaacggcucccuccagugucguauuugcauauga

SEQ ID NO: 124135 - RNA, 1698 nt, Artificial Sequence
  derived and/or modified sequence opt3 from hemagglutinin__InfluenzaA__ABW81508
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgcgcaaaaacggauuguaucccaaucugagcaagucuuacgcaaacaauaaagaaaaggagguucuaguacucuggggcgugcaucacccuccaaacaucggcgaucagcgagcccuguaccacacugaaaacgcuuaugucuccguggugucaagccauuacagucguagauucacccccgagauagcaaaaaggccuaagguccgggaccaggaagggcgcaucaauuauuacuggacacuucuggagccaggagauacuauuaucuuugaggccaacgguaauuugauugcuccgagauaugccuucgcgcucucuaggggcuuuggguccggaaucauaaccagcaacgcacccauggacgaaugugaugccaagugccagacaccucaaggcgcuauuaauucgucucugccauuccagaacguucaccccgugaccaucggugaguguccuaaauacguacgguccgccaaguuacgcauggugacggggcugcgaaauauuccaucaauccagaguagaggacucuuuggcgcaaucgcuggcuucauugaagggggauggacugguauggucgacggcugguauggguaccaucaccagaacgagcaaggaagcggcuacgccgcggaucagaaauccacacagaaugccauaaacgguaucaccaauaaggugaacucuguuauugaaaagaugaauacucaguuuacagcaguggggaaagaguucaacaaacuugagaggcggauggaaaaucugaacaagaaggucgacgauggcuucuuggacaucuggaccuauaacgcugagcuacuggugcuccuggaaaaugagcguacgcuugacuuucacgauagcaacguuaaaaaucuguacgaaaagguaaaaucacaauugaagaacaaugccaaagagauaggaaacggcugcuucgaguuuuaucauaaguguaaugacgaaugcauggagagugugaagaacgggaccuacgauuaucccaaauacuccgaagagagcaagcucaaucgcgagaaaauugacggagucaagcuggaaucuauggguguguaucagaucuuagcuaucuacucaacagucgccaguagccuggugcuacucguuucccugggcgcaauuucuuucuggaugugcucgaacgggagccuucaguguagaaucugcauuuga

SEQ ID NO: 124136 - RNA, 1701 nt, Artificial Sequence; identical to SEQ ID NO: 124132
  derived and/or modified sequence opt3 from hemagglutinin__InfluenzaA__ABW81509

SEQ ID NO: 124137 - RNA, 1698 nt, Artificial Sequence
  derived and/or modified sequence opt3 from hemagglutinin__InfluenzaA__ABW81511
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucgggaaccagcgcgcccuguaccacacugagaaugcuuaugucuccguggugucaagccauuacagucgacguuucacccccgaaauagcaaagagaccuaaagucagggaucaggagggucggaucaacuauuacuggacacuucuggaaccaggcgacucuauuaucuuugaggccaaugggaacuugauugcuccgugguaugccuucgcgcucucccgcggauuuggcagcgguaucauaacuucgaaugcacccauggaugagugugacgccaagugccagaccccucaaggggcuauuaacucuucccugccauuccagaauguucaccccgugacaaucggagaauguccuaaguacguaagaucagccaaauuaaggauggugaccggccugcggaacauuccaaguauccagagccgcggccucuuuggggcaaucgcuggauucauugaggguggcuggacggggauggucgauggaugguauggcuaccaucaccagaaugaacaagguuccggguacgccgcggaccagaagucuacucagaacgccauaaauggcaucacaaacaaagugaauagcguuauugagaagaugaacacccaguuuacugcagugggaaaagaguucaauaagcuagaacgaagaauggagaaccugaacaaaaaggucgaugacggcuucuuggauaucuggacauauaaugcugaacuacuggugcuccuggagaacgaaaggacccuugacuuucacgacucaaauguaaagaaccuguacgagaaaguuaagagucaauugaaaaauaacgccaaggaaauagggaauggaugcuucgaguuuuaucauaaauguaacaaugagugcauggaauccgugaagaacgguacguacgauuaucccaaguacagcgaggaaucuaaacucaaucgggagaagauugacggcgucaaacuggagucaauggggguguaucagaucuuagcuaucuacaguaccgucgccagcucccuggugcuacucguuucucugggagcaauuucguucuggaugugcagcaacggcucccuucagugucguaucugcauuuga

SEQ ID NO: 124138 - RNA, 1698 nt, Artificial Sequence; identical to SEQ ID NO: 122312
  derived and/or modified sequence opt3 from hemagglutinin__InfluenzaA__ABW81512

SEQ ID NO: 124139 - RNA, 1698 nt, Artificial Sequence; identical to SEQ ID NO: 123401
  derived and/or modified sequence opt3 from hemagglutinin__InfluenzaA__ABW81513

SEQ ID NO: 124140 - RNA, 1698 nt, Artificial Sequence
  derived and/or modified sequence opt3 from hemagglutinin__InfluenzaA__ABW81514
augaaggugaaacugcucguccuucugugcaccuucacagccacuuacgcugacacgaucuguauuagcuaucacgcaaacaauuccaccgauacaguugacacuguguuggagaagaacguaaccgugacacauucugucaauuuacuggaagauucacacaacggcaaacuaugccuccugaaggggauagcgccccuucagcugggaaauuguaguguggccgguuggaucuugggcaacccugagugcgaacuccugauuagcaaagaguccuggucuuacaucguugaaaccccaaauccggagaacgggacuuguuaucccggauacuuugcugacuaugaggaacugagagagcaacucucgucagugagcaguuucgaaagguuugagauuuucccuaaggaguccucuuggccaaaucauacagucaccggcgugagcgccuccugcucacacaacgguaagaguagcuuuuaccggaauuuacuguggcuuacggggaaaaacggauuguaucccaaucugucuaaguccuacgcaaacaauaaagaaaaggagguucuaguacucuggggcgugcaucacccuccaaacaucggcgaucagcgcgcccuguaccacacugaaaacgcuuaugucucaguggugagcagucauuacucucgacguuucacccccgagauagcaaaaagaccuaaggucagggaccaggaagggcggaucaauuauuacuggacacuucuggagccaggagauacuauuaucuuugaggccaacgguaauuugauugcuccgcgcuucgccuuugcgcucuccagaggcuucgggagcggaaucauaaccucgaacgcacccauggacgaaugugaugccaagugccagacaccucaaggcgcuauuaauucuucccugccauuucagaacguucaccccgugaccaucggugaguguccuaaauauguaaggucagccaaguuacggauggcaacggggcugcgcaauauuccaaguauccagagccgaggacucuucggcgcuaucgccggcuuuauugaagggggauggacugguaugguggacggcugguacggguaucaucaccagaacgagcaaggauccggcuacgcggccgaucagaaaucuacacagaaugcaauaaacgguaucaccaauaaggucaacagcgugauugaaaagaugaauacucaguucacagcuguugggaaagaguucucaaaacuugagagaaggauggaaaaccugaauaagaagguggacgauggcuuuuuggacaucuggaccuacaacgccgagcuacugguccuccuggaaaacgagcggacgcuugacuuccacgauaguaaugugaaaaaccuguaugaaaagguaaaaucccaauugaagaauaacgcuaaagagauaggaaauggcugcuuugaguucuaccauaaguguaacgacgaaugcauggagagcguuaagaaugggaccuaugauuaccccaaauauucugaagagucaaagcucaaccgugagaaaauugacggagugaagcuggaaaguaugggugucuaccagaucuuagccaucuauagcacaguggcauccucucugguccuacucgugucgcugggcgccauuagcuuuuggaugugcuccaaugggucacuucagugucgcaucugcauuuga

SEQ ID NO: 124141 - RNA, 1698 nt, Artificial Sequence; identical to SEQ ID NO: 123401
  derived and/or modified sequence opt3 from hemagglutinin__InfluenzaA__ABW81515

SEQ ID NO: 124142 - RNA, 1698 nt, Artificial Sequence; identical to SEQ ID NO: 123401
  derived and/or modified sequence opt3 from hemagglutinin__InfluenzaA__ABW81516

SEQ ID NO: 124143 - RNA, 1698 nt, Artificial Sequence
  derived and/or modified sequence opt3 from hemagglutinin__InfluenzaA__ABW81517
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucgauuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccgccaaguuacggauggcaacgggacugcgcaauaucccaucaauccagagucgaggccucuucggcgcuauugccggguuuauagaaggagguuggacuggcaugguagacgggugguacggauaucaucaccagaacgagcaaggcagcgguuacgcggccgaucagaaauccacacagaaugcaaucaacgggauuaccaauaaggugaacucugucaucgaaaagaugaauacucaguucacagcugugggcaaagaguucagcaaacuugagagaaggauggaaaaccugaauaagaagguugacgauggauuuuuggacauauggaccuacaacgccgagcuacuggugcuccuggaaaacgagcggacgcuugacuuccacgauucaaaugucaaaaaccuguaugaaaaggugaaaagucaauugaagaauaacgcuaaagagauuggcaaugggugcuuugaguucuaccauaaguguaacgacgaaugcauggaguccguaaagaauggaaccuaugauuaccccaaauauagcgaagagucuaagcucaaccgugagaaaaucgacgguguuaagcuggaaucaaugggcguguaccagaucuuagccauuuauaguacagucgcaagcucccuggugcuacucgucucucugggggccaucucguuuuggaugugcagcaauggaucccuucagugucgcauuugcauauga

SEQ ID NO: 124144 - RNA, 1698 nt, Artificial Sequence
  derived and/or modified sequence opt3 from hemagglutinin__InfluenzaA__ABW81518
augaaggugaaacugcucguccuucugugcaccuacacagccacuuaugcugacacgaucuguauuggcuaccacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuauaucguugaaaccccaaauccggagaacggaacuuguuaccccggcuauuucgcugacuacgaggaacugagagagcaacucucuucggugagcucauuugaaagguucgagauuuuuccuaaggagaguuccuggccaaaucauacagucaccggugugucugccagcugcucccacaacgggaagucaaguuucuaucggaauuuacuguggcuuacgggcaaaaacggauuguaccccaaucugagcaagucuuacgcaaacaauaaagaaaaggagguucuaguacucuggggcgugcaucacccuccaaacaucggggaucagcgcgcccuguaucacacugaaaacgcuuacgucuccguggugucaagccauuauagucgacguuuuacccccgagauagcaaaaagaccuaaggucagggaccaggaaggacggaucaauuacuauuggacacuucuggagccaggugauacuauuaucuucgaggccaacggcaauuugauugcuccgcgcuuugccuucgcgcucucuagaggguuuggauccggcaucauaaccagcaacgcacccauggacgaaugugaugccaagugccagacaccucaaggugcuauuaauucgucucugccauuccagaacguucaccccgugaccaucggggaguguccuaaauacguaagguccgccaaguuacggauggcaacgggacugcgcaauauuccaucaauccagagucgaggccucuuuggcgcuaucgccggguucauugaaggagguuggacuggcaugguggacgggugguauggauaccaucaccagaacgagcaaggcagcgguuacgcggccgaucagaaauccacacagaaugcaauaaacgggaucaccaauaaggucaacucugugauugaaaagaugaauacucaguuuacagcuguuggcaaagaguucagcaaacuugagagaaggauggaaaaccugaauaagaagguggacgauggauucuuggacaucuggaccuauaacgccgagcuacugguccuccuggaaaacgagcggacgcuugacuuucacgauucaaaugugaaaaaccuguacgaaaagguaaaaagucaauugaagaauaacgcuaaagagauaggcaaugggugcuucgaguuuuaucauaaguguaacgacgaaugcauggaguccguuaagaauggaaccuacgauuaucccaaauacagcgaagagucuaagcucaaccgugagaaaauugacggugugaagcuggaaucaaugggcgucuaucagaucuuagccaucuacaguacaguggcaagcucccugguccuacucgugucucugggggccauuucguucuggaugugcagcaauggaucccuucagugucgcaucugcauuuga

SEQ ID NO: 124145 - RNA, 1698 nt, Artificial Sequence
  derived and/or modified sequence opt3 from hemagglutinin__InfluenzaA__ABW81519
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcucaugucuccguggugucaagccacuauagucgacguuucacccccgagauagcaaaaagaccuaaggucagggaccaggaaggacggaucaauuacuauuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaucccgugaccaucggggaguguccuaaauacguaagguccgccaaguuacggauggcaacgggacugcgcaauauuccaucaauccagagucgaggccucuucggcgcuaucgccggguuuauugaaggagguuggacuggcaugguggacgggugguauggauaccaccaccagaacgagcaaggcagcgguuaugcggccgaucagaaauccacacagaaugcaauaaacgggaucaccaauaaggucaacucugugauugaaaagaugaauacucaguucacagcuguuggcaaagaguucagcaaacuugagagaaggauggaaaaccugaauaagaagguggacgauggauuuuuggacaucuggaccuacaacgccgagcuacugguccuccuggaaaacgagcggacgcuugacuuccaugauucaaaugugaaaaaccuguacgaaaagguaaaaagucaauugaagaauaacgcuaaagagauaggcaaugggugcuuugaguucuaucacaaguguaacgacgaaugcauggaguccguuaagaauggaaccuacgauuaucccaaauacagcgaagagucuaagcucaaccgugagaaaauugacggugugaagcuggaaucaaugggcgucuaucagaucuuagccaucuacaguacaguggcaagcucccugguccuacucgugucucugggggccauuucguuuuggaugugcagcaauggaucccuucagugucgcaucugcauuuga

SEQ ID NO: 124146 - RNA, 1698 nt, Artificial Sequence
  derived and/or modified sequence opt3 from hemagglutinin__InfluenzaA__ABW81520
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguucauguaguguggccggcuggaucuuggggaauccugagugcgaacuccugauuagcaaagaguccuggucuuacaucguugaaaccccaaacccggagaauggaacuuguuaucccggcuacuuugcugacuaugaggaacugagagagcaacucucgucagugagcaguuucgaaagguuugagauuuucccuaaggaguccucuuggccaaaccauacagucaccggugugagcgccuccugcucacacaaugggaagaguagcuuuuaccggaacuuacuguggcuuacgggcaaaaauggauuguaucccaaccugucuaaguccuacgcaaauaacaaagaaaaggagguucuaguacucuggggcgugcaucacccuccaaauaucggggaucagcgcgcccuguaccacacugaaaacgcuuaugucucaguggugagcagucauuacucucgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucuccagaggguucggaagcggcaucauaaccucgaaugcacccauggacgaaugugaugccaagugccagacaccucaaggugcuauuaacucuucccugccauuucagaauguucaccccgugaccaucggggaguguccuaaauauguaaggucagccaaguuacggauggcaacgggacugcgcaacauuccaaguauccagagccgaggccucuucggcgcuaucgccggguuuauugaaggagguuggacuggcaugguggacgggugguacggauaucaucaccagaaugagcaaggcuccgguuacgcggccgaucagaaaucuacacagaacgcaauaaaugggaucaccaacaaggucaauagcgugauugaaaagaugaacacucaguucacagcuguuggcaaagaguucucaaaacuugagagaaggauggaaaaucugaacaagaagguggacgauggauuuuuggacaucuggaccuacaaugccgagcuacugguccuccuggaaaacgagcggacgcuugacuuccacgauaguaacgugaaaaaucuguaugaaaagguaaaaucccaauugaagaacaaugcuaaagagauaggcaacgggugcuuugaguucuaccauaaguguaaugacgaaugcauggagagcguuaagaacggaaccuaugauuaccccaaauauucugaagagucaaagcucaaucgugagaaaauugacggugugaagcuggaaaguaugggcgucuaccagaucuuagccaucuauagcacaguggcauccucucugguccuacucgugucgcugggggccauuagcuuuuggaugugcuccaacggaucacuucagugucgcaucugcauuuga

SEQ ID NO: 124147 - RNA, 1698 nt, Artificial Sequence
  derived and/or modified sequence opt3 from hemagglutinin__InfluenzaA__ABW81521
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaagcucgaacgcacccauggacgaaugugaugccaagugccagaccccucaaggugcuauuaauucuucccugccauuucagaacguucaccccgugacaaucggggaguguccuaaauauguaaggucagccaaguuacggauggcaaccggacugcgcaauauuccaaguauccagagccgaggccucuucggcgcuaucgccggguuuauugaaggagguuggacgggcaugguggacgggugguacggauaucaucaccagaacgagcaaggcuccgguuacgcggccgaucagaaaucuacucagaaugcaauaaacgggaucacaaauaaggucaacagcgugauugaaaagaugaauacccaguucacugcuguuggcaaagaguucucaaaacuugagagaaggauggaaaaccugaauaagaagguggacgauggauuuuuggacaucuggacauacaacgccgagcuacugguccuccuggaaaacgagcggacccuugacuuccacgauaguaaugugaaaaaccuguaugaaaagguaaaaucccaauugaagaauaacgcuaaagagauaggcaaugggugcuuugaguucuaccauaaguguaacgacgaaugcauggagagcguuaagaauggaacguaugauuaccccaaauauucugaagagucaaagcucaaccgugagaaaauugacggugugaagcuggaaaguaugggcgucuaccagaucuuagccaucuauagcaccguggcauccucucugguccuacucgugucgcugggggccauuagcuuuuggaugugcuccaauggaucacuucagugucgcaucugcauuuga

SEQ ID NO: 124148 - RNA, 1698 nt, Artificial Sequence; identical to SEQ ID NO: 123401
  derived and/or modified sequence opt3 from hemagglutinin__InfluenzaA__ABW81522

SEQ ID NO: 124149 - RNA, 1698 nt, Artificial Sequence; identical to SEQ ID NO: 123401
  derived and/or modified sequence opt3 from hemagglutinin__InfluenzaA__ABW81523

SEQ ID NO: 124150 - RNA, 1698 nt, Artificial Sequence
  derived and/or modified sequence opt3 from hemagglutinin__InfluenzaA__ABW81524
augaaggugaaacugcucguccuucugugcaccuucacagccacuuacgcugacacgaucuguauuggcuaucacgcaaacaauagcaccgauacaauagacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccgccaaguuacggauggcaacgggacugcgcaauaucccaucaauccagagucgaggccucuucggcgcuauugccggguuuauagaaggagguuggacuggcaugguagacgggugguacggauaucaucaccagaacgagcaaggcagcgguuacgcggccgaucagaaauccacacagaaugcaaucaacgggauuaccaauaaggugaacucugucaucgaaaagaugaauacucaguucacagcugugggcaaagaguucagcaaacuugagagaaggauggaaaaccugaauaagaagguugacgauggauuuuuggacauauggaccuacaacgccgagcuacuggugcuccuggaaaacgagcggacgcuugacuuccacgauucaaaugucaaaaaccuguaugaaaaggugaaaagucaauugaagaauaacgcuaaagagauuggcaaugggugcuuugaguucuaccauaaguguaacgacgaaugcauggaguccguaaagaauggaaccuaugauuaccccaaauauagcgaagagucuaagcucaaccgugagaaaaucgacgguguuaagcuggaaucaaugggcguguaccagaucuuagccauuuauaguacagucgcaagcucccuggugcuacucgucucucugggggccaucucguuuuggaugugcagcaauggaucccuucagugucgcauuugcauauga

SEQ ID NO: 124151 - RNA, 1698 nt, Artificial Sequence
  derived and/or modified sequence opt3 from hemagglutinin__InfluenzaA__ABW81526
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacgggaaaucaaguuuuuauaagaauuuacuguggcuuaccggcaaaaacggauuguaccccaaucugagcaagucuuaugcaaacaauaaagaaaaggaggugcuaguucucuggggcgugcaccacccuccaaacaucggggaucagaaggcccuguaccauacggaaaacgcuuacgucuccguggugucaagccacuauagucggaaauucacucccgagauagcaaagcgcccuaaaguccgagaccaggaaggacguaucaauuacuauuggacccuucuggagccaggugauacaauuaucuuugaggccaacggcaauuugauugcuccgagauacgccuucgcgcucucuaggggguuuggauccggcaucauaaacagcaaugcacccauggguaagugugacgccaaaugccagacuccucaaggggcuauuaacucgucucugccauuccagaauguucaucccgugaccaucggagaauguccuaaguauguacgguccgccaaauuacgcauggugacaggccugagaaacauuccaucaauccagaguaggggccucuuuggggcaaucgcuggauucauugaggguggcuggaccgggauggucgauggaugguacggcuaucaccaccagaaugaacaagguagcggguacgccgcggaccagaaguccacgcagaacgccauaaauggcaucacuaacaagguaaauucuguuauugagaaaaugaacacacaguuuaccgcagugggaaaggaguucaauaaacuugaacggcgcauggagaaccugaacaagaaagucgaugacggcuucaucgauauauggacuuacaaugcugaauugcuagugcugcucgagaacgaacgaacacuggaccuucaugacagcaauguaaagaaccuguaugagaagguuaaaucacaauugaagaauaacgccaaagaaauugggaauggaugcuuugaguucuaccacaaguguaacgaugagugcauggaaagugugaaaaaugguaccuaugacuaccccaaguauuccgaggaaagcaagcucaacagagagaaaaucgauggcgucaagcuggagucuauggggguguaccagaucuuagcuauuuauucaacggucgccaguagccuggugcuacucguuucccugggagcaaucucuuuuuggaugugcucgaauggcagccuucaguguaggauuugcauauga

SEQ ID NO: 124152 - RNA, 1698 nt, Artificial Sequence
  derived and/or modified sequence opt3 from hemagglutinin__InfluenzaA__ABW81527
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucaggaaucaggaaggacggaucaacuauuacuggacacuucuggagccaggugacacuauuaucuuugaggccaauggcaacuugauugcuccgcgcuucgccuuugcgcucucuagaggguucggauccggcaucauaaccagcaaugcacccauggaugaaugugacgccaagugccagacaccucaaggugcuauuaacucgucucugccauuucagaauguucaccccgugaccaucggggaguguccuaaauauguaagguccgccaaguuacggauggcaacgggacugcgcaacauuccaucaauccagagucgaggccucuucggcgcuaucgccggguuuauugaaggagguuggacuggcaugguggaugggugguacggauaucaucaccagaaugagcaaggcagcgguuacgcggccgaccagaaauccacacagaacgcaauaaaugggaucaccaacaaggucaauucugugauugaaaagaugaacacucaguucacagcuguuggcaaagaguucagcaaacuugagagaaggauggaaaaucugaacaagaagguggaugacggauuuuuggauaucuggaccuacaacgccgagcuacugguccuccuggaaaaugagcggacgcuugacuuccacgacucaaacgugaaaaaucuguaugaaaagguaaaaagucaauugaagaacaaugcuaaagagauaggcaacgggugcuuugaguucuaccauaaguguaaugaugaaugcauggaguccguuaagaacggaaccuaugacuaccccaaauauagcgaagagucuaagcucaaucgugagaaaauugauggugugaagcuggaaucaaugggcgucuaccagaucuuagccaucuauaguacaguggcaagcucccugguccuacucgugucucugggggccauuucguuuuggaugugcagcaacggaucccuucagugucgcaucugcauuuga

SEQ ID NO: 124153 - RNA, 1698 nt, Artificial Sequence
  derived and/or modified sequence opt3 from hemagglutinin__InfluenzaA__ABW81528
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggccauuuugcugacuacgaggaacugagagagcaacucucuucggugagcucauucgaaagguuugagauuuucccuaaggagaguuccuggccaaaucacacagucaccggugugucugccagcugcucccauaacgggaagucaaguuuuuaucggaauuuacuguggcuuacgggcaaaaacggauuguaccccaaucugagcaagucuuaugcaaacaauaaagaaaaggagguucuaguacucuggggcauccaccacccuccaaacauaggggaucagcgcgcccuguaccauacugaaaacgcuuacguguccgucgugucaagccacuauagucgacguuucacccccgagaucgcaaaaagaccuaaggugagggaccaggaaggacggauuaauuacuauuggacacuucuggagccacgcgauacuaucauuuuugaggccaacgguaauuugaucgcuccgagauucgccuuugcgcucucuaggggcuucggguccggaauaauuaccagcaacgcacccauggacgaaugugaugccaagugccagacaccucaaggcgcuaucaauucgucucugccauuucagaacguccaucccguuaccauuggugaguguccuaaauacgugcgguccgccaaguuacgcaugguaacggggcugcgaaauaucccaucaauccagaguagaggacucuucggcgcaauugcuggcuuuauagaagggggauggacugguaugguggacggcugguauggguaccaccaccagaacgagcaaggaagcggcuaugccgcggaucagaaauccacacagaaugccaucaacgguauuaccaauaaggucaacucugugaucgaaaagaugaauacucaguucacagcaguugggaaagaguucaacaaacuugagaggcggauggaaaaucugaacaagaagguggacgauggcuuuuuggacauauggaccuacaacgcugagcuacugguccuccuggaaaaugagcguacgcuugacuuccaugauagcaacgugaaaaaucuguacgaaaagguaaaaucacaauugaagaacaaugccaaagagauuggaaacggcugcuuugaguucuaucacaaguguaaugacgaaugcauggagaguguuaagaacgggaccuacgauuaucccaaauacuccgaagagagcaagcucaaucgcgagaaaaucgacggagugaagcuggaaucuaugggugucuaucagaucuuagcuauuuacucaacaguggccaguagccugguccuacucgugucccugggcgcaaucucuuuuuggaugugcucgaacgggagccuucaguguagaauuugcauauga

SEQ ID NO: 124154 - RNA, 1698 nt, Artificial Sequence
  derived and/or modified sequence opt3 from hemagglutinin__InfluenzaA__ABW81529
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguagagagagcugguccuacauuguggaaaccccaaauccggagaacggaacuuguuaucccggcuacuuugcugacuaugaggaacugagggagcaacucucuucgguuagcucauucgaacgguuugagaucuucccuaaagagaguuccuggccaaaucauacagugaccggugucucugccagcugcucccacaacgggaagucaaguuuuuaccgcaauuuacuguggcuuacgggaaagaacggcuuguaucccaaucugagcaaaucuuacgcaaacaauaaggaaaaagaggugcuaauacucuggggcguacaucacccuccaaacauccgagaucagaugacucuguaccacaccgaaaacgccuauguuuccguggucucaagccauuacagucguagauucacacccgagauuacuaagaggccuaaagugcgggaccaggaagggcgcaucaauuauuacuggacccuucuggagccaggagauacaauuaucuuugaggcuaacgguaauuugauagcaccgugguaugccuucgcucucucuagaggcuuuggguccggaauuaucaccagcaacgcccccauggacgaaugugaugcgaagugccagacgccuaagggcgcaauuaauucgucucugccauuccaaaacgugcaccccgucacuaucggugaguguccuaaauacguuagguccgccaaguuacggauggugacagggcugcgcaauaucccaucaauucagagucgaggacucuuuggcgcuauagccggcuucaucgaagggggauggaccgguaugguagacggcugguauggguaccaucaccagaacgagcagggaagcggcuacgcagcugaucaaaaauccacucagaaugccauuaacgguaucacaaauaaggugaacucugucauagaaaagaugaauacccaguuuacggcgguggggaaagaguucaacaaacuugagagaaggauggaaaaucugaacaagaagguugacgauggcuucuuggacauuuggaccuauaacgccgagcuacuggugcuccuggaaaaugagcggacacuugacuuucacgauagcaacgucaaaaaucuguacgaaaaggugaaaucacaguugaagaacaaugcaaaagagaucggaaacggcugcuucgaguuuuaucauaaguguaauaacgaaugcauggagaguguaaagaaugggacuuacgacuaucccaaauacuccgaagagagcaagcucaaccgugagaaaaucgauggaguuaagcuggaaucuauggguguguaucaaauuuuagcuaucuacucaaccgucgccaguagccuggugcuacucgucucccugggcgcuauuucuuucuggaugugcucgaaugggagccuucagugucgcauaugcaucuga

SEQ ID NO: 124155 - RNA, 1698 nt, Artificial Sequence
  derived and/or modified sequence opt3 from hemagglutinin__InfluenzaA__ABW81530
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuagcucauucgaaagguuugagaucuucccuaaggagaguuccuggccaaaucauacugugacaggugucucugcaagcugcucccacaacgggaagucaaguuuuuaccggaauuuacuguggcuuaccggcaaaaacggauuguaucccaaucugagcaagucuuacgccaacaauaaagaaaaggaggugcuaauacucuggggcguacaucacccuccaaacaucggggaucagcgcacgcuguaccacacugaaaacgcuuauguuuccguggucucaagccauuacagucgacguuucacccccgagauuacaaaaagaccuaaggugagggaccaggaaggacggaucaauuauuacuggacucuucuggagccaggugauaccauuaucuuugaggcaaacggcaauuugauagccccgugguaugcuuucgcccucucucgcggguuuggauccggcauuaucacaagcaacgcgcccauggacgaaugugaugcaaagugccagaccccucaaggugccauuaauucgucucugccauuccagaacgugcaccccgucacgaucggggaguguccuaaauacguuagauccgcuaaguuaaggauggugacuggacugcggaauaucccaucaauucagagucgcggccucuuuggcgccauagcaggguucaucgaaggagguuggacaggcaugguagacgggugguauggauaccaucaccagaacgagcaaggcagcgguuacgcugccgaucagaaauccacccagaaugcgauuaaccgaaucacuaauaaggugaacucugucauagaaaagaugaauacacaguuuaccgccguggggaaagaguucaacaaacuugagagaaggauggaaaaucugaacaagaagguugacgauggcuucuuggacauuuggacguauaacgcagagcuacuggugcuccuggaaaaugagcggacccuugacuuucacgauagcaacgucaaaaaucuguacgaaaaggugaaaucacaauugaagaacaaugcuaaagagaucggaaacggcugcuucgaguuuuaucauaaguguaauaacgaaugcauggagaguguaaagaaugggacauacgacuaucccaaauacuccgaagagagcaagcucaaccgugagaaaaucgauggaguuaagcuggacucuauggguguguaucagauuuuagccaucuacucaacugucgcuaguagccuggugcuacucgucucccugggcgccauuucuuucuggaugugcucgaaugggagccuucagugucgcauaugcaucuga

SEQ ID NO: 124156 - RNA, 1698 nt, Artificial Sequence; identical to SEQ ID NO: 122342
  derived and/or modified sequence opt3 from hemagglutinin__InfluenzaA__ABW81531

SEQ ID NO: 124157 - RNA, 1698 nt, Artificial Sequence
  derived and/or modified sequence opt3 from hemagglutinin__InfluenzaA__ABW81532
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccugguacuuugccgacuaugaggaacugagagagcaacucucuucgguuucaucuuucgaaagguuugagaucuucccuaaggagaguuccuggccaaaucauacugugacaggcgucucugcaagcugcucccacaacgguaagucaaguuuuuaccggaauuuacuguggcuuaccgggaaaaacggauuguaucccaaucugagcaagucuuacgccaacaauaaagaaaaggaggugcuaauacucuggggcguacaucacccuccaaacaucggcaaccagcgcacgcuguaccacacugaaaaugcuuauguuuccguggucucaagccauuacagucgacguuucacccccgagauuacaaaaagaccuaaggugagggaucaggaagggcggaucaacuauuacuggacucuucuggagccaggagacaccauuaucuuugaggcaaaugguaacuugauagccccgugguaugcuuucgcccucucucgcggcuuuggguccggaauuaucacaagcaaugcgcccauggaugaaugugacgcaaagugccagaccccucaaggcgccauuaacucgucucugccauuccagaaugugcaccccgucacgaucggugaguguccuaaauacguuagauccgcuaaguuaaggauggugacugggcugcggaacaucccaucaauucagagucgcggacucuuuggcgccauagcaggcuucaucgaagggggauggacagguaugguagauggcugguauggguaccaucaccagaaugagcaaggaagcggcuacgcugccgaccagaaauccacccagaacgcgauuaaugguaucacuaacaaggugaauagcgucauagaaaagaugaacacacaguuuaccgccguggggaaagaguucaauaaacuugagcgaagaauggaaaaccugaacaagaagguugaugacggcuucuuggauauuuggacguauaaugcagagcuacuggugcuccuggaaaacgagaggacccuugacuuucacgacagcaaugucaaaaaccuguacgaaaaggugaaaucacaauugaagaauaacgcuaaagagaucggaaauggcugcuucgaguuuuaucauaaguguaacaaugaaugcauggagaguguaaagaacgggacauacgauuaucccaaauacuccgaagagagcaagcucaaucgggagaaaaucgacggaguuaagcuggauucuauggguguguaucagauuuuagccaucuacucaacugucgcuaguagccuggugcuacucgucucccugggcgccauuucuuucuggaugugcucgaacgggagccuucagugucguauaugcaucuga

SEQ ID NO: 124158 - RNA, 1698 nt, Artificial Sequence; identical to SEQ ID NO: 123972
  derived and/or modified sequence opt3 from hemagglutinin__InfluenzaA__ABW86321

SEQ ID NO: 124159 - RNA, 1698 nt, Artificial Sequence; identical to SEQ ID NO: 123937
  derived and/or modified sequence opt3 from hemagglutinin__InfluenzaA__ABW86332

SEQ ID NO: 124160 - RNA, 1698 nt, Artificial Sequence; identical to SEQ ID NO: 123926
  derived and/or modified sequence opt3 from hemagglutinin__InfluenzaA__ABW86343

SEQ ID NO: 124161 - RNA, 1698 nt, Artificial Sequence; identical to SEQ ID NO: 123930
  derived and/or modified sequence opt3 from hemagglutinin__InfluenzaA__ABW86354

SEQ ID NO: 124162 - RNA, 1698 nt, Artificial Sequence; identical to SEQ ID NO: 123930
  derived and/or modified sequence opt3 from hemagglutinin__InfluenzaA__ABW86365

SEQ ID NO: 124163 - RNA, 1698 nt, Artificial Sequence; identical to SEQ ID NO: 123946
  derived and/or modified sequence opt3 from hemagglutinin__InfluenzaA__ABW86376

SEQ ID NO: 124164 - RNA, 1698 nt, Artificial Sequence; identical to SEQ ID NO: 123930
  derived and/or modified sequence opt3 from hemagglutinin__InfluenzaA__ABW86387

SEQ ID NO: 124165 - RNA, 1698 nt, Artificial Sequence; identical to SEQ ID NO: 123926
  derived and/or modified sequence opt3 from hemagglutinin__InfluenzaA__ABW86409

SEQ ID NO: 124166 - RNA, 1698 nt, Artificial Sequence; identical to SEQ ID NO: 123926
  derived and/or modified sequence opt3 from hemagglutinin__InfluenzaA__ABW86431

SEQ ID NO: 124167 - RNA, 1698 nt, Artificial Sequence; identical to SEQ ID NO: 123930
  derived and/or modified sequence opt3 from hemagglutinin__InfluenzaA__ABW86442

SEQ ID NO: 124168 - RNA, 1698 nt, Artificial Sequence; identical to SEQ ID NO: 123946
  derived and/or modified sequence opt3 from hemagglutinin__InfluenzaA__ABW86453

SEQ ID NO: 124169 - RNA, 1698 nt, Artificial Sequence; identical to SEQ ID NO: 123930
  derived and/or modified sequence opt3 from hemagglutinin__InfluenzaA__ABW86464

SEQ ID NO: 124170 - RNA, 1698 nt, Artificial Sequence; identical to SEQ ID NO: 123946
  derived and/or modified sequence opt3 from hemagglutinin__InfluenzaA__ABW86475

SEQ ID NO: 124171 - RNA, 1698 nt, Artificial Sequence; identical to SEQ ID NO: 123926
  derived and/or modified sequence opt3 from hemagglutinin__InfluenzaA__ABW86486

SEQ ID NO: 124172 - RNA, 1698 nt, Artificial Sequence; identical to SEQ ID NO: 123972
  derived and/or modified sequence opt3 from hemagglutinin__InfluenzaA__ABW86497

SEQ ID NO: 124173 - RNA, 1698 nt, Artificial Sequence; identical to SEQ ID NO: 123930
  derived and/or modified sequence opt3 from hemagglutinin__InfluenzaA__ABW86508

SEQ ID NO: 124174 - RNA, 1698 nt, Artificial Sequence
  derived and/or modified sequence opt3 from hemagglutinin__InfluenzaA__ABW86519
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggaggugcuaguucucuggggcgugcaucacccuccaaacaucggggaucagcgcgcccuguaccacacugaaaacgcuuaugucuccguggugucaagccauuacagucgacguuucacccccgagauagcaaaaagaccuaaggucaggaaucaggaaggacggaucaacuauuacuggacacuucuggagccaggugacacuauuaucuuugaggccaauggcaacuugauugcuccgcgcuucgccuuugcgcucucuagaggguucggauccggcaucauaaccagcaaugcacccaugggugaaugugaugccaagugccagacaccucaaggggcuauuaacucgucucugccauuucagaauguucaccccgugaccaucggagaguguccuaaauauguaagguccgccaaguuacggauggugacgggccugcgcaacauuccaucaauccagagucgaggccucuucggggcaaucgcuggauuuauugaagguggcuggacugggauggucgacggaugguacggcuaucaucaccagaaugagcaagguagcggguacgccgcggaucagaaauccacacagaacgccauaaauggcaucaccaacaagguaaauucuguuauugaaaagaugaacacucaguucacagcagugggaaaagaguucaauaaacuugagagaaggauggaaaaccugaacaagaaggucgacgauggcuuuuuggacaucuggaccuacaaugcugagcuacuggugcuccuggaaaacgagcggacgcuugauuuccacgacagcaauguuaaaaaccuguaugaaaagguaaaaucacaauugaagaauaacgccaaagagauagggaauggaugcuuugaguucuaccauaaguguaacgacgaaugcauggagagugugaagaaugguaccuaugauuaccccaaauauuccgaagagagcaagcucaaccgugagaaaauugacggcgucaagcuggaaucuauggggguguaccagaucuuagcuaucuauucaacagucgccaguagccuggugcuacucguuucccugggagcaauuucuuuuuggaugugcucgaauggcagccuucagugucgcaucugcauuuga

SEQ ID NO: 124175 - RNA, 1698 nt, Artificial Sequence; identical to SEQ ID NO: 123926
  derived and/or modified sequence opt3 from hemagglutinin__InfluenzaA__ABW86530

SEQ ID NO: 124176 - RNA, 1698 nt, Artificial Sequence
  derived and/or modified sequence opt3 from hemagglutinin__InfluenzaA__ABW86541
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccugguuaaaucauacagucaccggugugucugccagcugcucccacaacgggaagucaaguuuuuaccggaaucugcuuugguugacgggcaaaaacggacuguauccaaaucuaagcaagucuuacgcaaacaauaaagaaaaggagguacucguucuguggggcgugcaucaucccccuaacaucggggaucagcgcgcccuuuaccacacugaaaacgcuuaugucuccguggugucaagccacuacagucgacguuucaccccagagauagcaaaaagacccaaggucagggaccaggaaggacggaucaauuauuacuggacacuguuggagccuggugauacuauuaucuuugaggccaacggcaaucucauugcuccacgcuucgccuuugcgcugucuagaggguucggauccggcaucauaaccagcaacgcaccgaugggugaaugugacgccaagugccagacaccccaaggggcuauuaauucgucuuuaccuuuucagaacguucacccagugaccaucggagagugucccaaauauguaagguccgccaagcugcggauggugacgggccuccgcaauauuccuucaauccagagucgaggccuuuucggggcaaucgcuggauuuauugaagguggcuggacugggauggucgauggaugguacggcuaucaucaccagaacgagcaagguagcggguacgccgcggaccagaaauccacacagaaugccauaaacggcaucaccaauaaggugaacucuguuauugaaaagaugaauacucaguucacagcagugggaaaagaguucaacaaacuggagagaaggauggaaaauuugaacaagaaggucgaugacggcuuucuagauaucuggaccuacaacgcugagcugcucgugcugcuugaaaaugagcggacgcuggacuuccacgacagcaacguuaaaaauuuguaugaaaagguaaaaucacaacucaagaacaaugccaaagagauagggaacggaugcuuugaguucuaccauaaguguaaugaugaaugcauggagagugugaagaacgguaccuaugacuacccaaaauauuccgaagagagcaagcugaaucgugagaaaauugauggcgucaaguuagaaucuauggggguguaccagauccuggcuaucuauucaacagucgccaguagccuagugcuccugguuucccuuggagcaauuucuuuuuggaugugcucgaacggcagcuugcagugucgcaucugcauuuga

SEQ ID NO: 124177 - RNA, 1698 nt, Artificial Sequence; identical to SEQ ID NO: 123926
  derived and/or modified sequence opt3 from hemagglutinin__InfluenzaA__ABW86552

SEQ ID NO: 124178 - RNA, 1701 nt, Artificial Sequence
  derived and/or modified sequence opt3 from hemagglutinin__InfluenzaA__ABW86563
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacagcgaaaugaauaaauuguucgagaagaccaaaaagcagcuaagggaaaacgcugaggauaugggcaauggaugcuuuaagaucuaccacaaaugugacaacgccugcauuggcucaauccggaaugggacauaugaucaugacguguaccgagacgaggcucugaacaaucgcuuccagauuaagggagucgaacucaaaaguggucacaaggauuggauccuguggauauccuuugccaucagcugcuuccuucuguguguggcauugcucggcuuuauuaugugggccugccagaaagggaacaucagauguaauauuugcaucuga

SEQ ID NO: 124179 - RNA, 1698 nt, Artificial Sequence; identical to SEQ ID NO: 123963
  derived and/or modified sequence opt3 from hemagglutinin__InfluenzaA__ABW86606

SEQ ID NO: 124180 - RNA, 1701 nt, Artificial Sequence; identical to SEQ ID NO: 122937
  derived and/or modified sequence opt3 from hemagglutinin__InfluenzaA__ABW91185

SEQ ID NO: 124181 - RNA, 1701 nt, Artificial Sequence
  derived and/or modified sequence opt3 from hemagglutinin__InfluenzaA__ABW91196
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaaguuuaaguauccagcacugaacgugaccaugcccaacaaugagaaauucgauaaacuuuacauuuggggaguccaccauccuggcacagacaacgaucagaucuuuuuguaugcccaggcuagcggccguauuacugugucuaccaagagaucccaacagacaguaaucccaaauauagggucaaggccccggguucgcaacauuccuagcagaaucaguauuuacuggaccaucgugaagccaggagacauccugcuaauuaauucuacggguaaccucauagccccgaggggcuacuucaaaauccgguccggaaagagcucgauuaugcgcucugaugcgcccaucgggaaguguaauuccgaaugcauaacuccuaacggcucaauuccaaaugacaaacccuuucagaacgucaaucgaaucacauauggugcauguccuagauacgugaagcagaacacccugaaacuugccacugggaugaggaaugugccagagaagcaaacacggggaaucuucggcgcuauugccggcuuuaucgaaaacgggugggagggaauggucgacgguugguauggcuuccgucaccagaauagugaggggauuggacaggcagcugaucugaaaagcacccaagccgcgauagaccagaucaacggcaaguugaaccgccucauugguaaaacgaaugaaaaguuccaccagaucgagaaggaauuuuccgagguugaagggagaauccaggaucuggagaaauacguggaggacaccaagauugauuuauggucuuauaacgccgaacugcucguagcacuugagaaucaacauacaauagaccugacugauagcgaaaugaacaaauuguucgagaagaccaaaaagcagcuaagggaaaaugcugaggacaugggcaacggaugcuuuaagaucuaccacaaaugugauaaugccugcauuggcucaauccggaacgggacauaugaccaugauguguaccgagacgaggcucugaauaaccgcuuccagauuaagggagucgaacucaaaagugguuacaaggacuggauccuguggauauccuuugccaucagcugcuuccuucuguguguggcauugcucggcuuuauuaugugggccugccagaaagggaauaucagauguaacauuugcaucuga

SEQ ID NO: 124182 - RNA, 1701 nt, Artificial Sequence; identical to SEQ ID NO: 124181
  derived and/or modified sequence opt3 from hemagglutinin__InfluenzaA__ABW91207

SEQ ID NO: 124183 - RNA, 1698 nt, Artificial Sequence; identical to SEQ ID NO: 123926
  derived and/or modified sequence opt3 from hemagglutinin__InfluenzaA__ABW91218

SEQ ID NO: 124184 - RNA, 1701 nt, Artificial Sequence; identical to SEQ ID NO: 123944
  derived and/or modified sequence opt3 from hemagglutinin__InfluenzaA__ABW91240

SEQ ID NO: 124185 - RNA, 1701 nt, Artificial Sequence
  derived and/or modified sequence opt3 from hemagglutinin__InfluenzaA__ABW91251
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagucuggagauauccugcuaauuaacuccacggguaaucucauagccccaaggggcuacuucaaaauccggagcgggaagucgucuauuaugcgcuccgacgcgccgaucggaaaguguaacucagaaugcauaacucccaauggcaguauuccuaacgacaaaccauuucagaaugucaaccgaaucacauauggugcaugucccagauacgugaagcagaauacccugaaacuugccacugggaugaggaacgugccugagaagcaaacacggggaaucuucggcgcuauugccggcuuuaucgaaaaugggugggagggaauggucgaugguugguauggcuuccgucaccagaacagcgaggggauuggacaggcagcugaccugaaauccacccaagccgcgauagaucagaucaauggcaaguugaaccgccucauugguaaaacgaacgaaaaguuccaccagaucgagaaggaauuuucugagguugaagggagaauccaggaccuggagaaauacguggaggauaccaagauugacuuauggagcuauaaugccgaacugcucguagcacuugagaaccaacauacaauagaucugacugacucagaaaugaauaaauuguucgagaagaccaaaaagcagcuaagggaaaacgcugaggauaugggcaauggaugcuuuaagaucuaccacaaaugugacaacgccugcauuggcaguauccggaaugggacauaugaucaugacguguaccgagacgaggcucugaacaaucgcuuccagauuaagggagucgaacucaaauccgguuacaaggauuggauccuguggaucagcuuugccauaucuugcuuccuucuguguguggcauugcucggcuuuauuaugugggccugccagaaagggaacaucagauguaauauuugcaucuga

SEQ ID NO: 124186 - RNA, 1701 nt, Artificial Sequence; identical to SEQ ID NO: 123944
  derived and/or modified sequence opt3 from hemagglutinin__InfluenzaA__ABW91262

SEQ ID NO: 124187 - RNA, 1698 nt, Artificial Sequence; identical to SEQ ID NO: 123961
  derived and/or modified sequence opt3 from hemagglutinin__InfluenzaA__ABW91273

SEQ ID NO: 124188 - RNA, 1698 nt, Artificial Sequence
  derived and/or modified sequence opt3 from hemagglutinin__InfluenzaA__ABW91284
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacuacaaccggugucucugccagcugcucccauaacggggaaucaaguuuuuauaagaauuuacuguggcuuacgggaaagaacggcuuguaccccaaucugagcaagucuuaugcaaacaauaaagagaaggaagugcuaguacucuggggcguucaccacccuccaaacaucggggaucagcgcgcccuguaccauacugagaacgcuuacguguccgucgugucaagccacuauagucgaaaauucacccccgaaauagcaaagcguccuaaggugagagaccaggagggaaggaucaauuacuauuggacacuucuggagccaggugauacuauuaucuuugaagccaacggcaauuugauugcuccgcgguacgccuucgcgcucucucgcggguuuggauccggcaucauaaacagcaaugcaucgaugggugagugugacgccaaaugccagacaccccaaggggcuauuaacucuucccugccuuuccagaauguccauccaguuaccaucggagaaugucccaaguaugugagaucagccaaauuaaggaugguaaccggccugcggaacauuccuaguauccagagccgcggccucuuuggggcaaucgcuggauucauugaggguggcuggacggggaugguggauggaugguacggcuaucaccaccagaaugaacaagguuccggguacgccgcggaccagaagucuacucagaacgccauaaauggcaucacaaacaaagucaauagcgugauugagaagaugaacacccaguuuacugcaguuggaaaagaguucaauaaacuugaacgaagaauggagaaccugaacaagaaaguggaugacggcuucaucgauauauggacauacaaugcugaauugcuaguccugcucgagaacgaaaggacccuggacuuucaugacucaaaugugaagaaccuuuaugagaaaguaaagagucaacugaaaaauaacgccaaggagauugggaauggaugcuucgaauuuuaccacaaguguaacgaugagugcauggaauccguuaaaaaugguacguaugacuacccaaaguauagcgaggagucuaaauugaaccgggaaaagaucgauggcgugaaacucgagucaaugggggucuaccagauccuggcuauuuauaguaccguggccagcuccuuaguccugcuagugucucucggagcaaucucguucuggaugugcagcaauggcucccugcagugucguauuugcauauga

SEQ ID NO: 124189 - RNA, 1698 nt, Artificial Sequence; identical to SEQ ID NO: 123961
  derived and/or modified sequence opt3 from hemagglutinin__InfluenzaA__ABW91295

SEQ ID NO: 124190 - RNA, 1698 nt, Artificial Sequence; identical to SEQ ID NO: 123930
  derived and/or modified sequence opt3 from hemagglutinin__InfluenzaA__ABW91306

SEQ ID NO: 124191 - RNA, 1698 nt, Artificial Sequence; identical to SEQ ID NO: 123930
  derived and/or modified sequence opt3 from hemagglutinin__InfluenzaA__ABW91317

SEQ ID NO: 124192 - RNA, 1698 nt, Artificial Sequence
  derived and/or modified sequence opt3 from hemagglutinin__InfluenzaA__ABW91328
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccacgaaguuacggaugguaacuggacugcgcaauaucccaucaauccagagucgaggccucuucggcgccauugcaggguuuauagaaggagguuggacaggcaugguggacgggugguacggauaucaucaccagaacgagcaaggcagcgguuacgcugccgaucagaaauccacccagaaugcgaucaacgggauuacuaauaaggucaacucugugaucgaaaagaugaauacacaguucaccgccguuggcaaagaguucaacaaacuugagagaaggauggaaaaucugaacaagaagguggacgauggauuuuuggacauauggacguacaacgcagagcuacugguccuccuggaaaaugagcggacccuugacuuccacgauagcaacgugaaaaaucuguaugaaaagguacguucacaauugaaaaacaaugcuaaggagauuggcaacgggugcuuugaguucuaccauaaauguaaugacgaaugcauggagaguguuaagaacggaacauaugauuaccccaaguauuccgaagagagcaaacucaaucgcgagaagaucgacggugugaaacuggaaucuaugggcgucuaccagaucuuagccauuuauucaacuguggcuaguagccugguccuacucgugucccugggggccaucucuuuuuggaugugcucgaacggaagccuucaguguagaauuugcauauga

SEQ ID NO: 124193 - RNA, 1698 nt, Artificial Sequence; identical to SEQ ID NO: 123930
  derived and/or modified sequence opt3 from hemagglutinin__InfluenzaA__ABW91339

SEQ ID NO: 124194 - RNA, 1698 nt, Artificial Sequence; identical to SEQ ID NO: 123930
  derived and/or modified sequence opt3 from hemagglutinin__InfluenzaA__ABW91350

SEQ ID NO: 124195 - RNA, 1698 nt, Artificial Sequence
  derived and/or modified sequence opt3 from hemagglutinin__InfluenzaA__ABW91361
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacggggaaucaaguuuuuaccggaauuuacuguggcuuacgggaaagaacggcuuguaucccaaucugagcaaaucuuacgcaaacaauaaggagaaagaaguucuaguacucuggggcgugcaucacccuccaaacaucggggaucagcgcgcccuguaccacacugagaacgcuuaugucuccguggugucaagccauuacagucgacguuucacccccgaaauagcaaagagaccuaaagucagggaccaggagggacggaucaauuauuacuggacacuucuggagccaggugauacuauuaucuuugaagccaacggcaauuugauugcuccgcgcuucgccuuugcgcucucuagaggguucggauccggcaucauaaccagcaacgcacccauggacaagugugaugccaagugccagacaccucaaggugcuauuaauucgucucugccauuucagaacguucaccccgugaccaucggggaguguccuaaauauguaagguccacgaaguuacggauggugacuggacugcgcaauauuccaucaauccagacacgaggccucuucggcgccaucgcaggguuuauugaaggagguuggaccggcauggucgacgggugguacggauaucaucaccagaacgagcaaggcagugguuacgcugccgaucagaaaagcacucagaaugcgauaaacgggaucacaaauaaggugaacuccguuauugaaaagaugaauacccaguucacggccgugggcaaagaguucaacaaacuugagagaaggauggaaaaucugaacaagaaggucgacgauggauuuuuggacaucuggaccuacaacgcagagcuacuggugcuccuggaaaaugagcggacacuugacuuccacgauucuaacguuaaaaaucuguaugaaaagguaaaaagccaauugaagaacaaugcuaaagagauaggcaacgggugcuuugaguucuaccauaaguguaaugacgaaugcauggagucagugaagaacggaacuuaugauuaccccaaauauagugaagaguccaagcucaaucgugagaaaauugacggugucaagcuggaaagcaugggcguguaccagaucuuagccaucuauucuaccgucgcuucaagucuggugcuacucguuagccugggggccauuuccuuuuggaugugcucuaacggaucgcuucagugucgcaucugcauuuga

SEQ ID NO: 124196 - RNA, 1698 nt, Artificial Sequence; identical to SEQ ID NO: 123930
  derived and/or modified sequence opt3 from hemagglutinin__InfluenzaA__ABW91372

SEQ ID NO: 124197 - RNA, 1698 nt, Artificial Sequence; identical to SEQ ID NO: 123963
  derived and/or modified sequence opt3 from hemagglutinin__InfluenzaA__ABW91383

SEQ ID NO: 124198 - RNA, 1701 nt, Artificial Sequence; identical to SEQ ID NO: 124003
  derived and/or modified sequence opt3 from hemagglutinin__InfluenzaA__ABW91394

SEQ ID NO: 124199 - RNA, 1698 nt, Artificial Sequence; identical to SEQ ID NO: 123972
  derived and/or modified sequence opt3 from hemagglutinin__InfluenzaA__ABW91405

SEQ ID NO: 124200 - RNA, 1698 nt, Artificial Sequence
  derived and/or modified sequence opt3 from hemagglutinin__InfluenzaA__ABW91416
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcaagucuuacgcaaacaauaaagaaaaggagguucuaguacucuggggcgugcaucacccuccaaacaucggggaucagaaagcccuguaccacacugaaaacgcuuaugucuccguggugucaagccauuacagucgccgauucacccccgagauagcaaagcguccuaaggucagagaccaggaaggaaggaucaauuauuacuggacacuucuggagccaggugauacuauuaucuuugaggccaacggcaauuugauugcuccgcgguucgccuuugcgcucucucgcggguucggauccggcaucauaaccagcaacgcacccaugggugaaugugacgccaaaugccagacaccucaaggggcuauuaauucgucucugccauuucagaacguucaccccgugaccaucggagaguguccuaaguauguaagauccgccaaauuaaggauggugacgggccugcggaauauuccaucaauccagagucgcggccucuucggggcaaucgcuggauuuauugaagguggcuggacugggauggucgauggaugguacggcuaucaucaccagaacgagcaagguagcggguacgccgcggaccagaaguccacacagaaugccauaaacggcaucaccaauaaagugaacucuguuauugaaaagaugaauacucaguucacagcagugggaaaagaguucaacaaacuugagcgaagaauggaaaaucugaacaagaaagucgaugacggcuuuuuggauaucuggaccuacaacgcugagcuacuggugcuccuggaaaaugagaggacgcuugacuuccacgacagcaacguaaagaaucuguaugaaaaaguuaagucacaauugaaaaacaaugccaaggagauagggaacggaugcuuugaguucuaccauaaguguaaugaugaaugcauggagagugugaaaaacgguaccuaugacuaccccaaguauuccgaagagagcaaacucaaucgggagaagauugauggcgucaaacuggaaucuauggggguguaccagaucuuagcuaucuauucaacagucgccaguagccuggugcuacucguuucccugggagcaauuucuuuuuggaugugcucgaacggcagccuucagugucguaucugcauuuga

SEQ ID NO: 124201 - RNA, 1698 nt, Artificial Sequence; identical to SEQ ID NO: 124075
  derived and/or modified sequence opt3 from hemagglutinin__InfluenzaA__ABW91427

SEQ ID NO: 124202 - RNA, 1701 nt, Artificial Sequence; identical to SEQ ID NO: 123944
  derived and/or modified sequence opt3 from hemagglutinin__InfluenzaA__ABW91438

SEQ ID NO: 124203 - RNA, 1698 nt, Artificial Sequence; identical to SEQ ID NO: 123972
  derived and/or modified sequence opt3 from hemagglutinin__InfluenzaA__ABW91449

SEQ ID NO: 124204 - RNA, 1698 nt, Artificial Sequence; identical to SEQ ID NO: 123972
  derived and/or modified sequence opt3 from hemagglutinin__InfluenzaA__ABW91460

SEQ ID NO: 124205 - RNA, 1698 nt, Artificial Sequence
  derived and/or modified sequence opt3 from hemagglutinin__InfluenzaA__ABW91471
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaguggcgccccuucagcuggguaauuguucaguugccggcuggauauuggggaacccugagugcgaacuccugaucaguaaagagagcugguccuacauuguggaaaccccaaauccggagaacggaacuuguuaucccggcuacuuugcugacuaugaggaacugagagagcaacucucuucggucagcucauucgaaagguuugagaucuucccuaaggagaguuccuggccaaaucauacagugaccgguguaucugccagcugcucccacaacgggaagucaaguuuuuaccggaauuuacuguggcuuacgggcaaaaacggauuguaucccaaucugagcaagucuuacgcaaacaauaaagaaaaggagguucuagugcucuggggcguccaucacccuccaaacauuggggaucagcgcgcccuguaccacacugaaaacgcuuauguguccguggucucaagccauuacagucgacguuucacccccgagaucgcaaaaagaccuaagguuagggaccaggaaggacggauaaauuauuacuggacacuucuggagccaggugauacuaucauuuuugaggccaacggcaauuugaucgcuccgcgcuucgccuuugcgcucucuagaggguucggauccggcauuaucaccagcaacgcacccauggacgaaugugaugccaagugccagacaccucaaggugcuauaaauucgucucugccauuucagaacgugcaccccguaaccauuggggaguguccuaaauaugugagguccacgaaguuacggauggucacuggacugcgcaauaucccaucaauucagagucgaggccucuucggcgccaucgcaggguuuaucgaaggagguuggacaggcaugguggacgggugguacggauaucaucaccagaacgagcaaggcagcgguuacgcugccgaucagaaauccacccagaaugcgauuaacgggauaacuaauaagguuaacucugugaucgaaaagaugaauacacaguucaccgccgucggcaaagaguucaacaaacuugagagaaggauggaaaaucugaacaagaagguggacgauggauuuuuggacauuuggacguacaacgcagagcuacugguacuccuggaaaaugagcggacccuugacuuccacgauagcaacguuaaaaaucuguaugaaaaggugaaaucacaauugaagaacaaugcuaaagagaucggcaacgggugcuuugaguucuaccauaaguguaaugacgaaugcauggagagugucaagaacggaacauaugauuaccccaaauauuccgaagagagcaagcucaaucgugagaaaauagacggugugaagcuggaaucuaugggcgucuaccagauuuuagccaucuauucaacuguggcuaguagccugguucuacucgugucccugggggccaucucuuuuuggaugugcucgaacggaagccuucagugucgcauuugcaucuga

SEQ ID NO: 124206 - RNA, 1698 nt, Artificial Sequence
  derived and/or modified sequence opt3 from hemagglutinin__InfluenzaA__ABW91482
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugauuucaaaagagaguuggagcuacaucguugaaaccccaaauccggagaacggaacuuguuaucccggcuacuuugcugacuaugaggaacugagggagcaacucuccucugugucgucauucgaacgguuugagauuuucccuaaggagagcaguuggccaaaucauacagucaccgguguguccgccucuugcagccacaacgggcgcuccucauuuuaccgaaauuuacuguggcuuacgggaaagaacggcuuguaucccaaucugagucguagcuacgcaaacaauaaagaaaaggagguucuaguacucuggggcgugcaucacccuccaaacaucggggaucagagagcccuguaccacacugaaaacgcuuaugucucugugguguccucacauuacagcaggcgguucacccccgagauagcaaaacgcccuaaggucagagaccaggaaggaaggaucaauuauuacuggacacuucuggagccaggugauacuauuaucuuugaggccaacggcaauuugauugcuccgcgguucgccuuugcgcucagucgcggguucggaucuggcaucauaaccuccaacgcacccauggacgaaugugaugccaaaugccagacaccucaaggugcuauuaauagcucgcugccauuucagaacguucaccccgugaccaucggggaguguccuaaguauguacgaucugccaaguuaagaauggugacgggacugaggaauauuccauccauccagucacggggccucuucggcgcaaucgcuggguuuauugaaggagguuggacuggcauggucgacgggugguacggauaucaucaccagaacgagcaaggcagugguuacgccgcggaucagaaaagcacacagaaugccauaaacgggaucaccaauaaggugaacuccguuauugaaaagaugaauacucaguucacagcagugggcaaagaguucaacaaacuugagcgucgcauggaaaaucugaacaagaaagucgacgauggauuuuuggacaucuggaccuacaacgcugagcuacuggugcuccuggaaaaugagagaacgcuugacuuccacgauucuaacguaaagaaucuguaugaaaagguuaaaagccaauugaagaacaaugccaaagagauaggcaacgggugcuuugaguucuaccauaaguguaaugacgaaugcauggagucagugaaaaacggaaccuaugauuaccccaaguauagugaagaguccaagcucaauagggagaaaauugacggugucaagcuggaaagcaugggcguguaccagaucuuagcuaucuauucuacagucgccucaagucuggugcuacucguuagccugggggcaauuuccuuuuggaugugcucuaacggaucgcuucagugucggaucugcauuuga

SEQ ID NO: 124207 - RNA, 1698 nt, Artificial Sequence
  derived and/or modified sequence opt3 from hemagglutinin__InfluenzaA__ABW91493
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccacgaaguuacggaugguaacuggacugcgcaauaucccaucaauccagagucgaggccucuucggcgccauugcaggguuuauagaaggagguuggacaggcaugguggacgggugguacggauaucaucaccagaacgagcaaggcagcgguuacgcugccgaucagaaauccacccagaaugcgaucaacgggauuacuaauaaggucaacucugugaucgaaaagaugaauacacaguucaccgccguuggcaaagaguucaacaaacuugagaagagaauggaaaaucugaacaagaaaguggacgauggauuuuuggacauauggacguacaacgcagagcuacugguccuccuggaaaaugagaggacccuugacuuccacgauagcaacgugaagaaucuguaugaaaaaguaaagucacaauugaaaaacaaugcuaaggagauuggcaacgggugcuuugaguucuaccauaaguguaaugacgaaugcauggagaguguuaaaaacggaacauaugauuaccccaaguauuccgaagagagcaaacucaaucgggagaagaucgacggugugaaacuggaaucuaugggcgucuaccagaucuuagccauuuauucaacuguggcuaguagccugguccuacucgugucccugggggccaucucuuuuuggaugugcucgaacggaagccuucagugucguauuugcauauga

SEQ ID NO: 124208 - RNA, 1698 nt, Artificial Sequence; identical to SEQ ID NO: 123946
  derived and/or modified sequence opt3 from hemagglutinin__InfluenzaA__ABW91504

SEQ ID NO: 124209 - RNA, 1698 nt, Artificial Sequence
  derived and/or modified sequence opt3 from hemagglutinin__InfluenzaA__ABW91515
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugauuucaaaagagaguuggagcuacguuguggaaaccccaaauccggagaacggaacuuguuaucccggcuacuuugcugacuaugaggaacugagggagcaacucuccucugucucgucauucgaacgguuugagaucuucccuaaggagagcaguuggccaaaucauacagugaccgguguauccgccucuugcagccacaacgggaaguccucauuuuaccgcaauuuacuguggcuuacgggcaaaaacggauuguaucccaaucugaguaagagcuacgcaaacaauaaagaaaaggagguucuagugcucuggggcguccaucacccuccaaacauuggggaucagcgagcccuguaccacacugaaaacgcuuaugugucuguggucuccucacauuacagccguagauucacccccgagaucgcaaaaaggccuaagguucgggaccaggaaggacgcauaaauuauuacuggacacuucuggagccaggugauacuaucauuuuugaggccaacggcaauuugaucgcuccgagauucgccuuugcgcucaguaggggguucggaucuggcauuaucaccuccaacgcacccauggacgaaugugaugccaagugccagacaccucaaggugcuauaaauagcucgcugccauuucagaacgugcaccccguaaccauuggggaguguccuaaauaugugcggucugccaaguuacgcauggucacgggacugcgaaauaucccauccauucagucaagaggccucuucggcgcaaucgcuggguuuaucgaaggagguuggacuggcaugguggacgggugguacggauaucaucaccagaacgagcaaggcagugguuacgccgcggaucagaaaagcacacagaaugccauuaacgggauaaccaauaagguuaacuccgugaucgaaaagaugaauacucaguucacagcagucggcaaagaguucaacaaacuugagaggcggauggaaaaucugaacaagaagguggacgauggauuuuuggacauuuggaccuacaacgcugagcuacugguacuccuggaaaaugagcguacgcuugacuuccacgauucuaacguuaaaaaucuguaugaaaaggugaaaagccaauugaagaacaaugccaaagagaucggcaacgggugcuuugaguucuaccauaaguguaaugacgaaugcauggagucagucaagaacggaaccuaugauuaccccaaauauagugaagaguccaagcucaaucgcgagaaaauagacggugugaagcuggaaagcaugggcgucuaccagauuuuagcuaucuauucuacaguggccucaagucugguucuacucgugagccugggggcaaucuccuuuuggaugugcucuaacggaucgcuucaguguagaauuugcaucuga

SEQ ID NO: 124210 - RNA, 1698 nt, Artificial Sequence
  derived and/or modified sequence opt3 from hemagglutinin__InfluenzaA__ABW91526
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaacaggagggacggaucaauuauuacuggacacuucuggagccaggugacacuauuaucuuugaagccaacggcaauuugauugcuccgcgcuucgccuuugcgcucucuagaggguucggauccggcaucauaaccagcaacgcacccauggaugagugugacgccaagugccagacaccucaaggugcuauuaauucgucucugccauuucagaacguucaccccgugaccaucggggaauguccuaaauauguaagguccacgcgguuacgcauggugacuggacugcgaaauauuccaucaauccagaguagaggccucuucggcgccaucgcaggguuuauugagggagguuggacaggcauggucgaugggugguacggauaucaucaccagaacgaacaaggcagcgguuacgcugccgaccagaaguccacccagaaugcgauaaacgggaucacuaauaaagugaacucuguuauugagaagaugaauacacaguucaccgccgugggcaaagaguucaacaaacuugaaaggcggauggagaaucugaacaaaaaggucgaugacggauuuuuggauaucuggacguacaacgcagaacuacuggugcuccuggagaaugaacguacccuugacuuccacgacagcaacguaaagaaucuguaugagaaaguuaagucacaauugaaaaacaaugcuaaggagauaggcaacgggugcuuugaguucuaccauaaauguaaugaugaaugcauggaaagugugaagaacggaacauaugacuaccccaaguauuccgaggagagcaaacucaaucgcgaaaagauugauggugucaaacuggagucuaugggcguguaccagaucuuagccaucuauucaacugucgcuaguagccuggugcuacucguuucccugggggccauuucuuuuuggaugugcucgaacggaagccuucaguguagaaucugcauuuga

SEQ ID NO: 124211 - RNA, 1698 nt, Artificial Sequence; identical to SEQ ID NO: 123930
  derived and/or modified sequence opt3 from hemagglutinin__InfluenzaA__ABW91537

SEQ ID NO: 124212 - RNA, 1701 nt, Artificial Sequence; identical to SEQ ID NO: 124003
  derived and/or modified sequence opt3 from hemagglutinin__InfluenzaA__ABW91548

SEQ ID NO: 124213 - RNA, 1698 nt, Artificial Sequence
  derived and/or modified sequence opt3 from hemagglutinin__InfluenzaA__ABW91559
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccacgaaguuacggaugguaacuggacugcgcaauaucccaucaauccagagucgaggccucuucggcgccauugcaggguuuauagaaggagguuggacaggcaugguggacgggugguacggauaucaucaccagaacgagcaaggcagcgguuacgcugccgaucagaaauccacccagaaugcgaucaacgggauuacuaauaaggucaacucugugaucgaaaagaugaauacacaguucaccgccguuggcaaagaguucaacaaacuugagagaaggauggaaaaucugaacaagaagguggacgauggauuuuuggacauauggacguacaacgcagagcuacugguccuccuggaaaaugagcggacccuugacuuccacgauagcaacgugaaaaaucuguaugaaaagguaaaaucacaauugaagaacaaugcuaaagagauuggcaacgggugcuuugaguucuaccauaaguguaaugacgaaugcauggagaguguuaagaacggaacauaugauuaccccaaauauuccgaagagagcaagcucuaccgugagaaaaucgacggugugaagcuggaaucuaugggcgucuaucagaucuuagccauuuacucaacuguggcuaguagccugguccuacucgugucccugggggccaucucuuuuuggaugugcucgaauggaagccuucagugucgcauuugcauauga

SEQ ID NO: 124214 - RNA, 1698 nt, Artificial Sequence; identical to SEQ ID NO: 124071
  derived and/or modified sequence opt3 from hemagglutinin__InfluenzaA__ABW91570

SEQ ID NO: 124215 - RNA, 1698 nt, Artificial Sequence; identical to SEQ ID NO: 123946
  derived and/or modified sequence opt3 from hemagglutinin__InfluenzaA__ABW91581

SEQ ID NO: 124216 - RNA, 1698 nt, Artificial Sequence; identical to SEQ ID NO: 123926
  derived and/or modified sequence opt3 from hemagglutinin__InfluenzaA__ABW91592

SEQ ID NO: 124217 - RNA, 1698 nt, Artificial Sequence; identical to SEQ ID NO: 123972
  derived and/or modified sequence opt3 from hemagglutinin__InfluenzaA__ABW91603

SEQ ID NO: 124218 - RNA, 1698 nt, Artificial Sequence
  derived and/or modified sequence opt3 from hemagglutinin__InfluenzaA__ABW91614
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaucuccggagaauggaacuuguuaucccggcuacuuugcugacuaugaggaacugagagagcaacucucgucagugagcaguuucgaaagguuugagauuuucccuaaggaguccucuuggccaaaccauacagucaccggugugagcgccuccugcucacacaaugggaagaguagcuuuuaccggaacuuacuguggcuuacgggcaaaaauggauuguaucccaaccugucuaaguccuacgcaaauaacaaagaaaaggaggugcuaguucucuggggcgugcaucacccuccaaauaucggggaucagcgcgcccuguaccacacugaaaacgcuuaugucucaguggugagcagucauuacucucgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucuccagaggguucggaagcggcaucauaucgucuaaugcacccaugggugaaugugacgccaagugccagaccccucaaggggcuauuaacuccucacugccauuucagaauguucaccccgugacaaucggagaguguccuaaauauguaaggagugccaaguuacggauggugaccggccugcgcaacauuccaagcauccagucccgaggccucuucggggcaaucgcuggauuuauugaagguggcuggacggggauggucgauggaugguacggcuaucaucaccagaaugagcaagguucuggguacgccgcggaccagaaaagcacucagaacgccauaaauggcaucacaaacaagguaaauucaguuauugaaaagaugaacacccaguucacugcagugggaaaagaguucaauaaacuugagagaaggauggaaaaccugaauaagaaggucgaugacggcuuuuuggauaucuggacauacaacgcugagcuacuggugcuccuggaaaacgagcggacccuugacuuccacgacaguaauguuaaaaaccuguaugaaaagguaaaaucccaauugaagaauaacgccaaagagauagggaauggaugcuuugaguucuaccauaaguguaacgaugaaugcauggagagcgugaagaaugguacguaugacuaccccaaauauucugaagagucaaagcucaaccgugagaaaauugauggcgucaagcuggaaaguauggggguguaccagaucuuagcuaucuauagcaccgucgccuccucucuggugcuacucguuucgcugggagcaauuagcuuuuggaugugcuccaauggcucacuucagugucgcaucugcauuuga

SEQ ID NO: 124219 - RNA, 1698 nt, Artificial Sequence; identical to SEQ ID NO: 123961
  derived and/or modified sequence opt3 from hemagglutinin__InfluenzaA__ABW91625

SEQ ID NO: 124220 - RNA, 1698 nt, Artificial Sequence; identical to SEQ ID NO: 123930
  derived and/or modified sequence opt3 from hemagglutinin__InfluenzaA__ABW91636

SEQ ID NO: 124221 - RNA, 1701 nt, Artificial Sequence; identical to SEQ ID NO: 124003
  derived and/or modified sequence opt3 from hemagglutinin__InfluenzaA__ABW91647

SEQ ID NO: 124222 - RNA, 1707 nt, Artificial Sequence
  derived and/or modified sequence opt3 from hemagglutinin__InfluenzaA__ABX10515
auggagaagaucgugcuucucuucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagugagccugggaguaaguuccgcuuguccauaccagggcaaaucuagcuucuuucggaacguuguguggcugaucaagaaaaauuccacauaucccacuauaaagcgcucauacaacaauaccaaccaagaggaccucuuaguccugugggguauucaccacccuaaugaugccgcagagcagacaaagcuguaucagaacccaaccacuuacaucaguguggggacaagcaccuugaaccagcgacuggugccccguauugccacgagaucuaaagucaauggacaauccggcaggauggaguucuuuuggacuauccuaaagccuaacgacgcuaucaauuucgaaucaaacggcaauuuuauugcaccagaauacgccuauaaaauaguuaagaaaggggauagcaccaucaugaagagugagcucgaauacggaaacugcaauacaaaaugucagacuccgaugggugcuauuaacucuuccaugcccuuccauaauauccacccucugaccauaggcgagugcccaaaguaugugaaaagcaaccggcuuguacuggccacaggguugcgcaauucgccccagagagagaggcggcgcaaaaagcgaggacucuuuggcgcgauugcagguuucaucgaagggggauggcagggcaugguggacggcugguacggguaucaucacucuaacgagcaaggauccgguuacgccgcugacaaagaaucaacccagaaggccaucgauggcgucacgaauaaagugaacaguauuaucgacaagaugaauacucaguuugaggcaguugggagagaguucaacaaccuggaaaggcggauugagaauuuaaacaagaaaauggaagauggauuccuggacguguggacauauaaugcugagcuccuuguccugauggaaaacgagcguaccuuggauuuucacgacagcaaugugaagaaccuauacgauaaaguacgccugcaacucaaggacaaugccaaagaacugggcaacgguuguuucgaguuuuaccauaagugcgauaaugaguguauggaauccguuagaaacgggacuuaugacuacccucaguauucugaggaagcgaggcuuaagcgggaggagauaagcggcgugaaacuggaaucaaucggaauuuaccagaucuugaguaucuauuccacagucgccagcucucucgcacuggcuauuaugguggccggcuuaucacuguggaugugcaguaaugggagccuacagugccgaauauguaucuga

SEQ ID NO: 124223 - RNA, 1701 nt, Artificial Sequence; identical to SEQ ID NO: 123872
  derived and/or modified sequence opt3 from hemagglutinin__InfluenzaA__ABX10525

SEQ ID NO: 124224 - RNA, 1698 nt, Artificial Sequence; identical to SEQ ID NO: 123930
  derived and/or modified sequence opt3 from hemagglutinin__InfluenzaA__ABX58239

SEQ ID NO: 124225 - RNA, 1698 nt, Artificial Sequence; identical to SEQ ID NO: 124030
  derived and/or modified sequence opt3 from hemagglutinin__InfluenzaA__ABX58250

SEQ ID NO: 124226 - RNA, 1698 nt, Artificial Sequence
  derived and/or modified sequence opt3 from hemagglutinin__InfluenzaA__ABX58261
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggucucuucuggagccaggugauacaaucauuuuugaggccaacggcaauuugaucgcuccgcgcuucgccuuugcgcucuccagaggguucggaagcggcauaauuacuucgaacgcacccauggacgaaugugaugccaagugccagaccccucaaggugcuaucaauucuucccugccauuucagaacguccaccccguuacaauuggggaguguccuaaauaugugaggucaaccaaguuacggaugguaacgggacugcgcaauaucccaaguauccagagccgaggccucuucggcgccauugcaggguuuauagaaggagguuggacuggcaugguggacgggugguacggauaucaucaccagaacgagcaaggcuccgguuacgcugccgaucagaaaucuacacagaaugcgaucaacgggauuaccaauaaggucaacagcgugaucgaaaagaugaauacucaguucacagccguuggcaaagaguucaacaaacuugagagaaggauggaaaaucugaacaagaagguggacgauggauuuuuggacauauggaccuacaacgcagagcuacugguccuccuggaaaaugagcggacgcuugacuuccacgauucaaacgugaaaaaucuguaugaaaagguaaaaagucaauugaagaacaaugcuaaagagauuggcaacgggugcuuugaguucuaccauaaguguaaugacgaaugcauggaguccguuaagaacggaaccuaugauuaccccaaauauagcgaagagucuaagcucaaucgugagaaaaucgacggugugaagcuggaaucaaugggcgucuaccagaucuuagccauuuauaguacaguggcuagcucccugguccuacucgugucucugggggccaucucguuuuggaugugcagcaacggaucccuucagugucgcauuugcauauga

SEQ ID NO: 124227 - RNA, 1698 nt, Artificial Sequence
  derived and/or modified sequence opt3 from hemagglutinin__InfluenzaA__ABX58272
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaagaagaguuccuggccaaaucauacagugaccggugucucugccagcugcucccacaacgggaaaucaaguuuuuaccggaauuuacuguggcuuacgggaaagaacggcuuguaucccaaucugagcaaaucuuacgcaaacaauaaggagaaagaagugcuaguacucuggggcguucaucacccuccaaacauaggggaucagcgcgcccuguaccacacugagaacgcuuauguguccgucgugucaagccauuacagucgacguuucacccccgaaaucgcaaagagaccuaaggugagggaccaggagggacggauuaauuauuacuggacacuucuggaaccaggugauacuaucauuuuugaggccaacggcaauuugaucgcuccgcgcuucgccuuugcgcucucuagaggguucggauccggcauaauuaccagcaacgcacccauggacgagugugaugccaaaugccagacaccucaaggugcuaucaauucgucucugccauuucagaacguccaccccguuaccauuggggaauguccuaaguaugugagguccacgaaauuacggaugguaacuggacugcgcaauaucccaucaauccagagucgaggccucuucggcgccauugcaggguuuauagagggagguuggacaggcaugguggacgggugguacggauaucaucaccagaacgaacaaggcagcgguuacgcugccgaucagaaguccacccagaaugcgaucaacgggauuacuaauaaagucaacucugugaucgagaagaugaauacacaguucaccgccguuggcaaagaguucaacaaacuugaaagaaggauggagaaucugaacaagaagguggacgauggauuuuuggacauauggacguacaacgcagaacuacugguccuccuggagaaugaacggacccuugacuuccacgauagcaacgugaagaaucuguaugagaaaguaaagucacaauugaaaaacaaugcuaaggaaauuggcaacgggugcuuugaguucuaccauaaguguaaugacgagugcauggaaaguguuaaaaacggaacauaugauuaccccaaguauuccgaggaaagcaaacucaaucgugagaagaucgacggugugaaacuggagucuaugggcgucuaccagaucuuagccauuuauucaacuguggcuaguagccugguccuacucgugucccugggggccaucucuuuuuggaugugcucgaacggaagccuucagugucgcauuugcauauga

SEQ ID NO: 124228 - RNA, 1698 nt, Artificial Sequence; identical to SEQ ID NO: 123930
  derived and/or modified sequence opt3 from hemagglutinin__InfluenzaA__ABX58283

SEQ ID NO: 124229 - RNA, 1698 nt, Artificial Sequence; identical to SEQ ID NO: 124071
  derived and/or modified sequence opt3 from hemagglutinin__InfluenzaA__ABX58294

SEQ ID NO: 124230 - RNA, 1698 nt, Artificial Sequence; identical to SEQ ID NO: 123926
  derived and/or modified sequence opt3 from hemagglutinin__InfluenzaA__ABX58316

SEQ ID NO: 124231 - RNA, 1698 nt, Artificial Sequence; identical to SEQ ID NO: 124075
  derived and/or modified sequence opt3 from hemagglutinin__InfluenzaA__ABX58327

SEQ ID NO: 124232 - RNA, 1698 nt, Artificial Sequence; identical to SEQ ID NO: 123926
  derived and/or modified sequence opt3 from hemagglutinin__InfluenzaA__ABX58338

SEQ ID NO: 124233 - RNA, 1698 nt, Artificial Sequence
  derived and/or modified sequence opt3 from hemagglutinin__InfluenzaA__ABX58360
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcccccauccagcuugguaauuguucaguggcgggcuggauucuggggaacccugagugcgaauugcucaucaguaaagagagcugguccuacauuguugaaaccccaaauccggagaacggaacuuguuaucccggcuacuuugcugacuaugaggaacugagagagcaacugucuucggugagcucauucgaaagguuugagaucuucccuaaggagaguuccuggccaaaucauacagucaccggugugucugccagcugcucccacaacgggaagucaaguuuuuaccggaaucucuuauggcugacgggcaaaaacggacuuuaucccaauuugagcaagucuuacgcaaacaauaaagaaaaggagguacugguucuauggggcgugcaucacccuccaaacauaggggaucagcgcgcccucuaccacacugaaaacgcuuaugucuccguggugucaagccauuacagucgacguuucacccccgagaucgcaaaaagaccuaaggucagggaccaggaaggacggauuaauuauuacuggacacugcuugagccaggugauacuaucauuuuugaggccaacggcaaucugaucgcuccgcgcuucgccuuugcguugucuagaggguucggauccggcauaauuaccagcaacgcacccauggacgaaugugaugccaagugccagacaccucaaggugcuaucaauucgucucucccauuucagaacguucaccccgugaccauuggggaguguccuaaauauguaagguccacgaagcugcggauggugacuggauuacgcaauaucccaucaauccagagucgaggccuguucggcgccauugcaggguuuauagaaggagguuggacaggcauggucgacgggugguacggauaucaucaccagaacgagcaaggcagcgguuacgcugccgaucagaaauccacccagaaugcgaucaacgggauuacuaauaaggugaacucuguuaucgaaaagaugaauacacaguucaccgccgugggcaaagaguucaacaaacucgagagaaggauggaaaaucuuaacaagaaggucgacgauggauuucuggacauauggacguacaacgcagaguugcuagugcugcucgaaaaugagcggacccuggacuuccacgauagcaacguuaaaaaucuuuaugaaaagguaaaaucacaacugaagaacaaugcuaaagagauuggcaacgggugcuuugaguucuaccauaaguguaaugacggaugcauggaaagugugaagaacgguacauaugauuaccccaaauauuccgaggaaagcaaguugaaucgugagaaaaucgacggcgucaagcucgagucuauggggguguaccagauccuggccauuuauucaacugucgcuaguagcuuagugcugcuaguuucccucggagccaucucuuuuuggaugugcucgaacggcagccugcagugucgcauuugcauauga

SEQ ID NO: 124234 - RNA, 1698 nt, Artificial Sequence; identical to SEQ ID NO: 123930
  derived and/or modified sequence opt3 from hemagglutinin__InfluenzaA__ABX58371

SEQ ID NO: 124235 - RNA, 1698 nt, Artificial Sequence; identical to SEQ ID NO: 123930
  derived and/or modified sequence opt3 from hemagglutinin__InfluenzaA__ABX58382

SEQ ID NO: 124236 - RNA, 1698 nt, Artificial Sequence; identical to SEQ ID NO: 124071
  derived and/or modified sequence opt3 from hemagglutinin__InfluenzaA__ABX58393

SEQ ID NO: 124237 - RNA, 1698 nt, Artificial Sequence; identical to SEQ ID NO: 123930
  derived and/or modified sequence opt3 from hemagglutinin__InfluenzaA__ABX58404

SEQ ID NO: 124238 - RNA, 1698 nt, Artificial Sequence
  derived and/or modified sequence opt3 from hemagglutinin__InfluenzaA__ABX58415
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugauuaguaaaaagucauggagcuacaucguugagaccccaaauccggaaaacggaacuuguuaucccggcuacuuugcugacuaugaggagcugagggaacaacucuccucugugucgucauucgagcgguuugaaauuuucccuaaggagagcaguuggccaaaucauacagucaccgguguguccgccucuugcagccacaacgggaaauccucauuuuaccgcaauuuacuguggcuuacgggaaagaacggcuuguaucccaaucugagucgaagcuacgcaaacaauaaagagaaggaaguucuaguacucuggggcgugcaucacccuccaaacaucggggaucagcgugcccuguaccacacugagaacgcuuaugucucugugguguccucacauuacagcagaagguucacccccgaaauagcaaaacggccuaagguccgcgaccaggagggaagaaucaauuauuacuggacacuucuggaaccaggugauacuauuaucuuugaggccaacggcaauuugauugcuccgagguucgccuuugcgcucagucggggguucggaucuggcaucauaaccuccaacgcacccauggacgagugugaugccaagugccagacaccucaaggugcuauuaauagcucgcugccauuucagaacguucaccccgugaccaucggggaauguccuaaauauguacgcucugccaaguuacgaauggugacgggacugagaaauauuccauccauccagucaaggggccucuucggcgcaaucgcuggguuuauugagggagguuggacuggcauggucgacgggugguacggauaucaucaccagaacgaacaaggcagugguuacgccgcggaucagaaaagcacacagaaugccauaaacgggaucaccaauaaggugaacuccguuauugagaaaaugaauacucaguucacagcagugggcaaggaguucaacaaacuugaacggcguauggagaaucugaacaagaaggucgacgauggauuuuuggacaucuggaccuacaacgcugaacuacuggugcuccuggagaaugaacgcacgcuugacuuccacgauucuaacguuaaaaaucuguaugagaagguaaaaagccaauugaagaacaaugccaaagaaauaggcaacgggugcuuugaguucuaccauaaguguaaugacgagugcauggaaucagugaagaacggaaccuaugauuaccccaaauauagugaggaauccaagcucaauagagagaaaauugacggugucaagcuggagagcaugggcguguaccagaucuuagcuaucuauucuacagucgccucaagucuggugcuacucguuagccugggggcaauuuccuuuuggaugugcucuaacggaucgcuucaguguaggaucugcauuuga

SEQ ID NO: 124239 - RNA, 1698 nt, Artificial Sequence; identical to SEQ ID NO: 123930
  derived and/or modified sequence opt3 from hemagglutinin__InfluenzaA__ABX58426

SEQ ID NO: 124240 - RNA, 1698 nt, Artificial Sequence; identical to SEQ ID NO: 123930
  derived and/or modified sequence opt3 from hemagglutinin__InfluenzaA__ABX58437

SEQ ID NO: 124241 - RNA, 1698 nt, Artificial Sequence; identical to SEQ ID NO: 123926
  derived and/or modified sequence opt3 from hemagglutinin__InfluenzaA__ABX58448

SEQ ID NO: 124242 - RNA, 1698 nt, Artificial Sequence; identical to SEQ ID NO: 123972
  derived and/or modified sequence opt3 from hemagglutinin__InfluenzaA__ABX58459

SEQ ID NO: 124243 - RNA, 1698 nt, Artificial Sequence; identical to SEQ ID NO: 124071
  derived and/or modified sequence opt3 from hemagglutinin__InfluenzaA__ABX58470

SEQ ID NO: 124244 - RNA, 1698 nt, Artificial Sequence; identical to SEQ ID NO: 123972
  derived and/or modified sequence opt3 from hemagglutinin__InfluenzaA__ABX58481

SEQ ID NO: 124245 - RNA, 1698 nt, Artificial Sequence; identical to SEQ ID NO: 123930
  derived and/or modified sequence opt3 from hemagglutinin__InfluenzaA__ABX58492

SEQ ID NO: 124246 - RNA, 1698 nt, Artificial Sequence; identical to SEQ ID NO: 123946
  derived and/or modified sequence opt3 from hemagglutinin__InfluenzaA__ABX58503

SEQ ID NO: 124247 - RNA, 1698 nt, Artificial Sequence; identical to SEQ ID NO: 123972
  derived and/or modified sequence opt3 from hemagglutinin__InfluenzaA__ABX58525

SEQ ID NO: 124248 - RNA, 1698 nt, Artificial Sequence
  derived and/or modified sequence opt3 from hemagglutinin__InfluenzaA__ABX58536
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugauuucaaaagagccauggaguuacaucguugaaaccccgaaucccgagaacggaacuuguuauccuggcuacuuugcugacuaugaggaacugagggagcaacucagcuccgugucuucguucgaacgguuugagauuuucccaaaggagucaagcuggcccaaucauacagucaccggugugagugccuccugcucucacaacggaaagagcuccuuuuaccgcaauuuacuguggcuuacggggaaaaacggcuuguauccuaaucugucacgaaguuacgcaaacaauaaggaaaaagagguacuuguucucuggggcgugcaucacccacccaacaucggggaucagcgugcccuguaccacacugaaaacgcuuaugucagcguggugucuucccauuacucaagaagguucaccccugagauagcaaagcggccaaaaguccgcgaccaggaaggaagaaucaauuauuacuggacacuucuggagccgggugauacuauuaucuuugaggccaacggcaauuugauugcucccagguucgccuuugcgcucagccggggguucggaaguggcaucauaaccucuaacgcaccuauggacgaaugugaugccaagugccagacaccacaaggugcuauuaauuccagccugcccuuucagaacguucacccugugaccaucggggaguguccaaaguauguacgcucggccaaauuacgaauggugacgggacugagaaauauucccucuauccaguccaggggccucuucggcgcaaucgcuggguuuauugaaggagguuggacuggcauggucgacgggugguacggauaucaucaccagaacgagcaaggcucagguuacgccgcggaucagaagaguacacagaaugccauaaacgggaucaccaauaaagugaacagcguuauugaaaagaugaauacucaguucacagcagugggcaaagaguucaacaagcuagagcggcguauggaaaaucugaacaaaaaggucgacgauggauuuuuggacaucuggaccuacaacgcugagcuacuggugcuccuggaaaaugagcgcacgcuugacuuccacgauuccaacguaaagaaucuguaugaaaaaguuaagucucaauugaaaaacaaugccaaggagauaggcaacgggugcuuugaguucuaccauaaauguaaugacgaaugcauggagagcgugaagaacggaaccuaugauuacccgaaguauucagaagagaguaaacucaauagagagaagauugacggugucaaacuggaauccaugggcguguaccagaucuuagcuaucuauagcacagucgccucuucacuggugcuacucguuagucugggggcaauuagcuuuuggaugugcuccaacggaucucuucaguguaggaucugcauuuga

SEQ ID NO: 124249 - RNA, 1698 nt, Artificial Sequence
  derived and/or modified sequence opt3 from hemagglutinin__InfluenzaA__ABX58547
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccacgaaguuacggaugguaacuggacugcgcaauaucccaucaauccagacacgaggccucuucggcgccauugcaggguuuauagaaggagguuggaccggcaugguggacgggugguacggauaucaucaccagaacgagcaaggcagugguuacgcugccgaucagaaaagcacucagaaugcgaucaacgggauuacaaauaaggucaacuccgugaucgaaaagaugaauacccaguucacggccguuggcaaagaguucaacaaacuugagagaaggauggaaaaucugaacaagaagguggacgauggauuuuuggacauauggaccuacaacgcagagcuacugguccuccuggaaaaugagcggacacuugacuuccacgauucuaacgugaaaaaucuguaugaaaagguaaaaagccaauugaagaacaaugcuaaagagauuggcaacgggugcuuugaguucuaccauaaguguaaugacgaaugcauggagucaguuaagaacggaacuuaugauuaccccaaauauagugaagaguccaagcucaaucgugagaaaaucgacggugugaagcuggaaagcaugggcgucuaccagaucuuagccauuuauucuaccguggcuucaagucugguccuacucgugagccugggggccaucuccuuuuggaugugcucuaacggaucgcuucagugucgcauuugcauauga

SEQ ID NO: 124250 - RNA, 1698 nt, Artificial Sequence
  derived and/or modified sequence opt3 from hemagglutinin__InfluenzaA__ABX58558
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggcggucaaguuuuuaccgcaauuuacuguggcuuacgggaaagaacggcuuguaucccaaucugagcaaaucuuacgcaaacaauaaggaaaaagagguucuaguacucuggggcgugcaucacccuccaaacaucggggaucagcgagcccuguaccacacugaaaacgcuuaugucuccguggugucaagccauuacagucguagauucacccccgagauagcaaagaggccuaaaguccgggaccaggaaggacgcaucaauuauuacuggacacuucuggagccaggugauacuauuaucuuugaggccaacggcaauuugauugcuccgagauucgccuuugcgcucucuaggggguucggauccggcaucauaaccagcaacgcacccauggacaagugugaugccaagugccagacaccucaaggugcuauuaauucgucucugccauuucagaacguucaccccgugaccaucggggaauguccuaaauauguacgguccacgaaguuacgcauggugacuggacugcgaaauauuccaucaauccagaguagaggccucuucggcgccaucgcaggguuuauugagggagguuggacaggcauggucgacgggugguacggauaucaucaccagaacgaacaaggcagcgguuacgcugccgaucagaaauccacccagaaugcgauaaacgggaucacuaauaaggugaacucuguuauugagaaaaugaauacacaguucaccgccgugggcaaggaguucaacaaacuugaaaggcggauggagaaucugaacaagaaggucgacgauggauuuuuggacaucuggacguacaacgcagaacuacuggugcuccuggagaaugaacguacccuugacuuccacgauagcaacguuaaaaaucuguaugagaagguaaaaucacaauugaagaacaaugcuaaagaaauaggcaacgggugcuuugaguucuaccauaaguguaaugacgagugcauggaaagugugaagaacggaacauaugauuaccccaaauauuccgaggaaagcaagcucaaucgcgagaaaauugacggugucaagcuggagucuaugggcguguaccagaucuuagccaucuauucaacugucgcuaguagccuggugcuacucguuucccugggggccauuucuuuuuggaugugcucgaacggaagccuucaguguagaaucugcauuuga

SEQ ID NO: 124251 - RNA, 1698 nt, Artificial Sequence
  derived and/or modified sequence opt3 from hemagglutinin__InfluenzaA__ABX58569
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagccaccggugugucugcaagcugcucccacaacgggaagucaaguuuuuaccggaauuuacuguggcuuacgggcaaaaacggauuguaucccaaucugagcaagucuuacgccaacaauaaagaaaaggagguccuagugcucuggggcguacaucacccuccaaacauaggggaucagcgcgcucuguaccacacugaaaacgcauauguuuccguggucucaagccauuacagucgacguuucacccccgagaucgccaaaagaccuaaggugagggaccaggaaggacggauuaauuauuacuggacacuucuggagccaggugauacuaucauuuuugaggcuaacggcaauuugaucgccccgcgcuucgcguuugcacucucuagaggguucggauccggcauaauuaccagcaacgcccccauggacgaaugugaugcuaagugccagacaccucaaggugccaucaauucgucucugccauuucagaacgugcaccccgucaccauuggggaguguccuaaauauguuagguccacgaaguuacggauggugacuggacugcgcaauaucccaucaauccagagucgaggccucuucggcgcaauugcuggguuuauagaaggagguuggacaggcaugguagacgggugguacggauaucaucaccagaacgagcaaggcagcgguuacgccgcggaucagaaauccacccagaaugccaucaacgggauuacuaauaaggugaacucugucaucgaaaagaugaauacacaguucaccgcagugggcaaagaguucaacaaacuugagagaaggauggaaaaucugaacaagaagguugacgauggauuuuuggacauauggacguacaacgcugagcuacuggugcuccuggaaaaugagcggacccuugacuuccacgauagcaacgucaaaaaucuguaugaaaaggugaaaucacaauugaagaacaaugccaaagagauuggcaacgggugcuuugaguucuaccauaaguguaaugacgaaugcauggagaguguaaagaacggaacauaugauuaccccaaauauuccgaagagagcaagcucaaucgugagaaaaucgacgguguuaagcuggaaucuaugggcguguaccagaucuuagcuauuuauucaacugucgccaguagccuggugcuacucgucucccugggggcaaucucuuuuuggaugugcucgaacggaagccuucagugucgcauuugcauauga

SEQ ID NO: 124252 - RNA, 1698 nt, Artificial Sequence; identical to SEQ ID NO: 123926
  derived and/or modified sequence opt3 from hemagglutinin__InfluenzaA__ABX58580

SEQ ID NO: 124253 - RNA, 1698 nt, Artificial Sequence; identical to SEQ ID NO: 123930
  derived and/or modified sequence opt3 from hemagglutinin__InfluenzaA__ABX58591

SEQ ID NO: 124254 - RNA, 1698 nt, Artificial Sequence
  derived and/or modified sequence opt3 from hemagglutinin__InfluenzaA__ABX58602
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccuggagggaauagcgccccuucagcuggguaauuguucaguggccggcuggaucuuggggaacccugaaugcgagcuccugauuaguaaggaaagcugguccuacaucguugagaccccaaauccggagaacggaacuuguuaucccggcuacuuugcugacuaugaagaacugagagaacaacucucuucggugagcucauucgagagguuugagauuuucccuaaagaaaguuccuggccaaaucauacagucaccggugugucugccagcugcucccacaacgggaagucaaguuuuuaccggaauuuacuguggcuuacgggaaagaacggcuuguaucccaaucugagcaaaucuuacgcaaacaauaaggagaaagaaguacuuguucucuggggcgugcaucacccuccaaacaucggggaucagcgcgcccuguaccacacugagaacgcuuaugucuccguggugucaagccauuacagucgacguuucacccccgaaauagcaaagagaccuaaagucagggaccaggagggacggaucaauuauuacuggacacuucuggagccacgcgauacuauuaucuuugaagccaacgguaauuugauugcuccgagauucgccuuugcgcucucuaggggcuucggguccggaaucauaaccagcaacgcacccaugggcgagugugacgccaagugccagacaccucaaggugcuauuaauucgucucugccauuucagaacguucaccccgugaccaucggggaauguccuaaguauguacgguccgccaaauuacgcauggugacgggacugcgaaauauuccaucaauccagaguagaggccucuucggcgcaaucgcuggguuuauugagggagguuggacuggcauggucgaugggugguacggauaucaucaccagaacgaacaaggcagcgguuacgccgcggaccagaaguccacacagaaugccauaaacgggaucaccaauaaagugaacucuguuauugagaagaugaauacucaguucacagcagugggcaaagaguucaacaagcuagaaaggcggauggagaaucugaacaaaaaggucgaugacggauuuuuggauaucuggaccuacaacgcugaacuacuggugcuccuggagaaugaacguacgcuugacuuccacgacagcaacguaaagaaucuguaugagaaaguuaagucacaauugaaaaacaaugccaaggagauaggcaacgggugcuuugaguucuaccauaaauguaaugaugagugcauggaaagugugaagaacggaaccuaugacuaccccaaguauuccgaggagagcaaacucaaucgcgaaaagauugauggugucaaacuggagucuaugggcguguaccagaucuuagcuaucuauucaacagucgccaguagccuggugcuacucguuucccugggggcaauuucuuuuuggaugugcucgaacggaagccuucaguguagaaucugcauuuga

SEQ ID NO: 124255 - RNA, 1698 nt, Artificial Sequence; identical to SEQ ID NO: 123963
  derived and/or modified sequence opt3 from hemagglutinin__InfluenzaA__ABX58613

SEQ ID NO: 124256 - RNA, 1698 nt, Artificial Sequence; identical to SEQ ID NO: 123930
  derived and/or modified sequence opt3 from hemagglutinin__InfluenzaA__ABX58624

SEQ ID NO: 124257 - RNA, 1698 nt, Artificial Sequence
  derived and/or modified sequence opt3 from hemagglutinin__InfluenzaA__ABX58635
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggcggucaaguuuuuaccgcaauuuacuguggcuuacgggaaagaacggcuuguaucccagccugucuaaauccuacgcaaauaacaaggaaaaagagguacuuguucucuggggcgugcaucacccuccaaauaucggggaucagcgagcccuguaccacacugaaaacgcuuaugucucaguggugagcagucauuacucucguagauucacccccgagauagcaaagaggccuaaaguccgggaccaggaaggacgcaucaacuauuacuggacacuucuggagccaggugauacuauuaucuuugaggccaauggcaacuugauugcuccgagauucgccuuugcgcucuccaggggguucggaagcggcaucauaaccucgaaugcacccauggacgaaugugaugccaagugccagacaccucaaggugcuauuaacucuucccugccauuucagaauguucaccccgugaccaucggggaguguccuaaguauguacggucaacgaaauuacgcauggugacuggacugcgaaacauuccaaguauccagagcagaggccucuucggcgccaucgcaggguuuauugaaggagguuggacaggcauggucgacgggugguacggauaucaucaccagaaugagcaaggcuccgguuacgcugccgaucagaagucuacccagaacgcgauaaaugggaucacuaacaaagugaauagcguuauugaaaagaugaacacacaguucaccgccgugggcaaagaguucaauaagcuagagaggcggauggaaaaccugaauaaaaaggucgacgauggauuuuuggacaucuggacguacaacgcagagcuacuggugcuccuggaaaacgagcguacccuugacuuccacgauucaaauguaaagaaccuguaugaaaaaguuaagagucaauugaaaaauaacgcuaaggagauaggcaaugggugcuuugaguucuaccauaaauguaacgacgaaugcauggaguccgugaagaauggaacauaugauuaccccaaguauagcgaagagucuaaacucaaccgcgagaagauugacggugucaaacuggaaucaaugggcguguaccagaucuuagccaucuauaguacugucgcuagcucccuggugcuacucguuucucugggggccauuucguuuuggaugugcagcaauggaucccuucaguguagaaucugcauuuga

SEQ ID NO: 124258 - RNA, 1698 nt, Artificial Sequence; identical to SEQ ID NO: 123926
  derived and/or modified sequence opt3 from hemagglutinin__InfluenzaA__ABX58679

SEQ ID NO: 124259 - RNA, 1698 nt, Artificial Sequence; identical to SEQ ID NO: 123972
  derived and/or modified sequence opt3 from hemagglutinin__InfluenzaA__ABX58701

SEQ ID NO: 124260 - RNA, 1698 nt, Artificial Sequence; identical to SEQ ID NO: 124030
  derived and/or modified sequence opt3 from hemagglutinin__InfluenzaA__ABX58712

SEQ ID NO: 124261 - RNA, 1704 nt, Artificial Sequence
  derived and/or modified sequence opt3 from hemagglutinin__InfluenzaA__ABY19417
auggagaagaucgugcugcuccuugccauuauaagccuggucaaauccgaccagaucugcauuggcuaccacgcuaacaauucuaccgaacaaguugauacaaucauggagaagaacgugacuguaacgcaugcacaggacauuuuggagaaaacccacaaugggaaguuaugugaucuggacggagugaaaccccuaauccucagagauugcucagucgccgguuggcugcuuggcaacccuaugugugacgaguucauaaaugugccagaauggaguuauaucguugagaaggcgaacccggcuaaugaucugugcuaccccgggaacuuuaaugacuaugaggaauugaagcaucuccugagcaggauuaaccacuucgagaaaauccagauuaucccuaaguccucuuggucggaucaugaagccucaagcggagugaguuccgcauguccauaccagggcguccccagcuuuuuccggaaugugguauggcugauaaagaagaacaauacauauccuacuauuaaacgcagcuacaacaauaccaaccaagaggaccucuuaauccugugggguauucaccacuccaacgaugccgcugagcagacaaaacuuuaucagaauccaaccacuuacaucucaguugggacaaguaccuugaaccagcgacuggugcccaagaucgcaacgcguagcaaagucaauggacaaucuggcagaauggacuuuuucuggacuauucuaaagccuaacgaugccauaaauuuugaauccaacggcaauuucaucgcuccagaguacgccuauaaaauugugaagaaaggggacucagcgaucaugaagucugaaguggaguacggaaacugcaauaccaaaugucagacaccgauaggugcaauuaacaguucuaugcccuuucauaauauccacccucucacuaucggcgaaugcccaaaguaugucaaguccaacaaacugguucuugccaccgggcugaggaauagccccuugcgggagcgcagaaggaagcggggacucuucggcgcuauugccgguuuuaucgaagggggauggcagggcaugguggacggcugguacggguaucaucacucgaacgaacagggaucugguuacgcagcugauaaagaguccacacaaaaggccauugacggcguaaccaauaaagugaacucaauaaucgauaagaugaacacgcaguucgaagcggucgggcgcgaguuuaauaaccuggaacgaagaauugagaauuuaaacaagaaaauggaggacggauuccuggauguguggacuuauaaugccgaacuccuuguucugauggagaacgaaaggacauuggacuuccacgauaguaaugugaagaaccuauacgacaaaguccggcugcagcuccgugauaaugcaaaggagcugggcaacgguuguuuuaaauucuaccauaagugcgacaaugaauguauggagagcgugcgcaacgggaccuaugauuacccucaauauuccgaggaagcuagacuuaagagggaggaaaucucuggcguaaaacuggagagcaucggaacuuaccagauuuugucaauauauaguacaguugccuccagccucgcucuggccaucaugguggcaggcuuaucucuguggaugugcucaaaugggagucuacagugccggauucgaaucuga

SEQ ID NO: 124262 - RNA, 1704 nt, Artificial Sequence
  derived and/or modified sequence opt3 from hemagglutinin__InfluenzaA__ABY19418
auggagaagaucgugcugcuccuugccauuauaagccuggucaaauccgaccagaucugcauuggcuaccacgcuaacaauucuaccgaacaaguugauacaaucauggagaagaacgugacuguaacgcaugcacaggacauuuuggagaaaacccacaaugggaaguuaugugaucuggacggagugaaaccccuaauccucagagauugcucagucgccgguuggcugcuuggcaacccuaugugugacgaguucauaaaugugccagaauggaguuauaucguugagaaggcgaacccggcuaaugaucugugcuaccccggggacuuuaacgauuaugaggaauugaagcaucuccugagcaggauuaaucacuucgagaaaauccagauuaucccuaaguccucuuggucggaccaugaagccucaagcggagugaguuccgcauguccauaccagggcguccccagcuuuuuccggaacgugguauggcugauaaagaagaauaacacauauccuacuauuaaacgcagcuacaauaacaccaaucaagaggaucucuuaauccugugggguauucaccacuccaacgacgccgcugagcagacaaaacuuuaucagaacccaaccacuuacaucucaguugggacaaguaccuugaaucagcgacuggugcccaagaucgcaacgcguagcaaagucaacggacaaucuggcagaauggacuuuuucuggacuauucuaaagccuaaugaugccauaaacuuugaauccaauggcaacuucaucgcuccagaguacgccuauaaaauugugaagaaaggggacucagcgaucaugaagucugaaguggaguacggaaauugcaacaccaaaugucagacaccgauaggugcaauuaauaguucuaugcccuuucauaacauccacccucucacuaucggcgaaugcccaaaguaugucaaguccaauaaacugguucuugccaccgggcugaggaacagccccuugcgggagcgcagaaggaagcggggacucuucggcgcuauugccgguuuuaucgaagggggauggcagggcaugguggauggcugguacggguuccaucacucgaaugaacagggaucugguuaugcagcugacaaagaguccacacaaaaggccauugauggcguaaccaacaaagucaauucaauaaucgacaagaugaacacgcaguuugaagcgguggggcgcgaguucaacaaucuggaacgaagaauugagaacuuaaauaagaaaauggaggauggauuccuggacguguggacuuacaacgccgaacuccuuguucugauggagaaugaaaggacauuggauuuucacgacaguaacgugaagaaucuauaugauaaaguccggcugcagcuccgugacaacgcaaaggagcugggcaaugguuguuucgaauuuuaccauaaaugcgauaacgaguguauggagagcgugcgcaaugggaccuacgacuauccucaauacuccgaagaggcuagacuuaagagggaagagaucucuggcguaaagcuggagagcaucggaacuuaucagauuuugucaauauacaguacaguugccuccagccucgcucuggccaucaugguggcaggcuuaucucuguggaugugcucaaacgggagucuacagugccggauuuguaucuga

SEQ ID NO: 124263 - RNA, 1704 nt, Artificial Sequence
  derived and/or modified sequence opt3 from hemagglutinin__InfluenzaA__ABY19419
auggagaagaucgugcugcuccuugccauuauaagccuggucaaauccgaccagaucugcauuggcuaccacgcuaacaauucuaccgaacaaguugauacaaucauggagaagaacgugacuguaacgcaugcacaggacauuuuggaaaagacccacaaugggaaguuaugugaucuggacggagugaaaccccuaauccucagagauugcucagucgccgguuggcugcuuggcaacccuaugugugacgaguucauaaaugugccagaauggaguuauaucguugagaaggcgaacccggcuaaugaucugugcuaccccgggaacuuuaaugacuaugaggaauugaagcaucuccugagcaggauuaaccacuucgagaaaauccagauuaucccuaaguccucuuggucggaucaugaagccucaagcggagugaguuccgcauguccauaccagggcguccccagcuuuuuccggaaugugguauggcugauaaagaagaacaauacauauccuacuauuaaacgcucuuacaacaauaccaaccaagaggaccucuuaauccugugggguauucaccacuccaacgaugccgcugagcagacaaaacuuuaucagaauccaaccacuuacaucucaguugggacaaguaccuugaaccagcgacuggugcccaagaucgcaacgcguagcaaagucaauggacaaucuggcagaauggacuuuuucuggacuauucuaaagccuaacgaugccauaaauuuugaauccaacggcaauuucaucgcuccagaguacgccuauaaaauugugaagaaaggggacucagcgaucaugaaaagcgaaguggaguacggaaacugcaauaccaaaugucagacaccgauaggugcaauuaacaguucuaugcccuuucauaauauccacccucucacuaucggcgaaugcccaaaguaugucaaguccaacaaacugguucuugccaccgggcugaggaauagccccuugcgggagcgcagaaggaagcggggacucuucggcgcuauugccgguuuuaucgaagggggauggcagggcaugguggacggcugguacggguaucaucacucgaacgaacagggaucugguuacgcagcugauaaagaguccacacaaaaggccauugacggcguaaccaauaaagugaacucaauaaucgauaagaugaacacgcaguucgaagcggucgggcgcgaguuuaauaaccuggaacgaagaauugagaauuuaaacaagaaaauggaggacggauuccuggauguguggacuuauaaugccgaacuccuuguucugauggagaacgaaaggacauuggacuuccacgauaguaaugugaagaaccuauacgacaaaguccggcugcagcuccgugauaaugcaaaggagcugggcaacgguuguuuugaguucuaccauaaaugcgacaaugaguguauggagagcgugcgcaacgggaccuaugauuacccucaauauuccgaagaggcuagacuuaagagggaagagaucucuggcguaaagcuggagagcaucggaacuuaccagauuuugucaauauauaguacaguugccuccagccucgcucuggccaucaugguggcaggcuuaucucuguggaugugcucaaaugggagucuacagugccggauuuguaucuga

SEQ ID NO: 124264 - RNA, 1698 nt, Artificial Sequence; identical to SEQ ID NO: 124071
  derived and/or modified sequence opt3 from hemagglutinin__InfluenzaA__ABY51017

SEQ ID NO: 124265 - RNA, 1701 nt, Artificial Sequence; identical to SEQ ID NO: 123944
  derived and/or modified sequence opt3 from hemagglutinin__InfluenzaA__ABY51028

SEQ ID NO: 124266 - RNA, 1698 nt, Artificial Sequence
  derived and/or modified sequence opt3 from hemagglutinin__InfluenzaA__ABY51039
augaaggugaaacugcucguccuucugugcaccuucacagccacuaacgcugacacgaucuguauuggcuaccacgcaaauaacagcaccgauacaguugacacuguguuggagaagaauguaaccgugacacauuccgucaacuuacuggaaaauucucacaacgggaaacuaugccuccugaagggaauagcgccccuucagcuggguaauuguucaguggccggcuggaucuuggggaacccugagugcgaacuccugauuaguaaagagagcugguccuauaucguugaaaccccaaauccggagaacggaacuuguuaccccggccauuuugcugauuaugaggaacugagagagcaacucucuucggugagcucauucgaaagguuugagauuuucccuaaggagaguuccuggccaaaucacacagucaccggugugucugccagcugcucccauaacggggaaucaaguuuuuaccggaauuuacuguggcuuacgggaaagaacggcuuguaucccaaucugagcaaaucuuacgcaaacaacaaggagaaagaagugcuaguucucuggggcgugcaccacccuccaaauaucggggaccagaaggcccuguaucauacugagaacgcuuacgucuccguggugucaagccacuacagucgcaaauucacccccgaaauagcaaagcgaccuaagguccgugaucaggagggaagaaucaauuauuacuggacacuucuggagccaggugacacuauuaucuuugaagccaacggcaauuugauugcuccgagguaugccuucgcgcucucucggggguuuggauccggcaucauaaacagcaaugcacccauggauaaaugugacgccaagugccagaccccucaaggugcuauuaacucgucucugccauuccagaauguucaucccgugacaaucggggaguguccuaaauacguacgcuccgccaaguuaagaauggugaccggacugaggaacauuccaucaauccagagucggggccucuuuggcgcaaucgcuggguucauugaaggagguuggacgggcauggucgaugggugguauggauaccaccaccagaaugagcaaggcagcgguuaugccgcggaccagaaauccacucagaacgccauaaaugggaucacaaacaagguaaauucuguuauugaaaagaugaacacccaguuuacugcagugggcaaggaguucaacaaacuugagcgccgaauggaaaaucugaacaaaaaggucgaugacggauucaucgauauauggacauacaaugcugaguugcuagugcugcucgaaaacgagagaacccuggacuuucaugacagcaauguuaaaaaccuuuacgaaaagguaaaaggccaacugaagaauaacgccaaggagauugggaauggaugcuucgaguuuuaucacaaauguaacgaugaaugcauggagucagugaagaaugguacguacgacuaucccaaauacagugaagaguccaaguugaacagggagaaaaucgauggcgucaagcucgaaagcauggggguguaucagauccuggcuauuuacucuaccgucgccucaaguuuagugcugcuaguuagccucggagcaaucuccuucuggaugugcucuaauggcucgcugcagugucggauuugcauauga

SEQ ID NO: 124267 - RNA, 1698 nt, Artificial Sequence
  derived and/or modified sequence opt3 from hemagglutinin__InfluenzaA__ABY51050
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacucgaaaugccagacuccucaaggugccauuaauucuucccugccauuccagaacguucaucccgugaccaucggggaguguccuaaguauguacgcucagcuaaauuaagaauggugacaggacugaggaauauuccaaguauccagagccggggccucuuuggcgccaucgcaggguucauugaaggagguuggaccggcauggucgaugggugguacggauaucaccaccagaacgagcaaggcuccgguuacgcugccgaccagaagucuacgcagaaugcgauaaacgggaucacuaauaaagugaacagcguuauugaaaagaugaauacacaguuuaccgccgugggcaaggaguucaacaaacuugagcgccgaauggaaaaccugaauaagaaagucgaugacggauucaucgauauauggacuuacaacgcagaguugcuagugcugcucgaaaaugagagaacacuggacuuucaugacucaaacguaaagaaucuuuaugaaaaaguuaagagucaacugaagaacaaugcuaaagagauuggcaacgggugcuucgaguuuuaccacaaguguaaugaugaaugcauggaguccgugaaaaacggaaccuaugacuaccccaaguauagcgaagagucuaaauugaauagggagaagaucgauggugucaagcucgaaucaaugggcguguaccagauccuggccauuuauaguacggucgcuagcuccuuagugcugcuaguuucucucggggccaucucguucuggaugugcagcaacggaucccugcagugucggauuugcauauga

SEQ ID NO: 124268 - RNA, 1698 nt, Artificial Sequence; identical to SEQ ID NO: 124030
  derived and/or modified sequence opt3 from hemagglutinin__InfluenzaA__ABY51061

SEQ ID NO: 124269 - RNA, 1698 nt, Artificial Sequence
  derived and/or modified sequence opt3 from hemagglutinin__InfluenzaA__ABY51072
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccacgaaguuacggaugguaacuggacugcgcaauaucccaucaauccagagucgaggccucuucggcgccauugcaggguuuauagaaggagguuggacaggcaugguggacgggugguacggauaucaucaccagaacgagcaaggcagcgguuacgcugccgaucagaaauccacccagaaugcgaucaacgggauuacuaauaaggucaacucugugaucgagaaaaugaauacacaguucaccgccguuggcaaggcauucaacaaacuugaaagaaggauggagaaucugaacaagaagguggacgauggauuuuuggacauauggacguacaacgcugaacuacugguccuccuggagaaugaacggacccuugacuuccacgauagcaacgugaaaaaucuguaugagaagguaaaaucacaauugaagaacaaugccaaagaaauuggcaacgggugcuuugaguucuaccauaaguguaaugacgagugcauggaaaguguuaagaacggaacauaugauuaccccaaauauuccgaggaaagcaagcucaaucgugagaaaaucgacggugugaagcuggagucuaugggcgucuaccagaucuuagcuauuuauucaacuguggccaguagccugguccuacucgugucccugggggcaaucucuuuuuggaugugcucgaacggaagccuucagugucgcauuugcauauga

SEQ ID NO: 124270 - RNA, 1698 nt, Artificial Sequence; identical to SEQ ID NO: 123972
  derived and/or modified sequence opt3 from hemagglutinin__InfluenzaA__ABY51083

SEQ ID NO: 124271 - RNA, 1698 nt, Artificial Sequence; identical to SEQ ID NO: 123930
  derived and/or modified sequence opt3 from hemagglutinin__InfluenzaA__ABY51094

SEQ ID NO: 124272 - RNA, 1698 nt, Artificial Sequence; identical to SEQ ID NO: 124071
  derived and/or modified sequence opt3 from hemagglutinin__InfluenzaA__ABY51105

SEQ ID NO: 124273 - RNA, 1698 nt, Artificial Sequence; identical to SEQ ID NO: 123930
  derived and/or modified sequence opt3 from hemagglutinin__InfluenzaA__ABY51116

SEQ ID NO: 124274 - RNA, 1701 nt, Artificial Sequence
  derived and/or modified sequence opt3 from hemagglutinin__InfluenzaA__ABY51127
augaagaccaucauugcccugagcuacauacucugcaugguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuucaaaacaaaaagugggaucuuuucguggagagauccaaagccuauucuaauuguuaccccuaugacgucccugauuacgcaucgcugaggucauugguggccagcaguggcacucucgaauuuaacaaugaguccuucaacuggacagguguuacccagaaugggacgucuagcgcuugcauccggcgcuccaacaauucauuuuucagucgacugaacuggcugacucaucucaaguuuaaguauccagcauuaaaugugaccaugcccaacaacgagaaauucgacaagcuguacauuuggggaguccaccauccuggcacagauaaugaccagguguuucuuuaugcccaggcuagcggccguaucacuguaucuaccaaaagaucccaacagacaguuauuccaaacaucgggucaaggccccgggugcgcaauauaccuagcagaauuaguaucuacuggaccauugucaagccaggagauaucuugcugaucaacucuacggguaaucuaauugccccgaggggcuacuucaaaauacgguccggaaagagcucgaucaugcgcucugacgcgcccauugggaaguguaacuccgaaugcaucacuccuaauggcucaauaccaaacgacaaacccuuucagaaugugaaccgaauuacauauggugcauguccuagauacgugaagcagaauacccucaaacuggccacugggaugaggaacgucccagagaagcaaacacggggaaucuucggcgcuaucgccggcuuuauugaaaaugggugggagggaaugguugaugguugguauggcuuccgucaccagaacagugaggggaucggacaggcagcugaccuuaaaagcacccaagccgcgauugaucagauaaauggcaagcugaaccgcuugaucgguaaaacgaacgaaaaguuccaccagauugagaaggaauuuuccgagguggaagggagaauccaggaccucgagaaauacguagaggauaccaagaucgaccuguggucuuauaaugccgaauuacugguggcacucgagaaccaacauacaauugaucuuacugacagcgaaaugaauaaacuguucgagaagaccaaaaagcaguugagggaaaacgcugaggauaugggcaauggaugcuuuaagauauaccacaaaugugacaacgccugcaucggcucaauucggaaugggacauaugaucaugacgucuaccgagacgaggcucuaaacaaucgcuuccagaucaagggaguggaacugaaaagugguuacaaggauuggauucucuggaucuccuuugccauaagcugcuuccugcuuuguguugcacuguugggcuuuaucaugugggccugccagaaagggaacauuagauguaauaucugcauuuga

SEQ ID NO: 124275 - RNA, 1698 nt, Artificial Sequence
  derived and/or modified sequence opt3 from hemagglutinin__InfluenzaA__ABY51138
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugauuucaaaagagaguuggagcuacaucguugaaaccccaaauccggagaacggaacuuguuaucccggcuacuuugcugacuaugaggaacugagggagcaacucuccucugugucgucauucgaacgguuugagauuuucccuaaggagagcaguuggccaaaucauacagucaccgguguguccgccucuugcagccacaacgggaaguccucauuuuaccgcaauuuacuguggcuuacgggaaagaacggcuuguaucccaaucugagucgaagcuacgcaaacaauaaggaaaaagagguacuuguucucuggggcgugcaucacccuccaaacaucggggaucagcgugcccuguaccacacugaaaacgcuuaugucucugugguguccucacauuacagcagaagguucacccccgagauagcaaagcggccuaaaguccgcgaccaggaaggaagaaucaauuauuacuggacacuucuggagccaggugauacuauuaucuuugaggccaacggcaauuugauugcuccgagguucgccuuugcgcucagucggggguucggaucuggcaucauaaccuccaacgcacccauggacgaaugugaugccaagugccagacaccucaaggugcuauuaauagcucgcugccauuucagaacguucaccccgugaccaucggggaguguccuaaguauguacgcucugccaaauuacgaauggugacgggacugagaaauauuccauccauccagucaaggggccucuucggcgcaaucgcuggguuuauugaaggagguuggacuggcauggucgacgggugguacggauaucaucaccagaacgagcaaggcagugguuacgccgcggaucagaaaagcacacagaaugccauaaacgggaucaccaauaaagugaacuccguuauugaaaagaugaauacucaguucacagcagugggcaaagaguucaacaagcuagagcggcguauggaaaaucugaacaaaaaggucgacgauggauuuuuggacaucuggaccuacaacgcugagcuacuggugcuccuggaaaaugagcgcacgcuugacuuccacgauucuaacguaaagaaucuguaugaaaaaguuaagauacaauugaaaaacaaugccaaggagauuggcaacgggugcuuugaguucuaccauaaauguaaugacgaaugcauggagagcgugaagaacggaaccuaugauuaccccaaguauucagaagagaguaaacucaauagagagaagaucgacggugucaaacuggaauccaugggcguguaccagaucuuagcuauuuauagcacagucgccucuucacuggugcuacucguuagucugggggcaaucagcuuuuggaugugcuccaacggaucucuucaguguaggauuugcauauga

SEQ ID NO: 124276 - RNA, 1698 nt, Artificial Sequence; identical to SEQ ID NO: 123930
  derived and/or modified sequence opt3 from hemagglutinin__InfluenzaA__ABY51149

SEQ ID NO: 124277 - RNA, 1698 nt, Artificial Sequence
  derived and/or modified sequence opt3 from hemagglutinin__InfluenzaA__ABY51160
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugauuucaaaagagaguuggagcuacaucguugaaaccccaaauccggagaacggaacuuguuaucccggcuacuuugcugacuaugaggaacugagggagcaacucuccucugugucgucauucgaacgguuugagauuuucccuaaggagagcaguuggccaaaucauacagucaccgguguguccgccucuugcagccacaacgggaaguccucauuuuaccgcaauuuacuguggcuuacgggaaagaacggcuuguaucccaaucugaguaagagcuacgcaaacaauaaagaaaaggagguacuuguucucuggggcgugcaucacccuccaaacaucggggaucagcgagcccuguaccacacugaaaacgcuuaugucucugugguguccucacauuacagccguagauucacccccgagauagcaaaaaggccuaagguccgggaccaggaaggacgcaucaauuauuacuggacacuucuggagccaggugauacuauuaucuuugaggccaacggcaauuugauugcuccgagauucgccuuugcgcucaguaggggguucggaucuggcaucauaaccuccaacgcacccauggacaagugugaugccaaaugccagacaccucaaggugcuauuaauagcucgcugccauuucagaacguucaccccgugaccaucggggaauguccuaaguauguacggucugccaaauuacgcauggugacgggacugcgaaauauuccauccauccagucaagaggccucuucggcgcaaucgcuggguuuauugagggagguuggacuggcaugauagacgggugguacggauaucaucaccagaacgaacaaggcagugguuacgccgcggaucagaaaagcacacagaaugccaucaacgggauuaccaauaaagucaacuccgugaucgagaagaugaauacucaguucacagcaguuggcaaagaguucaacaagcuagaaaggcggauggagaaucugaacaagaaaguggacgauggauuuuuggacauauggaccuacaacgcugaacuacugguccuccuggagaaugaacguacgcuugacuuccacgauucuaacgugaagaaucuguaugagaaaguaaagagccaauugaaaaacaaugccaaggaaauuggcaacgggugcuuugaguucuaccauaaguguaaugacgagugcauggaaucaguuaaaaacggaaccuaugauuaccccaaguauagugaggaauccaaacucaaucgcgagaagaucgacggugugaaacuggagagcaugggcgucuaccagaucuuagcuauuuauucuacaguggccucaagucugguccuacucgugagccugggggcaaucuccuuuuggaugugcucuaacggaucgcuucaguguagaauuugcauauga

SEQ ID NO: 124278 - RNA, 1698 nt, Artificial Sequence
  derived and/or modified sequence opt3 from hemagglutinin__InfluenzaA__ABY51171
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccaugggugaaugugacgccaagugccagacaccucaaggggcuauuaauucgucucugccauuucagaacguucaccccgugaccaucggagaguguccuaaauauguaagguccgccaaguuacggauggugacgggccugcgcaauauuccaucaauccagagucgaggccucuucggggcaaucgcuggauuuauugaagguggcuggacugggauggucgauggaugguacggcuaucaucaccagaacgagcaagguagcggguacgccgcggaccagaaauccacacagaaugccauaaacggcaucaccaauaaggugaacucuguuauugaaaagaugaauacucaguucacagcagugggaaaagaguucaacaaacuugagagaaggauggaaaaucugaacaagaaggucgaugacggcuuuuuggauaucuggaccuacaacgcugagcuacuggugcuccuggaaaaugagcggacgcuugacuuccacgacagcaacguuaaaaaucuguaugaaaagguaaaaucacaauugaagaacaaugccaaagagauagggaacggaugcuuugaguucuaccauaaguguaaugaugaaugcauggagagugugaagaacgguaccuaugacuaccagaaauauuccgaagagagcaagcucaaucgugagaaaauugauggcgucaagcuggaaucuauggggguguaccagaucuuagcuaucuauucaacagucgccaguagccuggugcuacucguuucccugggagcaauuucuuuuuggaugugcucgaacggcagccuucaaugucgcaucugcauuuga

SEQ ID NO: 124279 - RNA, 1698 nt, Artificial Sequence; identical to SEQ ID NO: 123926
  derived and/or modified sequence opt3 from hemagglutinin__InfluenzaA__ABY51182

SEQ ID NO: 124280 - RNA, 1698 nt, Artificial Sequence; identical to SEQ ID NO: 123946
  derived and/or modified sequence opt3 from hemagglutinin__InfluenzaA__ABY51193

SEQ ID NO: 124281 - RNA, 1698 nt, Artificial Sequence; identical to SEQ ID NO: 123930
  derived and/or modified sequence opt3 from hemagglutinin__InfluenzaA__ABY51237

SEQ ID NO: 124282 - RNA, 1698 nt, Artificial Sequence; identical to SEQ ID NO: 123946
  derived and/or modified sequence opt3 from hemagglutinin__InfluenzaA__ABY51248

SEQ ID NO: 124283 - RNA, 1698 nt, Artificial Sequence; identical to SEQ ID NO: 123926
  derived and/or modified sequence opt3 from hemagglutinin__InfluenzaA__ABY51259

SEQ ID NO: 124284 - RNA, 1701 nt, Artificial Sequence; identical to SEQ ID NO: 124003
  derived and/or modified sequence opt3 from hemagglutinin__InfluenzaA__ABY51270

SEQ ID NO: 124285 - RNA, 1707 nt, Artificial Sequence
  derived and/or modified sequence opt3 from hemagglutinin__InfluenzaA__ABY76282
auggagaagaucgugcugcuccuugccauugucagccugguuaaauccgaccagauaugcaucggcuaccacgcuaacaauucuaccgaacauguggauacaauuauggagaagaacguaacugugacgcacgcacaagacaucuuggaaaaagcccauaaugggagauuaugugaucuggacggagucaagccccuaauucucagggauugcucaguggcggguuggcugcuuggcaacccuaugugugacgaguuccugaauguuccagaauggaguuauaucguggagaaaaacaauccggcuaacgauuugugcuaccccgggaauuuuaacgacuaugaggaacucaagcaucugcugagccggauaaaucacuucgagaagauccagauuaucccuaaauccucuuggucggaucacgaagccucaagcggagucaguuccgcauguccauaccagggccgcucuagcuuuuuccgaaacgugguauggcucauuaagaaaaaugacgccuaucccaccaucaagcguuccuacaacaauacaaaccaggaggauuuacugguucuuugggguauacaccauccuaacgacgcugcagagcaaacuagauuguaucagaauccaaccacauacauuucaguggggaccaguacucugaaccagaggcuaguccccaaaaucgccacacggagcaaggugaauggacagucuggccgcauggaauuuuucuggaccauucucaagccuaacgaugcuaucaauuuugaguccaacggcaauuucaucgccccagaaaacgcguacaaaauugugaagaaaggggacucaacgauaaugaaaagcgagcuggaauauggaaauugcaacacuaagugucaaaccccgaucggugcaauuaauaguucuaugcccuuucacaacauccauccucuuacaauaggcgagugcccaaaguacgucaaauccaauagacugguuuuggccacugggcucaggaacagcccccagggagagcggcgccgaaagaagagaggccuguucggugcuauugccggguuuaucgaaggaggcuggcagggcaugguggacgggugguauggauaccaccacucgaaugagcaggguucuggcuaugcagcugauaaagaauccacccaaaaggccaucgacgggguaacaaacaaagugaacucaauuaucgauaagaugaauacccaguucgaggcggucggaagggaauuuaacaauuuagagcggcguauugagaaccugaauaaaaagauggaagacggcuuccucgauguguggacguacaacgccgagcuucugguuuugauggaaaaugagcgcacucuagacuuccaugauaguaacgugaagaaucuguaugacaaagucagacuccagcugagggauaacgcaaaggaacuugguaauggguguuuugaguucuaccaccggugcgacaacgaguguauggaaagcgugcgaaauggcacauacgauuauccucaauacuccgaggaagcucgccugaaaagagaggagauaucuggaguaaaguuggaaagcaucggcaccuaucagauucucucaaucuacaguacuguugccuccagccuggcuuuagccaucaugguggcagggcugucucuauggaugugcucaaacggaagucuccagugcaggauuuguauauga

SEQ ID NO: 124286 - RNA, 1701 nt, Artificial Sequence
  derived and/or modified sequence opt3 from hemagglutinin__InfluenzaA__ABY81349
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaguaucgccggcuggauuuuggggaauccugagugcgaaagccucuucuccaagaagucuuggucguauaucgcagagaccccaaacucagaaaauggaacauguuacccgggcuauuuugccgauuacgaggagcugagggaacaacugagcagugucuccucuuucgagcgguuugaaauuuuccccaaagagcgcagcuggccuaagcauaacgugacccgagguguuacugcugcaugcucccacaaagggaagucaaguuuuuaucguaaucucuuauggcugacagagaaaaacggaagcuacccaaaucuuucuaaguccuaugugaacaauaaggaaaaagaggucuuggugcuguggggcguacaucaccccucaaacaucaaggaccagaaaaccauauaccagaaggaaaaugccuacguuagcguggucaguucuaacuauaacagaagguucacgccugagaucgcuaaacggccaaaggugcgcgaucaggaaggcagaauuaauuacuauuggacucuacucgagcccggggacaccaucauuuuugaggccaacggaaaucugaucgcgccuugguacgcauucgcccuuuccagggguuuuggcagcgggauaauuacaucgaacgcuucuauggaugaaugugacacuaaaugccaaaccccacagggagccaucaauuccucacugccguuccagaacgugcaccccgucacaauuggcgaguguccuaaguauguucggaguaccaaguugcgcauggugacgggucuccgaaauaucccaagcauccaguccagagggcuguuuggagcaauugcuggcuucauagaaggcggguggacuggaaugaucgaugguugguacggcuaucaucaccaaaacgagcaggggucuggauacgccgcggaccagaaaagcacacagaaugccauuaacggcaucaccaauaagguaaacucagugauagaaaagaugaauacucaauuuacagcagucgguaaagaguucaacaaauuagagaagaggauggaaaaucugaacaagaaaguggaugacggguuccucgacauuuggaccuacaacgcugagcuucugguuuugcuagaaaaugagcggacgcuggauuuucaugacaguaacgugaagaaucucuaugaaaaagucaagucccagcugaaaaacaaugccaaggaggugggcaacggaugcuucgaguuuuaccacaaguguaauaacgaaugcauggagagcguuaaaaauggcaccuaugauuaccccaaguauucugaagagucaaaacuuaaccgugagaagaucgacgggguaaaacuggaaaguaugggaguguaccagaucuuggcuauuuauagcacagucgccuccucucucgugcuguuagucucgcugggugcaaucagcuucuggaugugcuccaauggcucacuacaaugucgcauuugcauauga

SEQ ID NO: 124287 - RNA, 1701 nt, Artificial Sequence; identical to SEQ ID NO: 123944
  derived and/or modified sequence opt3 from hemagglutinin__InfluenzaA__ABY81371

SEQ ID NO: 124288 - RNA, 1698 nt, Artificial Sequence; identical to SEQ ID NO: 123930
  derived and/or modified sequence opt3 from hemagglutinin__InfluenzaA__ABY81382

SEQ ID NO: 124289 - RNA, 1698 nt, Artificial Sequence; identical to SEQ ID NO: 123972
  derived and/or modified sequence opt3 from hemagglutinin__InfluenzaA__ABY81393

SEQ ID NO: 124290 - RNA, 1698 nt, Artificial Sequence
  derived and/or modified sequence opt3 from hemagglutinin__InfluenzaA__ABY81415
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaucuccggagaauggaacuuguuaucccggcuacuuugcugacuaugaggaacugagagagcaacucucgucagugagcaguuucgaaagguuugagauuuucccuaaggaguccucuuggccaaaccauacagucaccggugugagcgccuccugcucacacaaugggaagaguagcuuuuaccggaacuuacuguggcuuacgggcaaaaauggauuguaucccaaccugucuaaguccuacgcaaauaacaaagaaaaggagguucuaguacucuggggcgugcaucacccuccaaauaucggggaucagcgcgcccuguaccacacugaaaacgcuuaugucucaguggugagcagucauuacucucgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucuccagaggguucggaagcggcaucauaaccucgaaugcacccaugggugaaugugacgccaagugccagacaccucaaggggcuauuaacucuucccugccauuucagaauguucaccccgugaccaucggagaguguccuaaauauguaaggucagccaaguuacggauggugacgggccugcgcaacauuccaaguauccagagccgaggccucuucggggcaaucgcuggauuuauugaagguggcuggacugggauggucgauggaugguacggcuaucaucaccagaaugagcaagguuccggguacgccgcggaccagaaaucuacacagaacgccauaaauggcaucaccaacaaggugaauagcguuauugaaaagaugaacacucaguucacagcagugggaaaagaguucaauaaacuugagagaaggauggaaaaccugaauaagaaggucgaugacggcuuuuuggauaucuggaccuacaacgcugagcuacuggugcuccuggaaaacgagcggacgcuugacuuccacgacucaaauguuaaaaaccuguaugaaaagguaaaaagucaauugaagaauaacgccaaagagauagggaauggaugcuuugaguucuaccauaaguguaacgaugaaugcauggaguccgugaagaaugguaccuaugacuaccccaaauauagcgaagagucuaagcucaaccgugagaaaauugauggcgucaagcuggaaucaauggggguguaccagaucuuagcuaucuauaguacagucgccagcucccuggugcuacucguuucucugggagcaauuucguuuuggaugugcagcaauggcucccuucagugucgcaucugcauuuga

SEQ ID NO: 124291 - RNA, 1701 nt, Artificial Sequence; identical to SEQ ID NO: 123944
  derived and/or modified sequence opt3 from hemagglutinin__InfluenzaA__ACA24502

SEQ ID NO: 124292 - RNA, 1698 nt, Artificial Sequence
  derived and/or modified sequence opt3 from hemagglutinin__InfluenzaA__ACA24513
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucaauucuguuucgucauucgaaagguuugagaucuucccuaaggagagcaguuggccaaaccauacagugaccggugucuccgccucuugcagccacaaugggaaguccucauuuuaccggaacuuacuguggcuuacgggcaaaaauggauuguaucccaaccugaguaagagcuacgcaaauaacaaagaaaaggaggugcuaguacucuggggcguucaucacccuccaaacauaggggaucagcgcgcccuguaccacacugaaaaugcuuaugugucugucguguccucacauuacagccgacguuucacccccgagaucgcaaaaagaccuaaggugagggaccaggaaggacggauuaacuauuacuggacacuucuggagccacgcgauacuaucauuuuugaggccaaugguaacuugaucgcuccgagauucgccuuugcgcucaguaggggcuucgggucuggaauaauuaccuccaaugcacccauggacgaaugugaugccaagugccagacaccucaaggcgcuaucaacagcucgcugccauuucagaauguccaccccguuaccauuggugaguguccuaaauaugugcggucuacgaaguuacgcaugguaacugggcugcgaaacaucccauccauccagucaagaggacucuucggcgccauugcaggcuuuauagaagggggauggacagguaugguggacggcugguacggguaucaucaccagaaugagcaaggaaguggcuacgcugccgaucagaaaagcacccagaacgcgaucaaugguauuacuaacaaggucaauuccgugaucgaaaagaugaacacacaguucaccgccguugggaaagaguucaauaaacuugagaggcggauggaaaaccugaacaagaagguggacgauggcuuuuuggacauauggacguacaaugcagagcuacugguccuccuggaaaacgagcguacccuugacuuccacgauucuaaugugaaaaaccuguaugaaaagguaaaaagccaauugaagaauaacgcuaaagagauuggaaauggcugcuuugaguucuaccauaaguguaacgacgaaugcauggagucaguuaagaaugggacauaugauuaccccaaauauagugaagaguccaagcucaaccgcgagaaaaucgacggagugaagcuggaaagcaugggugucuaccagaucuuagccauuuauucuacuguggcuucaagucugguccuacucgugagccugggcgccaucuccuuuuggaugugcucuaaugggucgcuucaguguagaauuugcauauga

SEQ ID NO: 124293 - RNA, 1698 nt, Artificial Sequence; identical to SEQ ID NO: 123930
  derived and/or modified sequence opt3 from hemagglutinin__InfluenzaA__ACA24524

SEQ ID NO: 124294 - RNA, 1701 nt, Artificial Sequence
  derived and/or modified sequence opt3 from hemagglutinin__InfluenzaA__ACA24689
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauaaucgauggggagaauuguacccuaauugacgcucuccugggagauccgcagugcgacggcuuucaaaacaaaaagugggaucuuuucguggaaagaagcaaagccuauuccaauuguuaccccuaugacgucccugauuacgcaucucugaggucguugguggccucaagcgguacucucgaguuuaacaaugaaaguuucaacuggacagggguuacccagaauggaacguccucugcuugcaagcggggcagcaacaauuccuuuuucucacgccugaacuggcugacucauaguaaguuuaaauauccagcacucaaugugaccaugcccaacaacgaggaguucgacaaguuauacaucuggggcguccaccauccugggacagauaaugaccagauuuuucuguaugcccaggcuagcggacgaaucacugugucuaccaaacguucccaacagacaguaauaccaaacauugguucaagacccaggguucggaauaucccuagccgcauuaguaucuacuggaccaucgugaagccaggcgauauucuuuugauaaacucuacggggaaucugaucgccccgagaggauacuucaaaauuagguccggcaagagcucgaucaugcggucugacgcgcccauagguaaguguaacuccgaaugcauuacuccuaaugggucaaucccaaacgacaaacccuuucagaaugucaaccgcaucacauauggagcauguccucgauacgugaagcagaauacccuaaaacucgccacuggcaugagaaacgugccagagaagcaaacaaggggcauuuucggggcuaucgccggauuuauugaaaaugguugggagggcauggucgaugggugguauggauuccggcaccagaacagugagggcauaggucaggcagcugaccugaaaagcacccaagccgcgaucgaucagauuaaugggaaacuuaaccgucugaucggcaagacgaacgaaaaguuccaccagaucgagaaggaauuuuccgagguugaaggacgcauucaggacuuggagaaauacguggaggauaccaagauagaccucuggucuuauaaugccgaacuguuaguagcacuggagaaccaacauacaaucgaucucacugacagcgaaaugaauaaacuuuucgagaagaccaaaaagcagcugagagaaaacgcugaggauaugggcaaugggugcuuuaagauuuaccacaaaugugacaacgccugcaucggaucaauuaggaaugguacauaugaucauuacguguaccgggacgaggcuuugaacaaucgauuccagaucaagggcauagaacuaaaaaguggguauaaggacuggauccuguggauuuccuuugccaucagcugcuuccuccugugugucgcacuucugggauuuauuaugugggccugccagaaaggcaacauccgcuguaauauaugcauuuga

SEQ ID NO: 124295 - RNA, 1701 nt, Artificial Sequence
  derived and/or modified sequence opt3 from hemagglutinin__InfluenzaA__ACA24700
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagccaggccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaaacggggcagcaacaauuccuuuuucucacgccugaacuggcucacucauaguaaguuuaaguauccagcauuaaaugugaccaugcccaacaacgaggaguucgacaaacuguacauuuggggcguccaccauccugggacagauaaugaccagaucuuucuuuaugcccaagcuagcggacgaauuacugugucuaccaagcguucccagcagacaguaaucccaaacauagguucaagacccaggguucggaauauuccuagccgcaucaguauuuacuggaccaucgugaaaccaggcgauaucuugcugauuaacucuacggggaaucuaauagccccgagaggauacuucaagaucagguccggcaaaagcucgauuaugcggucugacgcgcccaucgguaaguguaacuccgaaugcauaacuccuaaugggucaauuccaaacgacaagcccuuucagaaugucaaccgcaucacauauggagcauguccucgauacgugaaacaaaauacccucaagcuggccacuggcaugagaaacgugccagagaaacagacaaggggcaucuucggggcuauugccggauuuaucgaaaaugguugggagggcauggucgaugggugguauggauuccggcaccagaacagugagggcauuggucaagcagcugaccuuaagagcacccaggccgcgauagaucagaucaaugggaaacugaaccguuugauuggcaagacgaacgaaaaauuccaccagaucgagaaggaauuuuccgagguugaaggacgcauccaagaccucgagaaguacguggaggauaccaaaauugaccuguggucuuauaaugccgaauuacugguagcacucgagaaccagcauacaauagaucuuacugacagcgaaaugaauaagcuguucgagaaaaccaagaaacaguugagagaaaacgcugaggauaugggcaaugggugcuuuaagaucuaccacaagugugacaacgccugcauuggaucaaucaggaaugguacauaugaucaugacguguaccgggacgaggcucuaaacaaucgauuccagauuaaaggcgucgaacugaagaguggguacaaagauuggauccucuggauauccuuugccaucagcugcuuccugcuuuguguggcacuguugggauuuauuaugugggccugccaaaagggcaacauccgcuguaauauuugcaucuga

SEQ ID NO: 124296 - RNA, 1698 nt, Artificial Sequence
  derived and/or modified sequence opt3 from hemagglutinin__InfluenzaA__ACA28846
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgggauacagaaagcccuguaccauacggagaaugcuuacgucuccguggugucaagccacuauagucgcaaguucacucccgaaaucgcaaagcgaccuaaaguccgugaccaggagggaagaauuaacuacuauuggacccuucuggagccaggugauacaaucauuuuugaagccaauggcaacuugaucgcuccgagguacgccuucgcgcucucucggggguuuggauccggcauaauuaauagcaacgcacccauggacaagugugaugccaaaugccagacuccucaaggugcuaucaauucgucucugccauuccagaacguucaucccgugaccauuggggaguguccuaaguauguacgcuccgccaaauuaagaauggugacaggacugaggaauaucccaucaauccagagucggggccucuuuggcgcaauugcuggguucauagaaggagguuggaccggcauggucgacgggugguacggauaucaccaccagaacgagcaaggcagcgguuacgccgcggaucagaaguccacgcagaaugccaucaacgggauuacuaauaaagugaacucuguuaucgaaaagaugaauacacaguuuaccgcagugggcaaggaguucaacaaacuugagcgccgaauggaaaaccugaauaagaaagucgacgauggauucauagacauuuggacuuacaacgcugaguugcuagugcugcucgaaaaugagagaacacuggauuuucaugacagcaacguaaagaaucuuuaugaaaaaguuaagucacaacugaagaacaaugccaaagagaucggcaacgggugcuucgaguuuuaccacaaguguaaugacgaaugcauggagagugugaaaaacggaaccuaugauuaccccaaguauuccgaagagagcaaauugaauagggagaagaucgacggugucaagcucgaaucuaugggcguguaccagauucuggcuaucuauucaacggucgccaguagcuuagugcugcuaguuucccucggggcaauuucuuucuggaugugcucgaacggaagccugcagugucggauaugcaucuga

SEQ ID NO: 124297 - RNA, 1701 nt, Artificial Sequence
  derived and/or modified sequence opt3 from hemagglutinin__InfluenzaA__ACA33749
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcuccugcauccggcgcucaaacaauagcuuuuucagccgacugaacuggcucacucauuuaaaguuuaaguauccagcucugaaugugaccaugcccaacaacgagaaauucgacaaacuuuacauuuggggaguccaccauccuggcacagauaaugaccagaucuuuuuguaugcacaggccucuggccguauuacuguguccaccaagagaucacaacagacaguaaucccaaacauagggagcaggccccggguucgcaauauuccuaguagaaucucuauuuacuggaccaucgugaagccaggagauauccugcuaauuaacuccacggguaaucucauagcuccgaggggcuacuucaaaauccggagcgggaagucgucuauuaugcgcuccgacgcccccaucggaaaguguaacucagaaugcauaacuccuaauggcaguauuccaaacgacaaacccuuucagaaugucaaccgaaucacauauggugcguguccuagauacgugaagcagaauacccugaaacuugcaacugggaugaggaacgugccagagaagcaaacacggggaaucuucggcgccauugcuggcuuuaucgaaaaugggugggagggaauggucgaugguugguauggcuuccgucaccagaacagcgaggggauuggacaggccgcagaccugaaauccacccaagcugccauagaucagaucaauggcaaguugaaccgccucauugguaaaacgaacgaaaaguuccaccagaucgagaaggaauuuucugagguugaagggagaauccaggaccuggagaaauacguggaggauaccaagauugacuuauggagcuauaaugcggaacugcucguagcccuugagaaccaacauacaauagaucugacugacucagaaaugaauaaauuguucgagaagaccaaaaagcagcuaagggaaaacgcagaggauaugggcaauggaugcuuuaagaucuaccacaaaugugacaacgcuugcauuggcaguauccggaaugggacauaugaucaugacguguaccgagacgaggcccugaacaaucgcuuccagauuaagggagucgaacucaaauccgguuacaaggauuggauccuguggauaaguuuugcuaucucuugcuuccuucuguguguggccuugcucggcuuuauuaugugggcaugccagaaagggaacaucagauguaauauuugcaucuga

SEQ ID NO: 124298 - RNA, 1698 nt, Artificial Sequence; identical to SEQ ID NO: 123926
  derived and/or modified sequence opt3 from hemagglutinin__InfluenzaA__ACA96519

SEQ ID NO: 124299 - RNA, 1659 nt, Artificial Sequence
  derived and/or modified sequence opt3 from hemagglutinin__InfluenzaA__ACC55270
augaacacccagauccuggccuucauugcuugcgugcucacaggcgucaagggggacaaaauaugucuuggacaccaugcaguugccaaugguacuaaggugaacacgcugaccgagagaggcaucgaaguagugaaugcgacagagacugucgaaaccacaaacauuaaaaagaucugcacccaagggaaaagacccacugauuugggacaguguggcuuacuggguacacuaauugggccuccacagugcgaccaguuucucgaguucagcuccgaucugaucauagaacggcgcgagggaaccgacaucuguuacccgggccgauuuacgaaugaggaaucucuucgucaaauucugagaaggucaggcgggaucggaaaggagaguauggguuucacuuauagcggcauucggaccaacggggcuacauccgccugcacucgcucuggaucgucauuuuacgcagaaaugaagugguugcucagcaauagugauaacgccgcuuucccccagaugaccaaagcauauagaaauccuaggaacaagccagcccugaucauauggggcgugcaccauuccgagucuguuagcgagcagacaaaacuguacgguuccgggaauaagcucauuaccgugcggucaaguaaauaucagcagagcuuuacgcccaacccuggagcucgccgaaucgacuuccacugguuacugcuugauccaaaugacacugucacauuuaccuucaacggcgccuuuauugcgcccgauagaacuucuuucuuuaggggcgaauccuugggggugcaaucagacgcaccucuggauagcaguugucggggagacugcuuccauucugguggcacaaucguauccagccuaccauuccagaauaucaacucgcguaccguugggaaguguccgcgcuacgugaagcagaaaucucuccugcuugccacgggaaugagaaacguccccgagaagccuaaaccaaggggccuguuuggugcuauugccggguucauagaaaauggcugggagggauugaucaacggcugguauggguuucggcaccaaaaugcacagggagaagguaccgcugccgauuacaaguccacacagucagcgauugaccaaaucacuggcaaacucaaccgacugauagggaagaccaaucagcaguucgaguuaauugacaacgaguuuaaugaaaucgagcagcaaaucggaaacgugauuaauuggacacgcgaugccaugacugaaaucuggaguuacaacgcagagcugcucguggcuauggaaaaucagcacaccauugaccuugccgauagcgagauguccaaacuguaugagagagucaagaagcaguugagggaaaacgcugaggaagacggcacagguugcuucgagauauuucauaaaugugaugaccagugcauggaaucuauccggaauaacaccuacgaucacacucaauaucgcacggagagccuacagaauaggauucagaucgaccccguuaagcugucaaguggguacaaagauaucauucucugguucuccuuuggcgccagcugcuuccugcuucuggcaauagccaugggauugguguuuaucuguauuaagaacggcaacaugcagugcacaaucuguauuuga

SEQ ID NO: 124300 - RNA, 1698 nt, Artificial Sequence; identical to SEQ ID NO: 123930
  derived and/or modified sequence opt3 from hemagglutinin__InfluenzaA__ACC61964

SEQ ID NO: 124301 - RNA, 1698 nt, Artificial Sequence
  derived and/or modified sequence opt3 from hemagglutinin__InfluenzaA__ACC61975
augaaggugaaacugcucguccuucugugcaccuucacagccagcuacgcugacacuaucuguauuggcuaucacgcaaacaauuccacggauaccguugacacaguguuggagaagaacguaacugugacccauucugucaauuuacuggaagauucacacaacgggaaacuaugccuccugaagggaauagcgccccuucagcuggguaauuguaguguggccggcuggaucuuggggaacccugagugcgaacuccugauuagcaaagaguccuggucuuacaucguugaagugccaaauccggagaacggaacauguuaucccggcuacuuugcugacuaugaggaacugagagagcaacucucgucaauuagcaguuucgaaagguuugagaucuucccuaaggaguccucuuggccaaaucauaccgucacuggugugagcgccuccugcucacacaacgggaagaguagcuuuuaccggaauuuacuguggcuuacaggcaaaaacggauuguaucccaaucugucuaaguccuacgcaaacaauaaagaaaaggagguucuaguacucuggggcgugcaucacccuccaaacauaggggaucagcgcgcccuguaccacaccgaaaacgcuuaugucucaguggugagcagucauuacucucgacguuucacgcccgagaucgcaaaaagaccuaaggucagggaccaggaaggacggauuaauuauuacuggacucuucuggagccaggugauaccaucauuuuugaggccaacggcaauuugaucgcuccgcgcuucgccuuugcgcucuccagagggcugggaagcggcauaauuacaucgaacgcacccauggacgaaugugaugccaagugccagacuccucaaggugcuaucaauucuuccuuaccauuccagaacguucaccccgugaccauuggggaguguccuaaauauguaaggucagccaagcugcggauggugacaggacuccgcaauaucccaaguauccagagccgaggccuuuuuggcgcaauugcuggguucauagaaggagguuggaccggcauggucgacgggugguacggauaucaucaccagaacgagcaaggcuccgguuacgccgcggaucagaaaucuacgcagaaugccaucaacgggauuacuaauaaggugaacagcguuaucgaaaagaugaauacacaguuuaccgcagugggcaaagaguucaacaaacuggagagaaggauggaaaauuugaacaagaaggucgacgauggauuccuagacauauggacuuacaacgcugagcugcucgugcugcuugaaaaugagcggacacuggacuuucacgauucaaacguuaaaaauuuguaugaaaagguaaaaagucaacucaagaacaaugccaaagagauuggcaacgggugcuucgaguuuuaccauaaguguaauaacgaaugcauggaguccgugaagaauggaaccuaugacuaccccaaauauagcgaagagucuaagcugaaccgugagaaaaucgauggugucaaguuagaaucaaugggcguguaccagauccuggcuauuuauaguacggucgccagcucccuagugcuccugguuucucuuggggcaaucucguucuggaugugcagcaauggauccuugcagugucgcauuugcauauga

SEQ ID NO: 124302 - RNA, 1698 nt, Artificial Sequence; identical to SEQ ID NO: 123926
  derived and/or modified sequence opt3 from hemagglutinin__InfluenzaA__ACC61986

SEQ ID NO: 124303 - RNA, 1698 nt, Artificial Sequence
  derived and/or modified sequence opt3 from hemagglutinin__InfluenzaA__ACD37430
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggagaguuccuggccaacacauaccgugacgggugucucugcaagcugcucccacaaugggaagucaaguuuuuaccggaacuuacuguggcuuacuggcaaaaauggauuguaucccaaccugagcaagucuuacgugaauaacaaagaaaaggaggugcuaguucucuggggcgugcaucacccuccaaauaucggggaucagcgcgcccuguaccacaccgaaaacgcuuaugucuccguggugucaagccauuacagucgacguuucacacccgagauagcaaaaagaccuaaggucagggaccaggaaggacggaucaacuauuacuggacucuucuggagccaggugauaccauuaucuuugaggccaauggcaacuugauugcuccgugguaugccuucgcgcucucucgcggguuuggauccggcaucauaacaagcaaugcacccauggacgaaugugaugccaagugccagaccccucaaggugcuauuaacucgucucugccauuccagaauguucaccccgugacgaucggggaguguccuaaauacguaagauccgccaaguuaaggauggugacuggacugcggaacauuccaucaauccagagucgcggccucuuuggcgcaaucgcuggguucauugaaggagguuggacaggcauggucgacgggugguauggauaccaucaccagaaugagcaaggcagcgguuacgccgcggaucagaaauccacccagaacgccauaaaugggaucacuaacaagguaaauucuguuauugaaaagaugaacacacaguuuaccgcagugggcaaagaguucaauaaacuugagcgaagaauggaaaaccugaauaagaaggucgacgauggauucuuggacaucuggacguauaacgcugagcuacuggugcuccuggaaaacgagaggacccuugacuuucacgauagcaauguuaaaaaccuguacgaaaagguaaaaucacaauugaagaauaacgccaaagagauaggcaaugggugcuucgaguuuuaucauaaguguaacaaugaaugcauggagagugugaagaacggaacauacgacuaucccaaauacuccgaagagagcaagcucaaucgggagaaaauugauggugucaagcuggaaucuaugggcguguaucagaucuuagcuaucuacucaacugucgccaguagccuggugcuacucguuucccugggggcaauuucuuucuggaugugcucgaacggaagccuucagugucguaucugcauuuga

SEQ ID NO: 124304 - RNA, 1698 nt, Artificial Sequence
  derived and/or modified sequence opt3 from hemagglutinin__InfluenzaA__ACD37507
augaaggccaaacugcucgugcuucugugcaccuucgcugcaacauacgccgacacuaucuguauuggcuaucacgcgaacaauagcacggauaccgucgacacaguuuuggagaagaacgugacuguaacccauuccgugaauuuacuggaaaacucucacaaugggaaacuaugccuccugaagggaauagcuccccuucagcuggguaacuguucagucgccggcuggaucuuggggaauccugagugcgaacuccugauuaguaaagagagcugguccuacaucguggaaaagccaaacccggagaauggaacauguuaucccggccauuuugcagauuacgaggaacugagagagcaacucucuucgguuagcucauucgaaagguuugagauuuucccuaaggagaguuccuggccaaaccacaccgugacuggugucucugccagcugcucccauaauggggaaucaaguuuuuaucggaacuuacuguggcuuacaggcaaaaauggauuguaccccaaccugagcaagucuuaugcuaauaacaaagagaaggaagugcuaguacucuggggcguucaccacccuccaaacaucgggaaucagaaagcacuguaccauaccgagaacgccuacguguccgucgugucaagccacuauagucgcaaguucacgcccgaaauagcuaagcgaccuaaagugcgugaccaggagggaagaaucaauuacuauuggacucuucuggagccaggugauaccauuaucuuugaagccaacggcaauuugauugcgccgagguacgcauucgcccucucucggggguuuggauccggcaucauaaacagcaaugcucccauggacaagugugaugccaaaugccagacaccucaaggugcaauuaacucgucucugccauuccagaauguccaucccguuacuaucggggaguguccuaaguaugugcgcuccgcuaaauuaagaaugguaaccggacugaggaacauuccaucaauccagagucggggccucuuuggcgccaucgcgggguucauugaaggagguuggacaggcaugguggacgggugguacggauaucaccaccagaaugagcaaggcagcgguuacgccgcagaucagaaguccacccagaacgcuauaaaugggaucacgaacaaagucaauucugugauugaaaagaugaacacucaguuuacagccguuggcaaggaguucaacaaacuugagcgccgaauggaaaaucugaacaagaaaguggacgauggauucaucgacauauggaccuacaaugcugaguugcuaguccugcucgaaaacgagagaacucuggauuuucaugacagcaaugugaagaaccuuuaugaaaaaguaaagucacaacugaagaauaacgccaaagagauuggcaaugggugcuucgaguuuuaccacaaguguaacgacgaaugcauggagaguguuaaaaauggaacauaugauuaccccaaguauuccgaagagagcaaauugaacagggagaagaucgacggugugaagcucgaaucuaugggcgucuaccagauccuggcaauuuauucaaccguggccaguagcuuaguccugcuagugucccucggggcuaucucuuucuggaugugcucgaauggaagccugcagugucggauuugcauauga

SEQ ID NO: 124305 - RNA, 1698 nt, Artificial Sequence; identical to SEQ ID NO: 124071
  derived and/or modified sequence opt3 from hemagglutinin__InfluenzaA__ACD56113

SEQ ID NO: 124306 - RNA, 1698 nt, Artificial Sequence; identical to SEQ ID NO: 123930
  derived and/or modified sequence opt3 from hemagglutinin__InfluenzaA__ACD56124

SEQ ID NO: 124307 - RNA, 1701 nt, Artificial Sequence; identical to SEQ ID NO: 124003
  derived and/or modified sequence opt3 from hemagglutinin__InfluenzaA__ACD56258

SEQ ID NO: 124308 - RNA, 1701 nt, Artificial Sequence; identical to SEQ ID NO: 123745
  derived and/or modified sequence opt3 from hemagglutinin__InfluenzaA__ACD56269

SEQ ID NO: 124309 - RNA, 1698 nt, Artificial Sequence
  derived and/or modified sequence opt3 from hemagglutinin__InfluenzaA__ACD56280
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccgggaaacggcacuuguuaucccgguuacuuugcugacuaugaggagcugagagaacaacucucuucgguuagcucauucgagagguuugaaaucuucccuaaggagaguuccuggccaaaucauacagugaccggggucucugccagcugcucccacaacggaaagucaaguuuuuaccggaauuuacuguggcuuacgggcaaaaacggcuuguaucccaaucugagcaagucuuacgcaaacaauaaagagaaggaagugcuaguacucuggggaguucaucacccuccaaacauaggggaucagcgcgcccuguaccacacugagaacgcuuauguguccgucgugucaagccauuacagucgacguuucacccccgaaaucgcaaaaagaccuaaggugagggaccaggagggucggauuaauuauuacuggacacuucuggaaccaggcgauacuaucauuuuugaggccaacgggaauuugaucgcuccgcgcuucgccuuugcgcucucuagaggauucggcuccgguauaauuaccagcaacgcacccauggacgagugugaagccaagugccagacaccucaaggggcuaucaauucgucucugccauuucagaacguccaccccguuaccauuggagaguguccuaaauaugugagguccacgaaguuacggaugguaacuggccugcgcaauaucccaucaauccagagucgaggccucuucggggccauugcaggauuuauagaagguggcuggacagggaugguggauggaugguacggcuaucaucaccagaacgagcaagguagcggguacgcugccgaccagaaauccacccagaaugcgaucaacggcauuacuaauaaggucaacucugugaucgaaaagaugaauacacaguucaccgccguuggaaaagaguucaacaaacuugagagaaggauggaaaaucugaacaagaagguggaugacggcuuuuuggauauauggacguacaacgcagagcuacugguccuccuggaaaaugagcggacccuugacuuccacgacagcaacgugaaaaaucuguaugaaaagguaaaaucacaauugaagaacaaugcuaaagagauugggaacggaugcuuugaguucuaccauaaguguaaugaugaaugcauggagaguguuaagaacgguacauaugacuaccccaaauauuccgaagagagcaagcucaaucgugagaaaaucgauggcgugaagcuggaaucuaugggggucuaccagaucuuagccauuuauucaacuguggcuaguagccugguccuacucgugucccugggagccaucucuuuuuggaugugcucgaacggcagccuucagugucgcauuugcauauga

SEQ ID NO: 124310 - RNA, 1689 nt, Artificial Sequence
  derived and/or modified sequence opt3 from hemagglutinin__InfluenzaA__ACD56324
auggccaucauuuaccugauacuccuuuucaccgcugugagaggcgaccagaucugcauuggguaucacgcaaacaauagcacagagaaggucgauacuauccuggaaaggaacguuacggugacccaugccaaaaauauuuuggagaagacacacaacggacgguuauguaaacugaaugguauacccccucuagaacucggcgacugcuccaucgcgggguggcugcuuggaaacccagagugugaucgccuguugcgaguaccggaauggucuuacaucauggagaaggagaauccccguaacggccucugcuauccugguucauuuaaugacuacgaagaacugaaacaucugcucaguagcgugaagcacuucgaaaaggucagaauuuuaccaaaagauagguggacucaacauaccacaaccggguccucucgggcuugugccgugucgggaaaccccucauuuuuccgcaauaugguuuggcugacuaagaaagagagcaacuauccuguggcaaagggcaguuacaauaacacauccggcgagcagaugcuuaucauuuggggaguccaccacccaaucgacgaaaccgagcagagaacguuguaucagaauguggggacuuacguaucuguugguaccagcacacugaacaaaagguccacucccgauauagccacccggccuaaggugaacggccuagggucacgcauggaauuuaguuggacacuccuggacaugugggauaccauuaauuucgagagcacgggaaaccuuaucgcuccagaauacggcuuuaagauuucuaaacgagguuccucagggaucaugaagacugagagaacacuggagaauugcgaaaccaaaugucaaacuccguugggagcaaucaacacaacccuccccuuccauaauguccacccucugacgauuggcgagugcccaaaguaugugaaaagcgaaaaguuagugcuggccaccggccucaggaacgucccccagauagagccucgggggcuuuuuggagcuaucgccgguuucauugaaggcggguggcagggaaugguugacggcugguacgguuaucaucacaguaaugaucaggggucuggcuacgcggcagacaaagaguccacacaaaaggccuuugauggaaucacuaacaaggugaauagcguaauagagaaaaugaacacccaguucgaagcugugggcaaggaguuuucgaaucuggaacgucgcuuggagaaccuaaauaaaaagauggaagacggguuccuggacgucuggacauauaacgccgagcuccuggugcuuauggagaaugaaagaacucuggauuuccacgacucuaacguuaaaaacuuguacgauaaggugaggaugcagcuccgggacaaugucaaggagcugggaaacgguuguuuugaguucuaucauaaaugcgaugacgaguguaugaacuccgugaagaauggcaccuacgauuacccaaaauaugaggaagagucaaaguuaaaucgaaacgaaauuaaagggguaaagcugaguagcaugggaguuuaccagauccuagcaaucuaugcuacaguggccggcucccucucucuggcgauuaugauggccgguaucagcuuuuggaugugcucaaaugggagucuucaaugccgcauuuguauauga

SEQ ID NO: 124311 - RNA, 1689 nt, Artificial Sequence
  derived and/or modified sequence opt3 from hemagglutinin__InfluenzaA__ACD85187
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcaguuuuaaugauuaugaagaacugaagcaucugcucagcuccgugaagcacuucgaaaaagucaagauuuuaccaaaagaccguuggacucaacauaccacaaccggugggucuaaggcuugugccgugucgggaaaacccucauuuuucagaaacaugguuuggcugacuaagaagggcccuaauuacccaguggcaaaaggcagcuauaacaauacaaguggggagcagaugcuuaucauuuggggaguccaccaccccaaggaugaggccgaacagagggcuuuguaccaggagguggguaccuacguauccgcaucuacgagcacucugaacaaacgguccaccccugaaaucgccgcucgcccagagguuaauggccuagggucaagaauggaauuuaguuggacacuccuggacgugugggauacuauaaacuucgagagcaccggaaaucuugucgccccggaguauggcuuuaagauuucuaaaagggguuccucagggaucaugaagacagaaggaacccugggcaacugcgagacgaaaugucaaacucccuugggcgcgauuaacacaacccucccuuuccauaaugugcacccacugacuaucggggaaugccccaaguacgugaaaagcgagaaauuaguccuggcaacaggacuccggaacguuccucagaucgaaagucgcggucuuuuuggcgccauugcuggguucauagagggaggcuggcaggguaugguggacgggugguauggcuaccaucacucuaaugaucagggauccggcuaugccgcagacaaggagagcacccaaaaggcuuuugaugggaucacgaacaagguaaauucggugauugagaaaaugaacacccaguucgaggccgucggaaaggaauuuaauaaccuggagaagcgauuggaaaaucuaaacaaaaagauggaggacgguuuccuggacguguggacauacaaugcggagcuccugguucuuauggaaaacgagagaacucuggauuuccacgacucuaaugugaaaaacuuguaugauaaggucaggaugcagcuccgggacaaugugaaagaacugggcaacggguguuuugaguucuaccauaagugcgaugacgaguguaugaacuccguaaagaauggaaccuacgauuauccaaaauacgaagaggaaucaaaguuaaaccguaaugagaucaaaggcguuaagcugaguagcauggguguguaucagauacuagccauuuacgcaacagucgcugggucccucucucuggccaucaugauggcuggcaucagcuuuuggaugugcucaaacggaagucuucaaugccgcauuuguaucuga

SEQ ID NO: 124312 - RNA, 1689 nt, Artificial Sequence
  derived and/or modified sequence opt3 from hemagglutinin__InfluenzaA__ACD85198
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcaguuuuaaugauuaugaggagcugaagcaucugcucagcuccgugaagcacuucgaaaaagucaagauuuuaccaaaagacgguuggacucaacauaccacaaccgggggaucuaaggcuugugccgugucgggcaaacccucauuuuuccguaacaugguuuggcugacuaagaagggcccuaauuacccaguggcaaaaagaagcuauaacaauacaaguggggagcagaugcuuaucauuuggggaguccaccaccccaccgaugaggccgaacagagggcuuuguaccaggagguggguacguacguauccgcaucuacuagcacccugaacaagcgguccacaccugaaaucgccgcucgcccagagguuaauggccuaagaucaaggauggaauuuaguuggacucuccuggacgugugggauaccauaaacuucgagagcacagggaaucuugucgccccggaguauggauuuaaaauuucuaagcggggcuccucagguaucaugaaaaccgaagggacgcugggaaacugcgagacuaagugucaaacacccuugggcgcgauuaacaccacucucccuuuccauaaugugcacccacugacaaucggcgaaugccccaaauacgucaagagcgagaaguuagugcuggcaaccgggcuccgcaacguuccucagaucgaaagucgaggacuuuuuggugccauugcuggcuucauagaagggggauggcagggcaugguggacgguugguauggguaccaucacucuaaugaucagggcuccggauaugccgcagacaaagagagcacgcaaaaggcuuuugauagaaucaccaacaaaguaaauucggugauugaaaagaugaacacacaguucgaggccgucggcaaagaauuuucuaaucuggagaagagguuggaaaaccuaaauaagaaaauggaggacggguuccuggacguguggacuuacaacgcggagcuccugguucuuauggaaaaugagcggacccugggauuccacgauuccaacgugaagaauuuguaugacaaaguccguaugcagcuccgcgauaacgugaaggaacuggguaauggcuguuuugaguucuaccauaaaugcgacgaugaguguaugaacucaguaaagaacgggacauacgacuauccaaaguacgaagaggaaaguaaauuaaagagaaaugagaucaaaggaguuaagcugagcuccaugggcguguaucagauacuagccauuuacgcaacugucgcugguucucucagccuggccaucaugauggcugggaucucauuuuggaugugcaguaacggcucccuucaaugcaggauuuguaucuga

SEQ ID NO: 124313 - RNA, 1689 nt, Artificial Sequence
  derived and/or modified sequence opt3 from hemagglutinin__InfluenzaA__ACD85209
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaggaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacucagaagggcagcaacuauccuguggcaaaagggaguuacaauaacacauccggagagcagaugcuuaucauuugggguguccaccacccaaaugacgagaccgaacagaggacguuguaucaaaacgugggcacuuacguaucuguugggaccagcacacugaauaagcgguccacucccgauaucgccacccgcccuaaggugaacggacagggcgguagaauggaguuuucauggacacuacucgacaugugggauaccauaaacuucgaaaguacggggaaucugauugcuccagaguacggauuuaaaaucagcaagagggggucuuccggcauuaugaaaacugaaggcacacuugagaacugcgagaccaagugucagacuccgcugggagcaaucaauacaaccuugcccuuccauaacguccacccucucacgaucggugaaugcccaaaauaugugaagucagagaaacugguguuagccaccggccugcggaaugucccccagauugaaagccgcgggcucuuuggagcuauagccggcuucaucgaggguggguggcaaggcaugguugacggaugguacggcuaucaucacaguaacgaucaggggucuggauacgcggcagacaaggaauccacacagaaggccuuugacgguauuacuaauaaagugaacagcguaaucgagaagaugaauacccaguucgaggcugugggcaaagaauuuucgaaccuugagcgaagacuggaaaauuugaacaagaaaauggaggauggguuccuagacgucuggacauauaaugccgaacugcucgugcugauggagaacgagaggacucuugauuuccacgacucuaauguuaagaaccuguacgauaaggugcggaugcaauugcgugacaacgucaaagaacucggaaauggcuguuuugaguucuaucauaagugcgaugacgaauguaugaacuccgugaaaaaugguaccuacgauuacccuaaguaugaggaggaaucaaaacugaaccgcaaugagauaaaggggguaaaguuaaguagcaugggcguuuaccagauucuggcaaucuaugcuacaguggccggaucccuaucucucgcgaucaugauggccggcauuagcuuuuggaugugcucaaacgggagucugcagugcagaaucuguauuuga

SEQ ID NO: 124314 - RNA, 1689 nt, Artificial Sequence
  derived and/or modified sequence opt3 from hemagglutinin__InfluenzaA__ACD85220
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaaccccaaguauucacucugcuacccuggcaguuuuaaugauuaugaagaacugaagcaucugcucagcuccgugaaacacuucgaaaaggucaaaauuuuaccaaaggaccgauggacucaacauaccacaaccggugggucuaaggcuugugccgugucgggagagcccucauuuuuccguaacaugguuuggcugacuaagaagggcccuaauuacccaguggcaaaaggcagcuauaacaauacaaguggggagcagaugcuuaucauuuggggaguccaccaccccaaggaugaagccgagcagagagcuuuguaccagaacguggguaccuacguauccgcaucuacgagcacucugaauaaaagguccaccccugaaaucgccgcucggccagagguuaacggccuagggucacgcauggaauuuaguuggacacuccuggacgugugggauacuauaaauuucgagagcaccggaaaccuugucgccccggaguauggcuuuaagauuucuaaaagagguuccucagggaucaugaagacagaaggaacccugggcaacugcgagacgaaaugucaaacucccuugggcgcgauuaauacaacccucccuuuccauaacgugcacccacugacuaucggggaaugccccaaguacgugaaaagcgagaaauuaguccuggcaacaggacucaggaauguuccucagaucgaaagucggggucuuuuuggcgccauugcuggguucauagagggaggcuggcaggguaugguggacgggugguauggcuaccaucacucuaacgaucagggauccggcuaugccgcagacaaggagagcacccaaaaggcuuuugaugggaucacgaauaaaguaaacucggugauugagaaaaugaauacccaguucgaggccgucggaaaggaauuuaacaaucuggagaagcgcuuggaaaaccuaaauaaaaagauggaggacgguuuccuggacguguggacauacaacgcggagcuccugguucuuauggaaaaugagcgaacucuggauuuccacgacucuaacgugaaaaauuuguaugauaaggucagaaugcagcucagggacaacgugaaagaacugggcaacggguguuuugaguucuaccauaagugcgaugacgaguguaugaacuccguaaagaauggaaccuacgauuauccaaaauacgaaaaggagucaaaauuaaaucggaacgaaaucaagggcguuaaacugaguagcauggguguguaucagauacuagccauuuacgcaacagucgcugggucccucucucuggccaucaugauggcuggcaucagcuuuuggaugugcucaaauggaagucuucaaugccguauuuguaucuga

SEQ ID NO: 124315 - RNA, 1689 nt, Artificial Sequence
  derived and/or modified sequence opt3 from hemagglutinin__InfluenzaA__ACD85242
auggccaucauuuaccugauacuccuuuucgcuaccgugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcagucugaaugauuaugaagaacugaagcaucucuuaagcuccgugaagcacuuugaaaaaguccguauucugccaaaggacagauggacucaacauaccacaaccggugggucuaaggcuugugccgugucgggaaagcccucauucuuuaggaacaugguuuggcuuacuaaaaagggcccuaauuacccaguggcaaagggcagcuauaacaauacaaguggggagcagauguugaucauuuggggaguccaccaccccaaagaugaggccgaacagcgggcucuguaccaggagguggguaccuacguauccgcaucuacgagcacucuaaacaagcgcuccaucccugaaauagccgcuagaccagagguuaauggccucgggucaaggauggaguucaguuggacccugcuugacgugugggauacaauuaacuuugagagcacuggaaaucuggucgccccggaguauggcuucaaaaucucuaagcgggguuccucagggauuaugaaaaccgaaggaacauugggcaacugcgagaccaagugucaaacgccccucggcgcgaucaacacuacacugccuuuucauaaugugcacccauuaaccaucggggaaugccccaaauacgugaaaagcgagaagcugguccucgcaacuggacuucgcaacguuccucagauugaaagucgaggucuguucggcgccauagcuggguuuaucgagggaggcuggcaggguaugguggacgggugguauggcuaccaucacucuaaugaucagggauccggcuaugccgcagacaaagagagcacacaaaaggcuuucgaugggauuaccaacaaaguaaauucgaugaucgaaaagaugaacacgcaguuugaggccgugggaaaagaguucaauaacuuggaaaagagacuagaaaaucuggacaagaaaauggaggacgguuuucucgaugucuggaccuacaacgcggagcugcuugugcugauggaaaaugagaggacauuggacuuccacgauucuaacguuaagaaucucuaugaaaaagugcggaugcagcugcgugacaacgucaaggaguuaggcaauggguguuucgaguuuuaccauaaaugcgauaacgaauguaugaacuccgugaagaauggaacuuacgacuauccaaaguacgaggaagagucaaaacugaagcgcaacgaaauaaaaggcguaaagcuaaguagcauggguguuuaucagauucucgccaucuacgcaaccguggcugggucccugucucuugccaucauggucgcuggcauuagcuucuggaugugcucaaauggaaguuugcaaugcagaaucuguauuuga

SEQ ID NO: 124316 - RNA, 1689 nt, Artificial Sequence
  derived and/or modified sequence opt3 from hemagglutinin__InfluenzaA__ACD85253
auggccaucauuuaccugauacuccuuuucgcuaccgugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauaaucucugcuacccuggcucacugaacgaauaugaggaacugaagcaucucuuaaguagcgugaagcacuuugagaaaguccguauucugccaaaggauagauggacucaacauaccacaaccgguggguccaaagccugugcugugucuggagagcccucguucuuuaggaauaugguuuggcuuacuaagaaaggcccuaacuacccaguggcaaagggcucauauaauaacacaagcggggaacagauguugaucauuuggggaguccaccaccccaaugacgaggccgaacagcgggcucuguaccagaagguggguaccuacguaagugcauccacgucuacucuaaacaaacgcagcaucccugagauagccgcuagaccaaagguuaauggccucggguccaggauggaguucuuuuggacccugcuugaugugugggacacaauuaacuucgaaucaacuggaaaccuggucgugccggaguauggcuuuaaaaucaguaagcgggguagcucugggauuaugaaaaccgaaggaacauugggcaauugcgagaccaagugucaaacgccccucggcgccaucaacacuacacugccuuuccauaaugugcacccauuaaccaucggggaaugccccaaauacgucaaguccgagaagcugguucucgcgacuggacuucgcaacgugccucagauugaaucacgaggucuguuuggcgcaauagccggguucaucgagggaggcuggcaggguaugguagaugggugguauggcuaccaucacagcaaugaccagggaaguggcuaugcugccgauaaagagucuacacaaaaggcauuugacgggauuaccaacaaagugaauagcgucaucgaaaagaugaacacgcaguucgagaccgugggaaaagaauuuaauaacuuggagaagagacuagaaaaucugaacaagaaaauggaggaugguuuccucgacguuuggacauacaaugcugagcugcuugugcugauggaaaacgagaggacuuuggacuuccacgauagcaaugucaagaaccucuaugaaaaagugcggaugcagcugcgugacaacguaaaggaguuaggcaauggguguuuugaguucuaccauaaaugcgaugacgaauguaugaacucgguuaagaauggaaccuacgauuauccaaaguacgaggaagagucuaaacugaagcgcaacgaaauaaaaggcgugaagcuauccucaaugggugucuaucagauucucgccaucuacgcgacaguggccgggagucugagccuugcaaucauggucgcuggcauuuccuuuuggaugugcucuaauggauccuugcaaugcagaaucuguauuuga

SEQ ID NO: 124317 - RNA, 1701 nt, Artificial Sequence
  derived and/or modified sequence opt3 from hemagglutinin__InfluenzaA__ACD85440
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacagcgaaaugaauaaauuguucgagaagaccaaaaagcagcuaagggaaaacgcugaggaucugggcaauggaugcuuuaagaucuaccacaaaugugacaacgccugcauuggcucaauccggaaugggacauaugaucaugacguguaccgagacgaggcucucaacaaucgcuuccagauuaagggagucgaacugaaaagugguuacaaggauuggauccuuuggauauccuuugccaucagcugcuuccuguuguguguggcacuccugggcuuuauuaugugggccugccagaaagggaacaucagauguaauauuugcaucuga

SEQ ID NO: 124318 - RNA, 1701 nt, Artificial Sequence; identical to SEQ ID NO: 124317
  derived and/or modified sequence opt3 from hemagglutinin__InfluenzaA__ACD85451

SEQ ID NO: 124319 - RNA, 1701 nt, Artificial Sequence; identical to SEQ ID NO: 124317
  derived and/or modified sequence opt3 from hemagglutinin__InfluenzaA__ACD85462

SEQ ID NO: 124320 - RNA, 1701 nt, Artificial Sequence; identical to SEQ ID NO: 123944
  derived and/or modified sequence opt3 from hemagglutinin__InfluenzaA__ACD85473

SEQ ID NO: 124321 - RNA, 1701 nt, Artificial Sequence
  derived and/or modified sequence opt3 from hemagglutinin__InfluenzaA__ACD85484
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgaggaguucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacagaauacccugaagcuggccacugggaugaggaacgugccagaaaaacaaacacggggaaucuucggcgcuauugccggcuuuaucgagaaugggugggagggaauggucgaugguugguauggcuuccgucaccagaacagugaagggauuggacaggcagcugaccuuaagagcacccaagccgcgauagaucagaucaauggcaaauugaaccgccucauugguaagacgaacgagaaauuccaccagaucgaaaaggaguuuuccgaaguugaggggagaauccaggaccuggagaaguacguggaagauaccaaaauugacuuauggucuuauaaugccgagcugcucguagcacuugaaaaccaacauacaauagaucugacugacagcgagaugaauaaguuguucgagaaaaccaagaaacagcuaagggaaaacgcugaggauaugggcaauggaugcuuuaagaucuaccacaagugugacaacgccugcauuggcucaauccggaaugggacauaugaucaugacguguaccgagacgaagcucugaacaaucgcuuccagauuaaaggagucgagcucaagagugguuacaaagauuggauccuguggauauccuuugccaucagcugcuuccuucuguguguggcauugcucggcuuuauuaugugggccugccagaaggggaacaucagauguaauauuugcaucuga

SEQ ID NO: 124322 - RNA, 1701 nt, Artificial Sequence; identical to SEQ ID NO: 123944
  derived and/or modified sequence opt3 from hemagglutinin__InfluenzaA__ACD85495

SEQ ID NO: 124323 - RNA, 1701 nt, Artificial Sequence
  derived and/or modified sequence opt3 from hemagglutinin__InfluenzaA__ACD85528
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgugucguugaggucacucguugcaagcaguggcacucuggaauuuaacaaugaguccuucaacuggacaggugugacccagaaugggacgucuagcgccugcauccggcgcuccaacaagucauuuuucagucgacugaauuggcucacucauuuaaaguuuaaauauccagcucugaacgucaccaugcccaauaacgagaacuucgacaaacuuuacauuuggggagugcaccauccuggcacagauaaugaccagaucuuuuuguaugcacaggccagcggccguauuacuguaucuaccaagagaucccaacagacaguuaucccaaacauagggucaaggccccgggugcgcaauauuccuagcagaaucaguauuuacuggaccaucgucaagccaggagauauccugcuaauuaacucuacggguaaucucauagcuccgaggggcuacuucaaaauccgguccggaaagagcucgauuaugcgcucugacgcccccaucgggaaguguaacuccgaaugcauaacuccuaauggcucaauuccaaacgacaaacccuuucagaaugugaaccgaaucacauauggugcguguccuagauacgugaagcagaauacccugaaacuugcaacugggaugaggaacgucccagagaagcaaacacggggaaucuucggcgccauugcuggcuuuaucgaaaaugggugggagggaaugguugaugguugguauggcuuccgucaccagaacagugaggggauuggacaggccgcagaccugaaaagcacccaagcugccauagaucagaucaauggcaaguugaaccgccucauugguaaaacgaacgaaaaguuccaccagaucgagaaggaauuuuccgagguggaagggagaauccaggaccuggagaaauacguagaggauaccaagauugacuuauggucuuauaaugcggaacugcucguggcccuugagaaccaacauacaauagaucugacugacagcgaaaugaauaaauuguucgagaagaccaaaaagcagcuaagggaaaacgcagaggaucugggcaauggaugcuuuaagaucuaccacaaaugugacaacgcuugcauuggcucaauccggaaugggacauaugaucaugacgucuaccgagacgaggcccucaacaaucgcuuccagauuaagggaguggaacugaaaagugguuacaaggauuggauccuuuggauauccuuugcuaucagcugcuuccuguuguguguugcccuccugggcuuuauuaugugggcaugccagaaagggaacaucagauguaauauuugcaucuga

SEQ ID NO: 124324 - RNA, 1701 nt, Artificial Sequence
  derived and/or modified sequence opt3 from hemagglutinin__InfluenzaA__ACD85539
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcacuaacaauuccuuuuucucacgacugaacuggcucacccauuuaaaguuuaaguauccagcacugaaugugacaaugcccaacaacgagaaauucgacaaacuuuacauuuggggaguccaccauccuggcacugauaaugaccagaucuuuuuguaugcccaggcuaguggccguauuaccgugagcacaaaaagaucucaacagaccguaaucccaaacauaggguccaggccccggguucgcaauauuccuucaagaaucagcauuuacuggacgaucgugaagccaggagauauccugcuaauuaacaguacugguaaucucauagccccgaggggcuacuucaaaauccggucugggaaguccagcauuaugcgcucggacgcgcccaucggaaaguguaacucugaaugcauaacaccuaauggcuccauuccaaacgacaaacccuuucagaaugucaaccgaaucaccuauggugcauguccuagauacgugaagcagaauacucugaaacuugccacagggaugaggaacgugccagagaagcaaacccggggaaucuucggcgcuauugccggcuuuaucgaaaaugggugggagggaauggucgaugguugguauggcuuccgucaccagaacucagaggggauuggacaggcagcugaccugaaaaguacgcaagccgcgauagaucagaucaauggcaaguugaaccgccucauugguaaaaccaacgaaaaguuccaccagaucgagaaggaauuuagcgagguugaagggagaauccaggaccuggagaaauacguggaggauacaaagauugacuuaugguccuauaaugccgaacugcucguagcacuugagaaccaacauacuauagaucugaccgacucugaaaugaauaaauuguucgagaagacaaagaagcagcuaagggaaaacgcugaggauaugggcaauggaugcuuuaagaucuaccacaaaugugacaacgccugcauuggcagcauccggaaugggacuuaugaucaugacguguaccgagacgaggcucugaacaaucgcuuccagauuaagggagucgaacucaaaucagguuacaaggauuggauccuguggauaaguuuugccaucuccugcuuccuucuguguguggcauugcucggcuuuauuaugugggccugccagaaagggaacaucagauguaauauuugcaucuga

SEQ ID NO: 124325 - RNA, 1701 nt, Artificial Sequence
  derived and/or modified sequence opt3 from hemagglutinin__InfluenzaA__ACD85550
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacagcgaaaugaauaaauuguucgagaagaccaaaaagcagcuaagggaaaacgcugaggaucugggcaauggaugcuuuaagaucuaccacaaaugugacaacgccugcauuggcucaauccggaaugggacauaugaucaugacguguaccgagacgaggcucucaacaaucgcuuccagauuaagggagucgaacugaaaagugguuacaaggauuggauccuuuggauauccuuugccaugagcugcuuccuguuguguguggcacuccugggcuuuaucaugugggccugccagaaagggaacauuagauguaauaucugcauuuga

SEQ ID NO: 124326 - RNA, 1701 nt, Artificial Sequence; identical to SEQ ID NO: 123944
  derived and/or modified sequence opt3 from hemagglutinin__InfluenzaA__ACD85561

SEQ ID NO: 124327 - RNA, 1701 nt, Artificial Sequence
  derived and/or modified sequence opt3 from hemagglutinin__InfluenzaA__ACD85572
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaaaagaucccaacagacaguaaucccaaacaccgggucaaggccccggguucgcaauauaccuagcagaauuaguaucuacuggacgauugugaagccaggagauauccugcuaaucaacucuacugguaaucucauugccccgaggggcuacuucaaaauacgguccggaaagagcucgaucaugcgcucugacgcgcccauugggaaguguaacuccgaaugcaucacaccuaauggcucaauaccaaacgacaaacccuuucagaaugucaaccgaauuaccuauggugcauguccuagauacgugaagcagaauacucugaaacuugccacagggaugaggaacgugccagagaagcaaacccggggaaucuucggcgcuaucgccggcuuuauugaaaaugggugggagggaauggucgaugguugguauggcuuccgucaccagaacagugaggggaucggacaggcagcugaccugaaaagcacgcaagccgcgauugaucagauaaauggcaaguugaaccgccucaucgguaaaaccaacgaaaaguuccaccagauugagaaggaauuuuccgagguugaagggagaauccaggaccuggagaaauacguggaggauacaaagaucgacuuauggucuuauaaugccgaacugcucguagcacuugagaaccaacauacuauugaucugaccgacagcgaaaugaauaaauuguucgagaagacaaagaagcagcuaagggaaaacgcugaggauaugggcaauggaugcuuuaagauauaccacaaaugugacaacgccugcaucggcucaauucggaaugggacuuaugaucaugacguguaccgagacgaggcucugaacaaucgcuuccagaucaagggagucgaacucaaaagugguuacaaggauuggauucuguggaucuccuuugccauaagcugcuuccuucuguguguggcauugcucggcuuuaucaugugggccugccagaaagggaacauuagauguaauaucugcauuuga

SEQ ID NO: 124328 - RNA, 1701 nt, Artificial Sequence; identical to SEQ ID NO: 124324
  derived and/or modified sequence opt3 from hemagglutinin__InfluenzaA__ACD85583

SEQ ID NO: 124329 - RNA, 1701 nt, Artificial Sequence
  derived and/or modified sequence opt3 from hemagglutinin__InfluenzaA__ACD93579
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacagcgaaaugaauaaauuguucgagaagaccaaaaagcagcuaagggaaaacgcugaggauaugggcaauggaugcuuuaagaucuaccacaaaugugacaacacaugcauuggcucaauccggaaugggacuuaugaucaugacguguaccgagacgaggcccugaacaaucgcuuccagauuaagggagucgaacucaaaagugguuacaaggauuggauccuguggauauccuuugcuaucagcugcuuccuucuguguguggccuugcucggcuuuauuaugugggcaugccagaaagggaacaucagauguaauauuugcaucuga

SEQ ID NO: 124330 - RNA, 1701 nt, Artificial Sequence; identical to SEQ ID NO: 122646
  derived and/or modified sequence opt3 from hemagglutinin__InfluenzaA__ACF09402

SEQ ID NO: 124331 - RNA, 1701 nt, Artificial Sequence
  derived and/or modified sequence opt3 from hemagglutinin__InfluenzaA__ACF22159
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacagguggcauuugcgacaguccacaccagauccuagauggggagaacuguacccucauagacgcucugcuuggagauccgcagugcgacggcuuucagaauaaaaagugggaucuguucguggaaagaagcaaagccuauuccaacuguuaccccuaugacgucccugauuacgcaucuuugaggucgcucguggccucaagcgguacucuggaguuuaauaacgaaaguuucaauuggacagggguuacccagaacggaacguccucugcuugcaagcggcgcagcaauaaguccuuuuucucacgacugaacuggcucacucauuuaaaauauaaguacccagcacugaaugugaccaugcccaacaacgagaaauuugacaaacuuuauaucuggggcguccaccauccuggcacagauagugaccagauuagcuuguacgcccaggcuucugggcguaucacuguguccaccaagagaucacaacagacaguaauuccaaauaucggauucaggccccggguucgcgaugugagcaguagaauaucuauuuacuggaccaucgucaagccuggugacauucugcuaaucaacuccacgggcaaucucaucgccccaaggggguauuuuaagauucggagcggaaaaucgucuauaaugcgcuccgacgcgccgaucggcaaguguaacucagagugcauuacucccaaugguaguaucccuaacgauaaaccauuccagaaugugaaccgaauaacauacggggcaugucccagauaugugaagcagaauacccugaaacuugccacuggaaugaggaacgucccugaaaagcaaacacggggcauuuuuggcgcuaucgccggguucaucgagaauggaugggaagguaugguugacggcugguacggguuucgucaccagaacagcgagggaaccggccaggcagcugaucugaaauccacgcaagccgcgauuaaucagaucaacgguaaguugaaucgccucauugggaagaccaacgagaaauuccaccagauagaaaaggaguucucugaaguggagggcagaauccaggaccuggaaaaauauguagaggauacaaagauugacuuauggagcuacaacgccgagcugcucguggcacuugaaaaucaacauacuaucgaucugaccgacucagagaugaacaaauuguuugaaaggacaaagaagcagcuacgggagaaugcugaagauaugggaaacggcugcuucaaaaucuaucacaagugugacaaugccugcauugagaguauacgaaacgggacuuacgaucaugacgucuaccgcgacgaggcucugaauaacagauuucagaucaaaggaguggaacucaaguccgguuauaaagauuggauucuguggaucagcuucgccauuucuugcuuucuucuguguguugcauugcucggcuucaucaugugggccugccagaaggggaauauaagguguaacaucugcauuuga

SEQ ID NO: 124332 - RNA, 1701 nt, Artificial Sequence
  derived and/or modified sequence opt3 from hemagglutinin__InfluenzaA__ACF22188
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucuggucacggccuuggguccgcggacugagcaguagaauaucuauuuauuggaccaucgugaagccaggcgacgugcuagucauuaacuccaaugguaaccucaucgccccgaggggguacuuuaaaaugcggacuggaaagagcucgaucaugcgcucugacgcucccauugauacauguauauccgagugcaucaccccuaauggcucaauuccaaacgacaaacccuuccagaauguuaacaagaucacguacggcgccuguccuaaauaugugaagcagaauacccugaaacuugcgacagggaugcgaaacguaccagaaaagcagacuagaggacuguuuggugcaauagccggcuucauugagaaugggugggaaggaaugaucgauggcugguacgguuuuaggcaccaaaacagugaggggaccggccaggcugccgaccuuaagagcacacaggcagcuaucgaucaaauuaauggaaaacucaaccgggugaucgagaagacuaaugaaaaauuccaccagauugagaaggaguucuccgaagucgaaggccguauacaggaccuggagaaauauguggaggauaccaagaucgacuuauggucuuacaacgccgaacugcucguugcgcuugagaaucagcauacaauugaucugaccgacagcgaaaugaacaaguuguuugagaaaacucgcagacaacuaagggaaaacgccgaggauauggggaauggaugcuucaagaucuaucacaaaugugacaacgcaugcaucgagucaauucggaaugguaacuacgaccaugauguguaucgagacgaagcucugaauaaccgcuuucagauaaagggcgucgagcucaaaaguggguacaaggauuggauccuguggauuuccuucgccaucagcugcuuucuucugugugugguauugcucggauucauuaugugggcuugccagagaggcaauaucagguguaacauaugcaucuga

SEQ ID NO: 124333 - RNA, 1701 nt, Artificial Sequence; identical to SEQ ID NO: 124332
  derived and/or modified sequence opt3 from hemagglutinin__InfluenzaA__ACF22199

SEQ ID NO: 124334 - RNA, 1701 nt, Artificial Sequence
  derived and/or modified sequence opt3 from hemagglutinin__InfluenzaA__ACF22210
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaacuccaaugggaaccucaucgccccgaggggauacuuuaaaaugcggacuggcaagagcucgaucaugcgcucugacgcucccauugauacauguauauccgagugcaucaccccuaauggcucaauuccaaacgacaaacccuuccagaauguuaacaagaucacguacggggccuguccuaaauaugugaagcagaauacccugaaacuugcgacaggaaugcgaaacguaccagaaaagcagacuagaggucuguuuggcgcaauagccggguucauugagaauggaugggaaggcaugaucgaugguugguacggguuuaggcaccaaaacagugagggcaccggacaggcugccgaccuuaagagcacacaggcagcuaucgaucaaauuaauggcaaacucaaccgggugaucgagaagacuaaugaaaaauuccaccagauugagaaggaguucuccgaagucgaagggcguauacaggaccuggagaaauauguggaggauaccaagaucgacuuauggucuuacaacgccgaacugcucguugcgcuugagaaucagcauacaauugaucugaccgacagcgaaaugaacaaguuguuugagaaaacucgcagacaacuaagggaaaacgccgaggauaugggaaaugguugcuucaagaucuaucacaaaugugacaacgcaugcaucgagucaauucggaauggcacguacgaccaugauguguaucgagacgaagcucugaacaaucgcuuucagauaaagggggucgagcucaaaaguggauacaaggauuggauccuguggauuuccuucgccaucagcugcuuucuucugugugugguauugcucggcuucauuaugugggcuugccagagagguaacaucagguguaauauaugcaucuga

SEQ ID NO: 124335 - RNA, 1701 nt, Artificial Sequence; identical to SEQ ID NO: 124334
  derived and/or modified sequence opt3 from hemagglutinin__InfluenzaA__ACF22221

SEQ ID NO: 124336 - RNA, 1701 nt, Artificial Sequence; identical to SEQ ID NO: 124334
  derived and/or modified sequence opt3 from hemagglutinin__InfluenzaA__ACF22232

SEQ ID NO: 124337 - RNA, 1701 nt, Artificial Sequence; identical to SEQ ID NO: 124334
  derived and/or modified sequence opt3 from hemagglutinin__InfluenzaA__ACF22243

SEQ ID NO: 124338 - RNA, 1701 nt, Artificial Sequence; identical to SEQ ID NO: 124334
  derived and/or modified sequence opt3 from hemagglutinin__InfluenzaA__ACF22254

SEQ ID NO: 124339 - RNA, 1701 nt, Artificial Sequence; identical to SEQ ID NO: 124334
  derived and/or modified sequence opt3 from hemagglutinin__InfluenzaA__ACF22265

SEQ ID NO: 124340 - RNA, 1701 nt, Artificial Sequence; identical to SEQ ID NO: 124334
  derived and/or modified sequence opt3 from hemagglutinin__InfluenzaA__ACF22276

SEQ ID NO: 124341 - RNA, 1701 nt, Artificial Sequence; identical to SEQ ID NO: 124334
  derived and/or modified sequence opt3 from hemagglutinin__InfluenzaA__ACF22287

SEQ ID NO: 124342 - RNA, 1701 nt, Artificial Sequence; identical to SEQ ID NO: 124334
  derived and/or modified sequence opt3 from hemagglutinin__InfluenzaA__ACF22298

SEQ ID NO: 124343 - RNA, 1701 nt, Artificial Sequence; identical to SEQ ID NO: 124334
  derived and/or modified sequence opt3 from hemagglutinin__InfluenzaA__ACF22320

SEQ ID NO: 124344 - RNA, 1701 nt, Artificial Sequence; identical to SEQ ID NO: 124334
  derived and/or modified sequence opt3 from hemagglutinin__InfluenzaA__ACF22342

SEQ ID NO: 124345 - RNA, 1701 nt, Artificial Sequence
  derived and/or modified sequence opt3 from hemagglutinin__InfluenzaA__ACF22364
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucgagucacggccuuggguccgcggacugagcaguagaauaucuauuuauuggaccaucgugaagccaggcgacgugcuagucauuaacuccaaugguaaccucaucgccccgaggggguacuuuaaaaugcggacuggaaagagcucgaucaugcgcucugacgcucccauugauacauguauauccgaaugcaucaccccuaauggcucaauuccaaacgacaaacccuuccagaauguuaacaagaucacguacggcgccuguccuaaauaugugaagcagaauacccugaaacuugcgacagggaugcgaaacguaccagagaaacagacuagaggacuguuuggugcaauagccggcuucauugaaaaugggugggagggaaugaucgauggcugguacgguuuuaggcaccaaaacagugaggggaccggccaggcugccgaccuuaagagcacacaggcagcuaucgaucaaauuaauggaaaacucaaccgggugaucgaaaagacuaaugagaaauuccaccagauugaaaaggaguucuccgaagucgagggccguauacaggaccuggagaaauauguggaagauaccaagaucgacuuauggucuuacaacgccgagcugcucguugcgcuugaaaaucagcauacaauugaucugaccgacagcgagaugaacaaguuguuugaaaagacucgcagacaacuaagggagaacgccgaggauauggggaauggaugcuucaagaucuaucacaaaugugacaacgcaugcaucgaaucaauucggaaugguacguacgaccaugauguguaucgagacgaggcucugaacaaucgcuuucagauaaagggcgucgaacucaaaaguggguacaaggauuggauccuguggauuuccuucgccaucagcugcuuucuucugugugugguauugcucggauucauuaugugggcuugccagagaggcaacaucagguguaauauaugcaucuga

SEQ ID NO: 124346 - RNA, 1701 nt, Artificial Sequence; identical to SEQ ID NO: 124324
  derived and/or modified sequence opt3 from hemagglutinin__InfluenzaA__ACF22408

SEQ ID NO: 124347 - RNA, 1701 nt, Artificial Sequence; identical to SEQ ID NO: 123944
  derived and/or modified sequence opt3 from hemagglutinin__InfluenzaA__ACF41669

SEQ ID NO: 124348 - RNA, 1698 nt, Artificial Sequence; identical to SEQ ID NO: 123930
  derived and/or modified sequence opt3 from hemagglutinin__InfluenzaA__ACF41680

SEQ ID NO: 124349 - RNA, 1689 nt, Artificial Sequence
  derived and/or modified sequence opt3 from hemagglutinin__InfluenzaA__ACF41691
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcaguuuuaaugauuaugaagaacugaagcaucugcucagcuccgugaagcacuucgaaaaagucaagauuuuaccaaaagacgguuggacucaacaugagaccgaugggggaucuaaggcuugugccgugucgggcaaacccucauuuuuccguaacaugguuuggcugacaaagaagggcccuaauuacccaguggcaaaaagaagcuauaacaauaccaguggggagcagaugcuuaucauuuggggaguccaccaccccaacgacgaagccgagcagagggcuuuguaccaggaaguggguacuuacguauccgcaucuacaagcacccugaauaagcgguccacgccugagaucgccgcucgcccaaaaguuucaggccuagggaguagaauggaauuuagcuggacucuccuggaugugugggacaccauaucuuucgaguccacaggaaaccuugucgccccggaguauggcuuuaagauuucaaaaagggguagcagugggaucaugaagacugaaggaacccugggcaauugcgagacaaaaugucaaacccccuugggcgcgauuaacacgacucucccuuuccauaacgugcacccacugacaaucggggaaugccccaaguacgugaagucugagaaauuaguccuggcaaccggacuccggaauguuccucagaucgaaucccgcggucuuuuuggcgccauugcuggguucauagagggaggcuggcaggguaugguggaugggugguauggcuaccaucacagcaacgaccagggaucgggcuaugccgcagauaaggagucuacucaaaaggcuuuugaccgaaucacaaauaaaguaaacuccgugauugagaaaaugaauacccaguucgaggccgucgggaaggaauuuucaaaccuggagaagagauuggaaaaucuaaacaaaaagauggaggacggauuccuggauguguggacguacaaugcggagcuccugguucuuauggaaaacgagaggacccuggacuuccacgauaguaaugugaaaaacuuguaugacaagguccggaugcagcuccgugauaaugugaaagaacuggguaacggcuguuuugaguucuaccauaagugcgacgaugaguguaugaauagcguaaagaacgggacauacgacuauccaaaauacgaagaggaauccaaguuaaaacgcaacgagaucaagggaguugaacugucuagcaugggcguguaucagauacuagccauuuacgcaacugucgcugguucacucagucuggccaucaugaucgcugggauuuccuuuuggaugugcagcaauggcucucuucaaugcagaaucuguauuuga

SEQ ID NO: 124350 - RNA, 1701 nt, Artificial Sequence; identical to SEQ ID NO: 124332
  derived and/or modified sequence opt3 from hemagglutinin__InfluenzaA__ACF41735

SEQ ID NO: 124351 - RNA, 1701 nt, Artificial Sequence
  derived and/or modified sequence opt3 from hemagglutinin__InfluenzaA__ACF41790
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagacuuuacguggacugguguuacccagaacgggggaaguaaugcuugcaagcgcggcccaggcuccggguucuuuucucgacucaacugguuaacaaaaagcggauccacuuaccccgugcuggaugucaccaugccuaauaacgacaauuucgacaaguuguauauuuggggugugcaccauccaucaacaaaccaagagcagaccaguuuguacguacaggcaagcggccguguuacggugucuacuagaaggucccagcaaacaaucauucccaauaucgggucacggccuuggguccgcggacugagcaguagaauaucuauuuauuggaccaucgugaagccaggcgaugugcuagucauuaacuccaacgguaaucucaucgccccgaggggguacuuuaaaaugcggacuggaaagagcucgaucaugcgcucugacgcucccauugauacauguauauccgagugcaucaccccuaacggcucaauuccaaaugacaaacccuuccagaacguuaauaagaucacguacggcgccuguccuaaauaugugaagcagaacacccugaaacuugcgacagggaugcgaaauguaccagaaaagcagacuagaggacuguuuggugcaauagccggcuucauugagaacgggugggaaggaaugaucgauggcugguacgguuuuaggcaccaaaauagugaggggaccggccaggcugccgaccuuaagagcacacaggcagcuaucgaucaaauuaacggaaaacucaaucgggugaucgagaagacuaacgaaaaauuccaccagauugagaaggaguucuccgaagucgaaggccguauacaggaccuggagaaauauguggaggauaccaagaucgacuuauggucuuacaaugccgaacugcucguugcgcuugagaaccagcauacaauugaucugaccgacagcgaaaugaauaaguuguuugagaaaacucgcagacaacuaagggaaaacgccgaggacauggggaacggaugcuucaagaucuaucacaaaugugauaaugcaugcaucgagucaauucggaacgguacguacgaccaugauguguaucgagacgaagcucugaauaaccgcuuucagauaaagggcgucgagcucaaaaguggguacaaggauuggauccuguggauuuccuucgccaucagcugcuuucuucugugugugguauugcucggauucauuaugugggcuugccagagaggcaauaucagguguaacauaugcaucuga

SEQ ID NO: 124352 - RNA, 1701 nt, Artificial Sequence
  derived and/or modified sequence opt3 from hemagglutinin__InfluenzaA__ACF41823
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccggcagacaaucauucccaacaucggaucacgcccuugggucagaggccugagcaguaggauaucuauuuauuggaccaucgugaagccaggugacgugcuagucauuaacuccaaugggaaccucaucgccccgcggggauacuuuaaaaugcgcacuggcaagagcucgaucaugcgaucugacgcucccauugauacauguauauccgagugcaucaccccuaauggcucaauuccaaacgacaaacccuuccaaaauguuaacaagaucacguacggggccuguccuaaauaugugaagcagaauacccugaaacuugcgacaggaaugagaaacguaccagaaaagcagacuaggggucuguuuggcgcaauagccggguucauugagaauggaugggaaggcaugaucgaugguugguacggguuucggcaccagaacagugagggcaccggacaagcugccgaccuuaagagcacacaggcagcuaucgaucagauuaauggcaaacucaaccgugugaucgagaagacuaaugaaaaauuccaccaaauugagaaggaguucuccgaagucgaagggcgcauacaggaccuggagaaauauguggaggauaccaagaucgacuuauggucuuacaacgccgaacugcucguugcgcuugagaaucagcauacaauugaucugaccgacagcgaaaugaacaaguuguuugagaaaacuagaaggcagcuacgggaaaacgccgaggauaugggaaaugguugcuucaagaucuaucacaaaugugacaacgcaugcaucgagucaauucgaaauggcacguacgaccauaacguguaucgcgaugaagcucugaauaacagauuucaaauaaagggggucgagcucaaaaguggauacaaggacuggauccuguggauuuccuucgccaucagcugcuuucuucugugugugguauugcucggcuucauuaugugggcuugccagagggguaauauccgguguaacauaugcaucuga

SEQ ID NO: 124353 - RNA, 1698 nt, Artificial Sequence
  derived and/or modified sequence opt3 from hemagglutinin__InfluenzaA__ACF41834
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaggaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaccugaaaaauucauacgucaacaagaaaggcaaggaggugcuaguacucuggggcauacaucacccaaguaacagcaaagaacagcagaaucuguaucagaacgagaaugccuacguuucuguggucacuuccaacuacaaucguagauuuacacccgaaaucgcugagaggccuaaggugcgggaccaagccgggcgcaugaacuauuacuggacccuucugaagccaggagauacgauuaucuucgaggcgaaugguaacuugauugcaccgauguaugccuuugcucucucaagaggcuucgggagcggaaucauaaccaguaaugccucuaugcacgaauguaacacuaaaugccagacaccccugggcgcaauuaauuccagcuuaccuuaccagaacauccauccagugacuauuggugagugucccaaguaugucaggucggcuaaacugcggaugguuaccgggcuccgcaauaucccuucuauccagucccgaggacuuuuuggcgccauugcgggcuucauagaagggggauggacagguaugaucgacggcugguacggguaucaccaucaaaacgagcagggaucaggcuacgccgcagaucagaagaguacccagaaugcuauuaacgguaucacgaacaaagugaauacuguaauagaaaagaugaacauucaauuuacagccguggggaaagaguucaauaagcuggagaagagaauggaaaacuugaauaaaaaggucgacgauggcuuucuagacaucuggaccuacaacgcugagcugcucgugcugcuugaaaaugagaggacucuggacuuccacgauagcaacguuaaaaauuuguaugaaaaggugaaaucccagcucaagaacaaugccaaggagaucggaaacggcugcuucgaguuuuaccacaaaugugacaaugaaugcauggagucuguccggaacgggacauaugauuacccaaaguauagcgaagagucaaaacugaaucgugagaagguggacggaguaaaauuagaaaguauggguauuuaccagauccuggcaauuuauuccaccguugccagcucucuagugcuccuggucucacuuggcgcuauaaguuucuggaugugcagcaacggguccuugcaaugucgcaucugcauuuga

SEQ ID NO: 124354 - RNA, 1701 nt, Artificial Sequence
  derived and/or modified sequence opt3 from hemagglutinin__InfluenzaA__ACF41856
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggggauccuaugcaugcaagcgaggcucugugaacagcuuuuucucccgucucaauugguuacacaagucagaguacaaauauccagcccugaacgucaccaugcccaauaacggcaaguuugacaaacuuuacaucuggggagugcaucacccuaguacggauagagaccaaacuagcuuguacguaagggcuucugggcggguuaccguguccacaaagcgcucacagcagacugucaccccaaauauugguagcagacccugggugaggggccagaguucucggaucuccauuuauuggacaaucgugaaaccuggggacauacugcuaauuaacagcaccggaaaccucaucgccccacgcggcuacuucaagauucgaaaugguaagucgucuaucaugagauccgaugcgccgaucgggacguguucaagugagugcauuacucccaacggaagcauaccuaaugacaaaccauuucaaaacgucaauaggaucacauauggcgcauguccccgguacguuaagcagaacacccugaaacuugccacuggcaugcguaaugugccugaaaagcagacacgcgggauuuucggagcuaucgccgguuuuauagagaacggcugggaagggaugguagauggaugguauggcuucagacaccaaaauuccgaggguaccgggcaggcagcugaccugaaaucuacgcaggccgcgauugaucagaucaacggcaaguugaauaggcucaucgagaaaaccaacgaaaaguuucaucaaauugagaaggaguucagcgaaguggaaggacggauccaggaccuggagaaauacgucgaggauacaaagauugacuuauggucauauaaugccgaacugcucguggcacuugagaaccagcacacuauagaucugaccgacagugaaaugaauaaauuguucgagaagacacgaaaacagcuacgcgaaaacgcugaggauaugggcaacgggugcuuuaagaucuaccauaagugugacaaugccugcauuggauccaucagaaacgguacuuacgaccacgauguuuauagggacgaggcucugaauaaccgguuccaaaucaaaggcguggaacucaagagcggguacaaagauuggauucuguggauaucuuuugccaucucaugcuuccuucugugugucguguugcucggauuuauuaugugggcaugccagaagggcaauauccgcuguaacauuugcaucuga

SEQ ID NO: 124355 - RNA, 1698 nt, Artificial Sequence
  derived and/or modified sequence opt3 from hemagglutinin__InfluenzaA__ACF41867
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucacggcaagcugcucccacaacgggaagucaaguuuuuaccggaaucucuuauggcugacugagaaaaacggacuuuaucccaauuugagcaacucuuacgugaauaacaaggagaaagaaguacugguucuauggggcgugcaucacccuuccaacauccgcgaucagcgagccauauaccacaccgagaaugcuuaugucucaguggugagcagucauuacucucguagauucacaccagaaaucgcaaagaggcccaaaguccggggccaggaggggcgcauuaacuauuacuggacucuccuggagccuggagacaccaucauuuuugaagccaaugguaaccuuaucgcuccaugguaugccuucgcgcuguccagaggcuuugggagcggaauaauuacaucgaaugcaccgaugaacgagugugaugccaagugccagacgccccaaggcgcuaucaauucuuccuugccuuuccagaacguucacccagugaccauuggugaaugucccaaguacguaaggucaacuaaacuccggauggugacagggcugcgcaauaucccuaguauccagagccgaggauuauuuggcgccauugcaggcuucauagaagggggauggaccgguaugauggacggcugguauggguaccaucaccagaacgaacaaggauccggcuacgcugccgaucagaagucuacucagaaugcgaucaacgguauuacaaauaaagucaacagcgugaucgagaagaugaauacccaguuuacggccguugggaaagaguucaacaagcuggaaagaaggauggagaaccucaauaaaaagguggacgauggcuuccuugacauauggaccuauaacgcagaacuguugguccuacuggagaaugaacggacacucgauuuucacgacucaaacgugaagaaucuguacgagaaaguaaagagucaacuuaaaaacaaugcuaaggagauuggaaacggcugcuucgaauuuuaucauaaauguaauaacgagugcauggaauccguuaagaaugggacuuacgacuauccaaaguacagcgaggagucuaaacugaaccgugaaaagaucgauggagugaaauuggagucaaugggugucuaucagauccucgccauuuacaguaccguggcuagcucccuggucuuacuggugucucuaggcgccaucucguucuggaugugcagcaaugggucccuccagugucgcauuugcauauga

SEQ ID NO: 124356 - RNA, 1698 nt, Artificial Sequence; identical to SEQ ID NO: 124131
  derived and/or modified sequence opt3 from hemagglutinin__InfluenzaA__ACF41878

SEQ ID NO: 124357 - RNA, 1701 nt, Artificial Sequence
  derived and/or modified sequence opt3 from hemagglutinin__InfluenzaA__ACF41922
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaauagcuccccugcagcuugguaauuguucagucgccggcuggauccuggggaacccuaaaugcgagaguuuguuuagcaaggaauccuggucuuacauugcagagacaccaaauccggaaaacggaaccuguuaucccggcuacuucgccgacuaugaggagcucagggaacaacugucgucagugagcaguuuugagcgguucgaaaucuuuccuaaggaguccucuuggccaaaucauacuguuacaaaaggugugaccgcuagcugcucccacaacgggaagucaaguuucuaccgcaaucugcucugguuaacggagaaaaacggacuguaucccaaucuuagcaagucuuacgucaacaauaaagaaaaggagguguugguacuguggggcguucaucacccuuccaacauucgagaucagcgugcaaucuaccacacugaaaacgccuaugugucagucgugagcagucauuacucuagaagguuuaccccagagauagcuaagcggcccaaagugcgcgaccaggaaggcagaaucaauuauuacuggacacuacucgagccuggggauacuauuaucuucgaggccaacggaaaucugauugcgccaugguaugcauuugcccuuuccagggguuucggcagcgggaucauaaccucgaacgcuucuauggacgaaugugaugccaagugccagacaccgcaaggagcaauuaauuccucacugcccuuucagaacguccacccuguuaccaucggcgaguguccaaaauacgugcggaguacgaaguugcgcaugguaacuggucuccgaaauauucccagcauccaguccagagggcuguucggagcuaucgccggcuuuauugaaggcggguggacaggaaugauagacgguugguauggcuaccaucaccagaacgagcaagggucuggauacgcggccgaucagaaaagcacccagaaugcaaucaacggcauuacuaauaaggugaacucagucaucgaaaagaugaauacacaguucaccgcuguggguaaggaguucaacaaguuagagaggcggauggaaaaucugaacaaaaagguugacgauggguuucucgacauauggacguauaacgccgagcuucugguguugcuagaaaauggccguacccuggacuuccacgauaguaacgucaaaaaucucuacgagaaggugaaaucccaacugaagaacaaugcuaaggaaauuggaaacggcugcuuugaguucuaucauaaauguaauaacgagugcauggaaagcguaaagaaugggacauacgacuauccuaaauacucugaggaaucaaaacuuaaccgcggaaaaaucgaugguguuaagcuggagaguaugggcguguaucagaucuuggccauuuacagcacugucgcauccucucucgugcuguuagucucgcugggggccaucagcuuuuggaugugcuccaauggaucacuacaguguagaauuugcauauga

SEQ ID NO: 124358 - RNA, 1689 nt, Artificial Sequence
  derived and/or modified sequence opt3 from hemagglutinin__InfluenzaA__ACF54389
auggccaucauuuaccugauacuccuuuucgcuaccgugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcagucugaaugauuaugaagaacugaagcaucucuuaagcuccgugaagcacuuugaaaaaguccguauucugccaaaggacagauggacucaacauaccacaaccggugggucuaaggcuugugccgugucgggaaaacccucauucuuuaggaacaugguuuggcuuacuaaaaagggcacaaauuacccuguggcaaagggcagcuauaacaauaccaguggggagcagauguugaucauuuggggaguccaccacccaaucgaugaggccgaacagcgggcucuguaccaggagguggguacguacguauccgcaucuacuagcacccuaaacaaacgcuccauacccgaaauugccgcuagaccugagguuaauggccucgggucaaggauggaguucaguuggacacugcuugacgugugggauacuaucaacuuugagagcaccggaaaucuggucgccccagaguauggcuucaagauuucuaaacgggguuccucagggaucaugaagacagaaggaaccuugggcaacugcgagacgaaaugucaaacuccgcucggcgcgaucaacacaacccugcccuuucauaaugugcacccuuuaacuauuggggaaugcccaaaguacgugaaaagcgagaagcugguccucgcaacaggacuucgcaacguuccccagauagaaagucgaggucuguucggcgccaucgcuggguuuauugagggaggcuggcaggguaugguggacgggugguauggcuaccaucacucuaaugagcagggauccggcuaugccgcagauaaggaaagcacccaaaaggcuuucgacgggaucacgaacaaaguaaauucggugauagagaaaaugaacacccaguuugaagccgucggaaaggaguucaauaacuuggagaaaagacuagaaaaucugaacaagaagauggaggaugguuuucucgacguguggacauacaaugcggaacugcuuguucugauggagaacgaaaggacuuuggacuuccacgauucuaaugugaaaaaccucuaugagaagguccggaugcagcugcgugacaaugugaaagaguuaggcaacggguguuucgaauuuuaccauaagugcgaugacgaguguaugaacuccguuaaaaauggaaccuacgauuauccuaaguacgaagaggaaucaaagcugaaacgcaacgagauuaagggcguaaaacuaaguagcauggguguguaucagauccucgccaucuacgcaacagucgcugggucccugucucuugccauuaugguggcuggcaucagcuucuggaugugcucaaauggaaguuugcaaugcagaauuuguauauga

SEQ ID NO: 124359 - RNA, 1701 nt, Artificial Sequence; identical to SEQ ID NO: 124332
  derived and/or modified sequence opt3 from hemagglutinin__InfluenzaA__ACF54400

SEQ ID NO: 124360 - RNA, 1701 nt, Artificial Sequence; identical to SEQ ID NO: 124334
  derived and/or modified sequence opt3 from hemagglutinin__InfluenzaA__ACF54411

SEQ ID NO: 124361 - RNA, 1701 nt, Artificial Sequence; identical to SEQ ID NO: 124334
  derived and/or modified sequence opt3 from hemagglutinin__InfluenzaA__ACF54422

SEQ ID NO: 124362 - RNA, 1701 nt, Artificial Sequence; identical to SEQ ID NO: 124345
  derived and/or modified sequence opt3 from hemagglutinin__InfluenzaA__ACF54433

SEQ ID NO: 124363 - RNA, 1701 nt, Artificial Sequence; identical to SEQ ID NO: 124334
  derived and/or modified sequence opt3 from hemagglutinin__InfluenzaA__ACF54444

SEQ ID NO: 124364 - RNA, 1701 nt, Artificial Sequence; identical to SEQ ID NO: 124352
  derived and/or modified sequence opt3 from hemagglutinin__InfluenzaA__ACF54466

SEQ ID NO: 124365 - RNA, 1689 nt, Artificial Sequence
  derived and/or modified sequence opt3 from hemagglutinin__InfluenzaA__ACF54477
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaggaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcaacuauccuguggcaaaggggaguuacaauaacacauccggagagcagaugcuuaucauuugggguguccaccacccaaaugacgagaccgaacagaggacguuguaucagaacgugggcacuuacguaucuguugggaccagcacacugaauaagcgguccacucccgauaucgccacccgcccuaaagugaacggacuaggcucaagaauggaguuuaguuggacacuccuggacaugugggauaccauaaacuucgaaagcacggguaaucuuauugcuccagaguacggguuuaagaucucuaaaaggggauccucaggcauuaugaagacugaaggcacacuggagaacugcgagaccaaaugucaaacuccguugggggcaaucaauacaacccuccccuuccauaacguccacccucugacgaucggagaaugcccaaaguaugugaaaagcgagaaguuagugcuggccaccggucuccggaaugucccccagauugaaagucgcggccuuuuuggggcuauagccggauucaucgagggcgguuggcaggggaugguugacggcugguacggauaucaucacucuaacgaucagggcuccggguacgcggcagacaaggaaagcacacaaaaagccuuugacggaauuacuaauaaggugaacucgguaaucgagaaaaugaauacccaguucgaggcuguggguaaggaauuuucuaaccuggagcgaagauuggaaaaucuaaacaaaaagauggaggauggcuuccuggacgucuggacauauaaugccgaacuccuggugcuuauggagaacgagaggacucuggauuuccacgacuccaauguuaagaacuuguacgauaaagugcggaugcagcuccgugacaacgucaaggaacuggggaauggauguuuugaguucuaucauaaaugcgaugacgaauguaugaacucagugaagaauggcaccuacgauuacccuaaauaugaggaggaaaguaaguuaaaccgcaaugagauaaaggguguaaaacugagcuccauggggguuuaccagauucuagcaaucuaugcuacaguggccggcucucucagccuggcgaucaugauggccggaauuucauuuuggaugugcaguaacggcucccuucaaugcagaaucuguauuuga

SEQ ID NO: 124366 - RNA, 1689 nt, Artificial Sequence
  derived and/or modified sequence opt3 from hemagglutinin__InfluenzaA__ACF54499
auggccaucauuuaccugauacuccuuuucaccgcugugagaggcgaccagaucugcauuggguaucacgcaaacaauagcacagagacugucgauacgauccuggaaaggaacguuaccgugacacaugccaaggacauuuuggagaaaacucacaauggaaaguuauguaaacugaacgguauacccccucuagaacucggcgauugcuccaucgcgggguggcugcuuggaaauccagagugugaccggcuguugucuguaccggaauggucauacaucauggagaaggagaacccccgcgauggccucugcuauccugguaguuuuaaugacuacgaggaacugaaacaucugcucagcuccgugaagcacuucgaaaaggucaaaauuuuaccaaaggaucgauggacccaacauacaaccacugggggaucucgugcuugugccgugucgggcaaccccucauuuuucagaaauaugguuuggcugacaaagaagggcagcaacuauccuguggcaaaagggaguuacaauaacaccuccggagagcagaugcuuaucauuugggguguccaccacccaaaugacgagacggaacagaggacuuuguaucagaacgugggcaccuacguaucuguugggacaagcacucugaauaagcgguccacccccgauaucgccacacgcccuaaggugaacggacuaggcucaagaauggaguuuaguuggacccuccuggacaugugggauacgauaaacuucgaaagcacugguaaucuuauugcuccagaguacggguuuaaaaucucuaagaggggauccucaggcauuaugaaaacagaaggcacccuggagaacugcgagacuaagugucaaacaccguugggggcaaucaauaccacgcuccccuuccauaacguccacccucugaccaucggagaaugcccaaaauaugugaaaagcgagaaauuagugcuggccacaggucuccggaaugucccccagauugaaagucgcggccuuuuuggggcuauagccggauucaucgagggcgguuggcaggggaugguugacggcugguacggauaucaucacucuaacgaucagggcuccggguacgcggcagacaaggaaagcacucaaaaggccuuugacggaauuaccaauaaagugaacucgguaaucgagaagaugaauacacaguucgaggcuguggguaaagaauuuucuaaccuggagcgaagauuggaaaaucuaaacaagaaaauggaggauggcuuccuggacgucuggacuuauaaugccgaacuccuggugcuuauggagaacgagaggacccuggauuuccacgacuccaauguuaagaacuuguacgauaaggugcggaugcagcuccgugacaacgucaaagaacuggggaauggauguuuugaguucuaucauaagugcgaugacgaauguaugaacucagugaaaaauggcacauacgauuacccuaaguaugaggaggaaaguaaauuaaaccgcaaugagauaaaggguguaaagcugagcuccauggggguuuaccagauucuagcaaucuaugcuaccguggccggcucucucagccuggcgaucaugauggccggaauuucauuuuggaugugcaguaacggcucccuucaaugcagaaucuguauuuga

SEQ ID NO: 124367 - RNA, 1689 nt, Artificial Sequence; identical to SEQ ID NO: 124366
  derived and/or modified sequence opt3 from hemagglutinin__InfluenzaA__ACF54510

SEQ ID NO: 124368 - RNA, 1689 nt, Artificial Sequence; identical to SEQ ID NO: 124366
  derived and/or modified sequence opt3 from hemagglutinin__InfluenzaA__ACF54521

SEQ ID NO: 124369 - RNA, 1701 nt, Artificial Sequence
  derived and/or modified sequence opt3 from hemagglutinin__InfluenzaA__ACF54532
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccgggaagaguucgauuaugcgcucugacgcgcccaucggaaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacagcgaaaugaauaaauuguucgagaagaccaaaaagcagcuaagggaaaacgcugaggauaugggcaauggaugcuuuaagaucuaccacaaaugugacaacgccugcauuggcucaauccggaaugggacauaugaucaugacguguaccgagacgaggcucugaacaaucgcuuccagauuaagggagucgaacucacuagcgguuacaaagauuggauccuguggauauccuuugccaucagcugcuuccuucuguguguggcauugcucggcuuuauuaugugggccugccagaaggggaacaucagauguaauauuugcaucuga

SEQ ID NO: 124370 - RNA, 1701 nt, Artificial Sequence
  derived and/or modified sequence opt3 from hemagglutinin__InfluenzaA__ACF54543
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgugucguugaggucacucguugcaagcaguggcacucuggaauuuaacaaugaguccuucaacuggacaggugugacccagaaugggacgucuagcgccugcauccggcgcuccaacaauucauuuuucagucgacugaacuggcucacucauuuaaaguuuaaguauccagcucugaaugucaccaugcccaacaacgagaauuucgacaaacuuuacauuuggggagugcaccauccuggcacagauaacgaccagaucuuuuuguaugcacaggccagcggccguauuacuguaucuaccaagagaucccaacagacaguuaucccaaauauagggucaaggccccgggugcgcaacauuccuagcagaaucaguauuuacuggaccaucgucaaaccaggagauauccugcuaauuaauucuacggguaaccucauagcuccgaggggcuacuucaagauccgguccgggaaaagcucgauuaugcgcucugacgcccccaucggaaaguguaauuccgaaugcauaacuccuaacggcucaauuccaaaugacaagcccuuucagaacgugaaucgaaucacauauggugcguguccuagauacgugaaacagaacacccugaagcuggcaacugggaugaggaaugucccagagaaacaaacacggggaaucuucggcgccauugcuggcuuuaucgaaaacgggugggagggaaugguugaugguugguauggcuuccgucaccagaauagugaggggauuggacaggccgcagaccuuaagagcacccaagcugccauagaucagaucaacggcaaauugaaccgccucauugguaagacgaaugaaaaauuccaccagaucgagaaggaauuuuccgagguggaagggagaauccaggaccuggagaaguacguagaggauaccaaaauugacuuauggucuuauaacgcggaacugcucguggcccuugagaaucaacauacaauagaucugacugacagcgaaaugaacaaguuguucgagaaaaccaagaaacagcuaagggaaaaugcagaggaucugggcaacggaugcuuuaagaucuaccacaagugugacaaugcuugcauuggcucaauccggaacgggacauaugaucaugacgucuaccgagacgaggcccucaauaaccgcuuccagauuaaaggaguggaacugaagagugguuacaaagauuggauccuuuggauauccuuugcuaucagcugcuuccuguuguguguugcccuccugggcuuuauuaugugggcaugccagaaggggaauaucagauguaacauuugcaucuga

SEQ ID NO: 124371 - RNA, 1701 nt, Artificial Sequence
  derived and/or modified sequence opt3 from hemagglutinin__InfluenzaA__ACF54565
augaagaccaucauugcccugagcuacauacucugccuuguguucucccagaaacugcccggcaacgacaauucuacagcuacuuuguguuuagggcaccaugcagucccuaacggaacgaucguuaagaccauuacaaaugaucaaaucgaggugacuaacgccaccgaacugguacagucaaguagcacagguggcauuugcgacuccccacaccagauccuagauggggagaauuguacccucauagacgcgcugcuuggagauccgcagugcgacggcuuucaaaacaaaaagugggaucuguucguggaaagaucuaaggcuuauucgaauuguuaccccuaugacgucccugauuacgccucauugaggagccucguggcaaguuccgguacucuggaguuuaacaaugaaucuuucaacugggccgggguuacacagaauggaaccagcuccgcuugcaagcggcgcucaaacaagagcuuuuucagucgacugaauuggcucacgcauuuaaaauauaaguacccagcacugaacgugacuaugcccaauaacgagaaauuugacaaacuuuauaucuggggcguccaccauccugugaccgauucugaccagauuuccuuguacgcccaggcuucaggccguaucacaguaagcacuaaaagaagucaacagaccguuauuccaaacaucggguacaggccccgggugcgcgauauaucuuccagaauuagcaucuauuggacaauugucaagccuggagacauccugcuaaucaauucgaccgguaaccucauugccccaaggggcuacuucaagauacggucugggaaauccucaaucaugcgcagugacgcgccgauuggaaaguguaauagcgagugcaucacgcccaacggcuccauaccuaaugauaaaccauuucagaacgugaaucgaauuacuuauggugcaugucccagauacgugaagcagaacacacugaaacuugccaccgggaugaggaaugucccugaaaagcaaacucggggaaucuucggcgcuaucgccggcuuuauugagaacgggugggaaggaaugguugacgguugguauggcuuccgucaccaaaauucugaggggacaggacaggcagcugaucugaaaagcacccaggccgcgaucaaccagauuaauggcaaguugaaccgccucauagguaagacgaaugagaaauuucaccagaucgaaaaggaguucucagaaguggaggggaggauucaggaccuggaaaaauacguagaggauaccaagaucgacuuauggaguuauaacgccgagcugcucguggcacuugaaaaccaacauacaaucgaucugacugacuccgagaugaauaaauuguucgaaagaaccaagaagcagcuacgggagaacgcugaagauaugggcaauggaugcuuuaaaauuuaccacaagugugacaacgccugcauagagagcauccgaaauggcacauacgaucaugacgucuaucgcgacgaggcucugaacaauagauuccagauuaaagggguggaacucaagucuggauacaaagauuggauccuguggauuucauuugccaucaguugcuuccuucuguguguugcauugcucgguuuuauaaugugggccugccagaagggcaacaucagguguaauauuugcaucuga

SEQ ID NO: 124372 - RNA, 1701 nt, Artificial Sequence
  derived and/or modified sequence opt3 from hemagglutinin__InfluenzaA__ACF54576
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacgacgaauccuucaauuggacagggguuacccagaacggaacgucuagcuccugcaagcggcgcucaaauaacagcuuuuucagccgacugaauuggcucacucaguuaaaguuuaaauauccagcucugaacgugaccaugcccaauaacgagaaguucgauaaacuuuacaucuggggcguccaucacccugugacagacaacgaucagauuuuucuuuaugcacaagccucuggccguaucacuguauccaccaagagaucacagcagacaguuauuccaaauaucgggagcaggccccggauacgcaacauuccuaguagaaucucuauuuacuggaccaucgugaaaccaggagacauccugcuaauuaauuccacggguaaccucauagcuccgaggggcuacuucaagauccggagcgggaagucgucuauuaugcgcuccgacgcccccaucggaaaauguaauucagagugcauaacuccuaacggcaguauuccaaaugauaagcccuuucagaacgucaaucgaaucacauauggugcguguccuagauacgugaaacaaaacacccugaaguuggcaacugggaugaggaaugugccagaaaaacagacacggggaaucuucggcgccauugcuggcuuuaucgagaacgggugggaaggaauggucgacgguugguauggcuuccgucaucagaauagcgaggggauuggacaagccgcagaucugaaguccacccaggcugccauaaaccagaucaauggcaaauugaaccgccucauugguaagacgaacgagaaguuccaccagaucgaaaaagaguuuucugaaguugaggggagaauccaagaccuggaaaaguacguggaggauaccaaaauugacuuauggagcuauaaugcggagcugcucguagcccuugaaaaccagcacacaauagaucugacugacucagagaugaauaaguuguucgaaaggaccaaaaagcagcuacgggagaacgcagaagauaugggcaauggaugcuuuaagaucuaccauaaaugugacaacgcuugcauuggcaguauccgaaaugggacauaugaucacgacguguaccgcgacgaggcccugaacaauagauuccagauuaagggagucgagcucaaauccgguuacaaggauuggauccuguggauaaguuuugcuaucucuugcuuccuucuguguguggccuugcucggcuuuauuaugugggcaugccaaaaagggaacaucagguguaauauuugcaucuga

SEQ ID NO: 124373 - RNA, 1698 nt, Artificial Sequence
  derived and/or modified sequence opt3 from hemagglutinin__InfluenzaA__ACF54598
augaaggccaaacugcucgugcuucuguacgcuuucgucgcaaccgacgccgauacaaucugcauuggcuaucacgcgaacaauagcacugacacgguugauaccauauuugagaagaacguggcuguaacacauuccgugaauuuguuagaagacagacacaacgggaaacuguguaagcuaaaaggaaucgcaccccuccagcuggguaagugcaauauuaucggcuggcuucuggggaacccugagugugauucuuugcucccagccaggucauggaguuacauugucgaaacuccgaauagcgagaacggagccugcuaucccggcgacuucaucgauuacgaagaacugcgggagcaacuguccucugugucgucacucgaacgcuuugagauauucccuaaggaaagcaguuggccaaaucauaccuuuaacgguguuacagcuuccuguucucaccgagggaaaagcuccuucuaucguaauuuacuguggcuuaccaagaaaggagacucauaccccaaguugacuaacaguuaugugaauaacaaaggcaaggagguccuggugcuauggggcguacaucacccuucuagcuccgaugagcagcagucacucuacagcaaugggaacgcauacguuaguguggccucuuccaacuauaauagaagguuuacaccagaaaucgcugcccggcccaaggucaaagaccagcacggacgcaugaacuacuauuggacccugcuugagccuggugauacgauuaucuucgaagcgacuggcaaucugauugcaccaugguacgccuuugcuuugagcagaggguucgagucgggaaucauaaccucuaacgccuccaugcaugaaugcaauacaaagugucaaacuccgcagggcucaauuaacaguaaucuccccuuucagaacauccacccugugaccauuggugagugcccaaaauaugugaggagcacaaagcugcggauggucaccggguuacgcaauauccccuccauccaguaccgaggacuguucggcgcaauugcuggcuuuauagaagggggauggacggguaugaucgacggcugguauggguaccaucaccaaaacgaacagggaucuggcuacgccgcggaucagaaaagcacucagaaugccauuaacgguaucacaaauaagguuaacucaauaauugagaaaaugaauacccaauucacugcaguggggaaggaguucaacaaccucgagaagagaauggaaaaucuuaacaaaaagguagacgacggcuuucuggauaucuggacauauaaugcugaguugcuagugcugcucgagaacggaaggacccuggacuuccacgaucuuaaugucaaaaaccuguacgaaaaggugaaaagucaguugaagaauaacgccaaggagaucggcaauggguguuuugaguucuaucauaaaugcgacaacgaguguauggaauccguucggaauggaacguacgauuauccuaaguacagcgaggagucuaaacucaaccgugaaaagauugacggugugaaacuggagucaaugggcgucuaucagaucuuagcuauuuacaguaccguggccagcucccugguacuacucguuucucugggggcaauaucguuuuggaugugcagcaauggaucccuucaaugccgcaucuguauuuga

SEQ ID NO: 124374 - RNA, 1704 nt, Artificial Sequence
  derived and/or modified sequence opt3 from hemagglutinin__InfluenzaA__ACG50699
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauaugguggagaaggcgaacccggcuaaugaucugugcuaccccgggaacuuuaaugacuaugaggaauugaagcaucuccugagcaggauaaaccacuucgagaaaauccagauuaucccuaaguccucuuggucggaucaugaagccucacugggagucagcagugcauguccauaccagggcuccucuagcuuuuuccggaaugugguauggcucauuaaaaagaacaaugccuaucccacaaucaaacgcuccuacaacaauacuaaccaagaggacuuacugguucuuugggguauacaccacccuaacgaugaggcugaacagacccgauuguaucagaauccaacaaccuacauuucaguggggacaaguacucugaaccagcgucuaauccccaagauugcaaccagaagcaaggucaauggacaaucuggcaggauggacuuuuucuggacgauccucaaaccuaacgaugccaucaauuuugaguccaacggcaauuucauugcuccagaauacgccuauaagauagugaaaaagggggacucagcgaucaugaaaagcgagguggaauacggaaacugcaauacuaagugucagaccccgaugggugcaauuaacaguucuaugcccuuucauaauauccacccucugacaauaggcgagugcccaaaauaugucaaguccaacaaacuuguucuggccacuggguugcggaauagcccccagcgcgagagaaggcggaaacgcggacucuucggcgcuauugccgguuuuaucgaagggggauggcagggcaugguggacggcugguacggguaucaucacucgaacgagcaaggaucugguuacgcagcugauaaggaauccacccagaaagccaucgacggcguaacaaauaaggugaacucaauuaucgauaaaaugaacacccaguucgaggcggucgggcgagaauuuaauaaccuggagagaaggauugagaauuuaaacaagaagauggaagacggauuccuggauguguggacguauaaugccgagcuccuuguucugauggaaaacgagcggacuuuggacuuccacgauaguaaugugaaaaaccuauacgacaagguccgucugcaacuccgcgauaaugcaaaagaacugggcaacgguuguuuugaguucuaccauaagugcgacaaugaguguauggaaagcgugagaaacgggacauaugauuacccucaguauuccgaggaagcuaggcuuaaacgggaggagauaucuggcguaaagcuggaaagcaucggaaccuaccagauuuugucaaucuauaguacuguugccuccagccucgcucuggccaucaugguggcaggcuuaucucuguggaugugcucaaaugggagucuacagugccgaauuuguauauga

SEQ ID NO: 124375 - RNA, 1701 nt, Artificial Sequence; identical to SEQ ID NO: 123944
  derived and/or modified sequence opt3 from hemagglutinin__InfluenzaA__ACG70142

SEQ ID NO: 124376 - RNA, 1701 nt, Artificial Sequence; identical to SEQ ID NO: 123944
  derived and/or modified sequence opt3 from hemagglutinin__InfluenzaA__ACG70153

SEQ ID NO: 124377 - RNA, 1701 nt, Artificial Sequence
  derived and/or modified sequence opt3 from hemagglutinin__InfluenzaA__ACG80410
augaagaccaucauugcccugagcuacauacucugccuuguguucgcucagaaacugcccggcaacgacaauuccacagcaacuuuguguuuagggcaccaugccgucccuaacggaacgaucguuagaaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaagaaaugggaucuguucguggagagguccaaggccuauucuaauuguuaccccuaugacgucccugauuacgcaucguugcggucacucguggccagcaguggcacucuggaauuuaacaaugaguccuucaacuggacagguguuacccagaaugggacgucuagcgcuugcauccgccgauccaacaauucauuuuucagucgucugaacuggcucacucauuuaagauuuaaauauccagcacugaaugugaccaugcccaacaacgagcaguucgacaaacuuuacauuuggggaguccaccauccuggcacagauaaugaccagaucuuuuuguaugcccaagcuagcggcaggauuacugugucuaccaagcggucccagcagacaguaaucccaaacauagggucacgccccagaguuaggaauauuccuagccggaucaguauuuacuggaccaucgugaagccaggagauauccugcuaauuaacucuacggguaaucucauagccccgcgcggcuacuucaagauccgaaacgggaaauccagcauuaugagaucggacgcgcccaucggaaaguguaauucugaaugcauaacuccuaacggcuccauuccaaaugacaaacccuuucagaacgucaauaggaucacauauggugcauguccucgguacgugaagcaaaacacccugaaacuugccacugggaugcguaaugugccagagaagcagacacgcggaaucuucggcgcuauugccggcuuuaucgaaaacgggugggagggaauggucgaugguugguauggcuucagacaccaaaauucagaggggaggggacaggcagcugaccugaagaguacccaggccgcgauugaucagauaaacggcaaauugaaccggcucaucgguaagacgaaugaaaaauuccaccagauugagaaggaauuuagcgagguugaagggcgaauccaagaccuggagaaauacguggaggauaccaagaucgacuuaugguccuauaacgccgaacugcucguagcacuugagaaucagcauacaauugaucugacugacucugaaaugaacaaguuguucgagaaaaccaagaaacagcuacgcgaaaaugcugaggauaugggcaacggaugcuuuaagauauaccacaaaugugacaaugccugcaucggcagcauuagaaacgggacauaugaucaugacguguacagggacgaggcucugaauaaccgguuccagaucaagggagucgaacucaagucagguuacaaagauuggauucuguggaucaguuuugccauauccugcuuccuucuguguguggcauugcucggcuuuaucaugugggccugccaaaaggggaauauucgcuguaacaucugcauuuga

SEQ ID NO: 124378 - RNA, 1701 nt, Artificial Sequence
  derived and/or modified sequence opt3 from hemagglutinin__InfluenzaA__ACG80420
augcagaccaucauugcccugagcuacauacucugccuuguguucgcucaaaagcugcccggcaacgacaauuccacagcaacuuuguguuuagggcaccaugccgucccuaacggaacgaucguuagaaccauuacaaaugaucagaucgaggugacuaacgcgaccgaacugguacagucuucaaguacaggugagauuugcgacagcccacaccagauccuagauggcgaaaauuguacccucauagacgcucugcuuggggauccgcaaugcgacggauuucagaacaaaaagugggaucuguucguggagagguccaaagccuauucuaauuguuaccccuaugacgucccugauuacgcaucguugcggucacucguggccagcaguggcacucuggaauuuaacaaugaguccuucaacuggacagguguuacccagaaugggacgucuagcgcuugcauccgccgauccaacaauucauuuuucagucgucugaacuggcucacucauuuaagauuuaaguauccagcacugaaugugaccaugcccaacaacgagcaguucgacaaacuuuacauuuggggaguccaccauccuggcacagauaaugaccaaaucuuuuuguaugcccaggcuagcggcaggauuacugugucuaccaagcggucccagcagacaguaaucccaaacauagggucacgccccagaguuaggaauauuccuagccggaucaguauuuacuggaccaucgugaagccaggagauauccugcuaauuaacucuacggguaaucucauagccccgcgcggcuacuucaaaauccgaaacgggaaguccagcauuaugagaucggacgcgcccaucggaaaauguaauucugaaugcauaacuccuaacggcuccauuccaaaugacaagcccuuucaaaacgucaauaggaucacauauggugcauguccucgguacgugaaacagaacacccugaaacuugccacugggaugcguaaugugccagagaagcagacacgcggaaucuucggcgcuauugccggcuuuaucgaaaacgggugggagggaauggucgaugguugguauggcuucagacaccaaaauucagaggggaggggacaggcagcugaccugaagaguacccaggccgcgauugaucagauaaacggcaaguugaaccggcucaucgguaaaacgaaugaaaaguuccaccaaauugagaaagaauuuagcgagguugaagggcgaauccaggaccuggagaaguacguggaggauaccaaaaucgacuuaugguccuauaacgccgaacugcucguagcacuugagaaucagcauacaauugaucugacugacucugaaaugaacaaguuguucgagaagaccaaaaagcagcuacgcgaaaaugcugaggauaugggcaacggaugcuuuaaaauauaccacaagugugacaaugccugcaucggcagcauuagaaacgggacauaugaucaugacguguacagggacgaggcucugaauaaccgguuccaaaucaaaggagucgaacucaagucagguuacaaggauuggauucuguggaucaguuuugccauauccugcuuccuucuguguguggcauugcucggcuuuaucaugugggccugccagaaagggaauauucgcuguaacaucugcauuuga

SEQ ID NO: 124379 - RNA, 1701 nt, Artificial Sequence; identical to SEQ ID NO: 124377
  derived and/or modified sequence opt3 from hemagglutinin__InfluenzaA__ACG80426

SEQ ID NO: 124380 - RNA, 1701 nt, Artificial Sequence; identical to SEQ ID NO: 124377
  derived and/or modified sequence opt3 from hemagglutinin__InfluenzaA__ACG80430

SEQ ID NO: 124381 - RNA, 1701 nt, Artificial Sequence
  derived and/or modified sequence opt3 from hemagglutinin__InfluenzaA__ACG80436
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaagugggaucuuuuuguggagagauccaaagccuauucuaauuguuaccccuaugacgucccugauuacgcaucgcugaggucauugguggccagcaguggcacucucgaguucaacaaugaauccuuuaacuggacagguguuacccagaaugggacgucuagcgcuugcauccggcgcuccaacaauucauucuuuagucgacugaacuggcugacucaucuccguuucaaguauccagcauuaaaugugaccaugcccaacaacgagaauuuugacaagcuguacauuuggggaguccaccauccuggcacagauaacgaccagaucuuccuuuaugcccaggcuagcggcagaauuacugugucuaccaaaaggucccaacagacaguaaucccaaauauagggucacggccccgcguuagaaacauuccuagcaggaucaguauuuacuggaccaucgugaagccaggagauaucuugcugauuaauucuacggguaaccuaauagccccgcggggcuacuuuaaaauccgcuccggaaagagcucgauuaugcgaucugacgcgcccaucgggaaauguaauuccgaaugcauaacuccuaacggcucaauuccaaaugacaagcccuuccagaacgucaauagaaucacauauggugcauguccuagguacgugaagcagaacacccucaaacuggccacugggaugcggaaugugccagagaagcaaacacguggaaucuuuggcgcuauugccggcuucaucgaaaacgggugggagggaauggucgaugguugguauggcuuccgccaccagaauagugaggggauuggacaggcagcugaccuuaaaagcacccaagccgcgcuggaucagauaaacggcaaguugaacagacucaucgguaaaacgaaugaaaaguuucaccagauugagaaagaguucuccgaaguugaagggaggauccaggaccuggagaaguacguggaggauaccaagaucgacuuauggucuuauaacgccgaacugcucguagcacuugagaaucaacauacaauugaucugacugacagcgaaaugaacaaauuguuugagaagaccaaaaagcagcuacgggaaaaugcugaggauaugggcaacggaugcuucaaaauauaccacaagugugacaaugccugcaucggcucaauucgaaacgggacauaugaucauaauguguaccgcgacgaggcucugaacaauagauuucagaucaagggagucgaacucaaaagugguuacaaggacuggauucuguggaucuccuucgccauaagcugcuuucuucuguguguggcauugcucggcuucaucaugugggccugccagaaagggaacauuagguguaauaucugcauuuga

SEQ ID NO: 124382 - RNA, 1701 nt, Artificial Sequence
  derived and/or modified sequence opt3 from hemagglutinin__InfluenzaA__ACG80445
augaagaccaucauugcccugagcuacauacucugccuuguguucgcucagaaacugcccggcaacgacaauuccacagcaacuuuguguuuagggcaccaugccgucccuaacggaacgaucguuagaaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaagaaaugggaucuguucguggagagguccaaggccuauucuaauuguuaccccuaugacgucccugauuacgcaucguugcggucacucguggccagcaguggcacucuggaauuuaacaaugaguccuucaacuggacagguguuacccagaaugggacgucuagcgcuugcauccgccgauccaacaauucauuuuucagucgucugaacuggcucacucauuuaagauuuaaauauccagcacugaaugugaccaugcccaacaacgagcaguucgacaaacuuuacauuuggggaguccaccauccuggcacagauaaugaccagaucuuuuuguaugcccaagcuagcggcaggauuacugugucuaccaagcggucccagcagacaguaaucccaaacauagggucacgccccagaguuaggaauauuccuagccggaucaguauuuacuggaccaucgugaagccaggagauauccugcuaauuaacucuacggguaaucucauagccccgcgcggcuacuucaagauccgaaacgggaaauccagcauuaugagaucggacgcgcccaucggaaaguguaauucugaaugcauaacuccuaacggcuccauuccaaaugacaaacccuuucagaacgucaauaggaucacauauggugcauguccucgguacgugaagcaaaacacccugaaacuugccacugggaugcguaaugugccagagaagcagacacgcggaaucuucggcgcuauugccggcuuuaucgaaaacgggugggagggaauggucgaugguugguauggcuucagacaccaaaauucagaggggaggggacaggcagcugaccugaagaguacccaggccgcgauugaucagauaaacggcaaauugaaccggcucaucgguaagacgaaugaaaaauuccaccagauugagaaggaauuuagcgagguugaagggcgaauccaagaccuggagaaauacguggaggauaccaagaucgacuuaugguccuauaacgccgaacugcucguagcacuugagaaucagcauacaauugaucugacugacucugaaaugaacaaguuguucgagaaaaccaagaaucagcuacgcgaaaacgcugaggauaugggcaauggaugcuuuaaaauauaccacaagugugacaacgccugcaucggcagcauuagaaaugggacauaugaucaugacguguacagggacgaggcucugaacaaucgguuccagaucaaaggagucgaacucaagucagguuacaaggauuggauucuguggaucaguuuugccauauccugcuuccuucuguguguggcauugcucggcuuuaucaugugggccugccaaaaagggaacauucgcuguaauaucugcauuuga

SEQ ID NO: 124383 - RNA, 1701 nt, Artificial Sequence; identical to SEQ ID NO: 124377
  derived and/or modified sequence opt3 from hemagglutinin__InfluenzaA__ACG80454

SEQ ID NO: 124384 - RNA, 1701 nt, Artificial Sequence; identical to SEQ ID NO: 124377
  derived and/or modified sequence opt3 from hemagglutinin__InfluenzaA__ACG80463

SEQ ID NO: 124385 - RNA, 1701 nt, Artificial Sequence
  derived and/or modified sequence opt3 from hemagglutinin__InfluenzaA__ACG80472
augaagaccaucauugcccugagcuacauacucugccuuguguucgcucagaaacugcccggcaacgacaauuccacagcaacuuuguguuuagggcaccaugccgucccuaacggaacgaucguuagaaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaagaaaugggaucuguucguggagagguccaaggccuauucuaauuguuaccccuaugacgucccugauuacgcaucguugcggucacucguggccagcaguggcacucuggaauuuaacaaugaguccuucaacuggacagguguuacccagaaugggacgucuagcgcuugcauccgccgauccaacaauucauuuuucagucgucugaacuggcucacucauuuaagauuuaaauauccagcacugaaugugaccaugcccaacaacgagcaguucgacaagcuguacauuuggggaguccaccauccuggcacagauaaugaccagaucuuuuuguaugcccaagcuagcggcaggauuacugugucuaccaagcggucccagcagacaguaaucccaaacauagggucacgccccagaguuaggaauauuccuagccggaucaguauuuacuggaccaucgugaaaccaggagauauccugcuaauuaacucuacggguaaucucauagccccgcgcggcuacuucaagauccgauccgggaaaagcucgauuaugagaucugacgcgcccaucggaaaguguaacuccgaaugcauaacuccuaauggcucaauuccaaacgacaaacccuuucagaaugucaacaggaucacauauggugcauguccucgguacgugaagcaaaauacccugaaacuugccacugggaugcguaacgugccagagaagcagacacgcggaaucuucggcgcuauugccggcuuuaucgaaaaugggugggagggaauggucgaugguugguauggcuucagacaccagaacagugaggggauuggacaagcagcugaccuuaagagcacccaggccgcguuggaucagauaaauggcaaacucaacaggcugaucgguaagacgaacgaaaaauuccaccagauugagaaggaauuuuccgagguugaagggcggauccaagacuuagagaaauacguggaggauaccaagaucgaccuguggucuuauaaugccgaacuccuuguagcacuggagaaccagcauacaauugauuugacugacagcgaaaugaauaagcuauucgagaaaaccaagaaacagcugcgagaaaacgcugaggauaugggcaauggaugcuuuaagauauaccacaaaugugacaacgccugcaucggcucaauucgcaaugggacauaugaucauaacguguacagagacgaggcucucaauaacagguuccagaucaagggagucgaacugaagagugguuacaaagacuggauucuuuggaucuccuuugccauaagcugcuuccuguuguguguggcacuccugggcuuuaucaugugggccugccaaaaggggaauauucgguguaacaucugcauuuga

SEQ ID NO: 124386 - RNA, 1701 nt, Artificial Sequence
  derived and/or modified sequence opt3 from hemagglutinin__InfluenzaA__ACH69558
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcaauagcccacaccagauccuagacggggagaacuguacccucauagaugcucugcuuggagacccgcagugcgauggcuuucaaaauaaaaagugggaccuguucguggaaagauccaaagccuauucuaacuguuaccccuaugaugucccugacuacgcaucguugaggucacucguggccagcagugguacucuggaguuuaauaacgaauccuucaauuggacagggguuacccagaacggaacgucuagcgcuugcaagcggcgcuccaauaacucauuuuucagucgacugaauuggcucacucauuuacguuuuaaguauccagcacugaacgugaccaugcccaacaaugagaaauucgauaaguuguacaucuggggcguccaccauccuggcacagacaacgaucagauuuuucuuuaugcccaggcuagcgggagaaucacugugucuaccaaaaggucccaacagacaguaauuccaaauaucggaucacggccccgcguuagaaacauaccuagcaggauuaguaucuacuggaccauugugaagccaggugacauccugcuaaucaauucuacgggcaaccucauugccccgcggggguacuucaaaauacgcuccggaaagagcucgaucaugcgaucugaugcgcccauuggcaaguguaauuccgagugcaucacuccuaacgguucaauaccaaaugacaaacccuuucagaacgucaauagaauuacauauggggcauguccuagguacgugaagcagaacacccugaaacuugccacuggaaugcggaaugugccagaaaagcaaacacguggcaucuucggcgcuaucgccggguuuauugagaacggaugggaagguauggucgacggcugguauggguuccgccaccagaauagugagggaaucggccaggcagcugaucugaaaagcacccaagccgcgauuaaccagauaaacgguaaguugaauagacucaucgggaaaacgaacgagaaguuccaccagauugaaaaggaguuuuccgaaguugagggcaggauccaggaccuggaaaaauacguggaggauaccaagaucgacuuauggucuuauaaugccgagcugcucguagcacuugaaaaccaacauacaauugaucugacugacagcgagaugaauaaauuguucgaacggaccaagaaacagcuacgagagaacgcugaagauaugggaaauggcugcuuuaagauauaccacaagugugacaacgccugcaucgggucaauucgcaauggaacauaugaucaugacguguacagagaugaggcucugaacaauagguuccagaucaaaggugucgagcucaagaguggcuacaaagacuggauucuguggaucuccuuugccauaagcugcuuccuucuguguguggcauugcucggguuuaucaugugggccugccagaagggaaacauucgguguaauaucugcauuuga

SEQ ID NO: 124387 - RNA, 1701 nt, Artificial Sequence
  derived and/or modified sequence opt3 from hemagglutinin__InfluenzaA__ACH69569
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcaauagcccacaccagauccuagacggggagaacuguacccucauagaugcucugcuuggagacccgcagugcgauggcuuucaaaauaaaaagugggaccuguucguggaaagauccaaagccuauucuaacuguuaccccuaugaugucccugacuacgcaucguugaggucacucguggccagcagugguacucuggaguuuaauaacgaauccuucaauuggacagggguuacccagaacggaacgucuagcgcuugcaagcggcgcuccaauaacucauuuuucagucgacugaauuggcucacucauuuaaaguuuaaauauccagcacugaacgugaccaugcccaacaaugagaaguucgauaaacuuuacaucuggggcguccaccauccuggcacagacaacgaucagauuuuucuuuaugcccaggcuagcgggcguaucacugugucuaccaagagaucccaacagacaguaauuccaaauaucggaucaaggccccggguucgcaacauaccuagcagaauuaguaucuacuggaccauugugaaaccaggugacauccugcuaaucaauucuacgggcaaccucauugccccgaggggguacuucaagauacgguccggaaagagcucgaucaugcgcucugaugcgcccauuggcaaauguaauuccgagugcaucacuccuaacgguucaauaccaaaugacaagcccuuucagaacgucaaucgaauuacauauggggcauguccuagauacgugaaacagaacagucugaaguuggccaccggaaugaggaaugugccagaaaaacaaacucggggcaucuucggcgcuaucgccggguuuauugagaacggaugggaagguauggucgacggcugguauggguuccgucaccagaauagcgagggaaucggccaggcagcugaucugaaguccacacaagccgcgauuaaccagauaaacgguaaauugaaucgccucaucgggaagaccaacgagaaguuccaccagauugaaaaagaguuuucugaaguugagggcagaauccaggaccuggaaaaguacguggaggauacgaaaaucgacuuauggagcuauaaugccgagcugcucguagcacuugaaaaccaacauaccauugaucugacagacucagagaugaauaaguuguucgaaaggacuaaaaagcagcuacgggagaacgcugaagauaugggaaauggcugcuuuaagauauaccacaaaugugacaacgccugcaucgggaguauucgaaauggaaccuaugaucaugacguguaccgcgaugaggcucugaacaauagauuccagaucaagggugucgagcucaaauccggcuacaaggacuggauucuguggaucagcuuugccauaucuugcuuccuucuguguguggcauugcucggguuuaucaugugggccugccagaaaggaaacauuagguguaauaucugcauuuga

SEQ ID NO: 124388 - RNA, 1701 nt, Artificial Sequence
  derived and/or modified sequence opt3 from hemagglutinin__InfluenzaA__ACH69580
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacgauuuucaaaacaaaaagugggaccuguucguggaaagauccaaagccuauucuaauuguuaccccuaugaugucccugacuacgcaucguugaggucacucguggccagcaguggcacucuggaguuuaacaaugaauccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgauaaacuuuacaucuggggaguccaccauccuggcacagacaaugaucagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagacauccugcuaaucaacucuacggguaaucucauugccccgaggggcuacuucaagauacgguccggaaagagcucgaucaugcgcucugacgcgcccauugggaaauguaacuccgagugcaucacuccuaauggcucaauaccaaacgauaagcccuuucagaaugucaaccgaauuacauauggugcauguccuagauacgugaaacagaauacccugaagcuggccacugggaugaggaacgugccagaaaaacaaacacggggaaucuucggcgcuaucgccggcuuuauugagaaugggugggaaggaauggucgacgguugguauggcuuccgucaccagaacagugaggggaucggacaggcagcugaucuuaagagcacccaagccgcgauuaaucagauaaacggcaaauugaaccgccucaucgguaagacgaaugagaaguuccaccagauugaaaaagaguuuuccgaaguugaggggagaauccaggaccuggaaaaguacguggaggauaccaaaaucgacuuauggucuuauaacgccgagcugcucguagcacuugaaaaucaacauacaauugaucugacugacagcgagaugaacaaguuguucgaaaggaccaaaaagcagcuacgggagaaugcugaagauaugggcaacggaugcuuuaagauauaccacaaaugugacaaugccugcaucggcucaauucgaaacgggacauaugaucaugacguguaccgcgacgaggcucugaauaacagauuccagaucaagggagucgagcucaaaagugguuacaaggauuggauucuguggaucuccuuugccauaagcugcuuccuucuguguguggcauugcucggcuuuaucaugugggccugccagaaagggaauauuagguguaacaucugcauuuga

SEQ ID NO: 124389 - RNA, 1701 nt, Artificial Sequence
  derived and/or modified sequence opt3 from hemagglutinin__InfluenzaA__ACH69591
augaagaccaucauugcccugagcuacauacucugccuugcuuucgcacagaaacugcccggcaacgacaauuccacagccacuuuguguuuagggcaccaugcggugccuaacggaacgcuggucaagaccaucacaaaugaucaaauugagguuacuaacgcuaccgaacuugugcagucuucaaguacagguagaaucugcgacagcccacaccagauucucgauggcgagaauuguacccugaucgacgcccuucugggggauccgcauugcgacggauuucagaacaaagaaugggauuuguucguagagagguccaaggcauauucuaauuguuaccccuaugacgugccugauuacgccucgcuccggucacuggucgcuagcaguggcacucuggaauuuaacaaugaguccuucaacuggacagguguggcacaaaaugggaccucuagcgccugcaaacgccgauccauaaacucauuuuucagucgucucaauugguuacaccagcugaaguauagauacccagcucuuaacguuacgaugcccaauaacgacaaguuugauaaauuguauaucuggggagugcaucacccuagcacugacucugaucagauuuccgucuacgcccaggcgucaggcagggugaccguaagcacaaagcggagucaacagacuguuaucccaaacauuggcucucgccccugggugagagggaucuccagcaggauaucgauuuacuggaccaucgucaaaccuggagacauucugcuaaucaauucuacagguaaccucaucgcaccacggggcuauuucaagauucgcuccgggaaaucaaguauaaugcgaagcgacgccccgaucggaaaguguaauuccgagugcauuacccccaacggcucuaucccuaaugauaagccauuucagaacgugaauagaauaacguacggugcuugucccagguaugugaaacagaacacucugaagcuagccacagggaugcggaaugucccugaaaaacaaacccguggaauuuucggcgcaaucgcuggcuuuaucgagaacgggugggaaggaaugauggacgguugguacggcuuccgccaccagaauagcgaggggacuggacaggccgcggaucugaagucaacacaagccgcaauuaaccagaucaauggcaaauugaacaagcucauugagaaaaccaaugaaaaguuucaucagauagagaacgaguucagugaaguugaagguagaauccaggaccuggagaaguauguggaggauacgaaaauugacuuaugguccuacaacgcugaacugcucguagcccuugagaaucaacacaccaucgaucugacagacagcgaaaugaacaaguuguucgagaggacucggaaacagcuacgagaaaaugcugaggauauggggaacggcugcuuuaagaucuaucauaaaugugacaaugccugcauuggaucuauacgcaacggcaccuacgaucacgacguguacagagacgaggcacugaauaacagguuccagaucaagggggucgaacucaagucaggauauaaagauuggauucuguggaucaguuuugccauuagcugcuuccuucugugugugguuuugcucgguuuuaucaugugggcuugccagaagggcaauauacgguguaacaucugcauuuga

SEQ ID NO: 124390 - RNA, 1701 nt, Artificial Sequence
  derived and/or modified sequence opt3 from hemagglutinin__InfluenzaA__ACH69602
augaagaccaucauugcccugagcuacauacucugccuugcuuucgcacagaaacugcccggcaacgacaauuccacagccacuuuguguuuagggcaccaugcggugccuaacggaacgcuggucaagaccaucacaaaugaucaaauugagguuacuaacgcuaccgaacuugugcagucuucaaguacagguagaaucugcgacagcccacaccagauucucgauggcgagaauuguacccugaucgacgcccuucugggggauccgcauugcgacggauuucagaacaaagaaugggauuuguucguagagagguccaaggcauauucuaauuguuaccccuaugacgugccugauuacgccucgcuccggucacuggucgcuagcaguggcacucuggaauuuaacaaugaguccuucaacuggacagguguggcacaaaaugggaccucuagcgccugcaaacgccgauccauaaacucauuuuucagucgucucaauugguuacaccagcugaaguauagauacccagcucuuaacguuacgaugcccaauaacgacaaguuugauaaauuguauaucuggggagugcaucacccuagcacugacucugaucagauuuccgucuacgcccaggcgucaggcagggugaccguaagcacaaagcggagucaacagacuguuaucccaaacauuggcucucgccccugggugagagggaucuccagcaggauaucgauuuacuggaccaucgucaaaccuggagacauucugcuaaucaauucuacagguaaccucaucgcaccacggggcuauuucaagauucgcuccgggaaaucaaguauaaugcgaagcgacgccccgaucggaaaguguaauuccgagugcauuacccccaacggcucuaucccuaaugauaagccauuucagaacgugaauagaauaacguacggugcuugucccagguaugugaaacagaacacucugaagcuagccacagggaugcggaaugucccugaaaaacaaacccguggaauuuucggcgcaaucgcuggcuuuaucgagaacgggugggaaggaaugauggacgguugguacggcuuccgccaccagaauagcgaggggacuggacaggccgcggaucugaagucaacacaagccgcaauuaaccagaucaauggcaaauugaacaagcucauugagaaaaccaaugaaaaguuucaucagauagagaaggaguucagugaaguugaagguagaauccaggaccuggagaaauauguggaggauacgaagauugacuuaugguccuacaacgcugaacugcucguagcccuugagaaccaacacaccaucgaucugacagacagcgaaaugaauaaauuguucgagaggacucggaagcagcuacgagaaaacgcugaggauauggggaauggcugcuuuaaaaucuaucauaagugugacaacgccugcauuggaucuauacgcaauggcaccuacgaucacgacguguacagagacgaggcacugaacaauagguuccagaucaagggggucgaacucaaaucaggauauaaggauuggauucuguggaucaguuuugccauuagcugcuuccuucugugugugguuuugcucgguuuuaucaugugggcuugccagaaaggcaacauacgguguaauaucugcauuuga

SEQ ID NO: 124391 - RNA, 1701 nt, Artificial Sequence
  derived and/or modified sequence opt3 from hemagglutinin__InfluenzaA__ACH69613
augaagaccaucauugcccugagcuacauacucugccuugcuuucgcacagaaacugcccggcaacgacaauuccacaccuacuuuguguuuagggcaccaugccgugccaaacggaacgcuggucaagaccaucacaaaugaucaaauugagguuacuaacgcgaccgagcuagugcagucuucaaguacagguggcaucugcgacagcccgcaccagauuaucgauggggaaaauuguacccucauagacgcucugcuuggagauccccauugcgacggcuuucagaacaaagaaugggaucuguucguagagagauccaaggccuauucuaauuguuacccuuaugacgugccagauuacgcaucguugaggucacucgucgccagcagugguacucuggaauuuaacaaugaguccuucaacuggacagggguggcucaaaauggaaccucuagcgcaugcaaacggcgcuccaucaacucauuuuucagucgacugaauuggcuccaccaguuaaaguaucguuaccccgcccugaacguuacgaugccuaauaacgacaaguuugauaaacuuuauauuuggggcgugcaucacccaagcacugacucugaucagaucuccgucuacgcucaggccucaggcagagugaccguaagcacaaagaggagucaacagacuguuauucccaacaucgggucucggccuugggugcgcggaauauccagcagaauuucgaucuacuggaccauugucaaaccaggugacaucuugcugaucaauucuacaggcaacccgauugcgcccaggggguauuucaagauacgguccggaaaaucaaguaucaugcgcagcgacgcaccuauuggcaaguguaauuccgagugcaucaccccaaacgguucuauacccaaugauaagccuuuucagaacgugaaucgaauuacguacggggccuguccaagauaugugaaacagaacacucuaaagcucgcuacaggaaugaggaauguccccgaaaaacaaacccggggcaucuucggcgccaucgcaggguuuauugagaacggaugggaagguaugauggacggcugguacgggcugcgucaccagaauagcgagggaacuggccaggcugccgaucuuaagucaacacaagcggccaucaaccagauuaaugguaaacugaacaaguugauagagaaaaccaaugaaaaguuccaucagaucgagaacgaauuuagugagguugaagggcgcauucaggaccucgagaaguauguggaggauacgaaaaucgaccugugguccuacaacgcagaauuacugguagcucucgagaaucaacacaccaucgaucuuacagacagcgaaaugaacaagcuguucgagagaacuaggaaacaguugcgggaaaaugccgaggauaugggcaacggaugcuucaagauuuaucauaaaugugacaaugcuugcauaggcucuauccgaaacgggaccuacgaucacgacguguaccgcgacgaggcccuaaauaacagauuucagauuaagggagucgaacugaagucagguuauaaagauuggauccucuggauuaguuucgcaaucagcugcuuucugcuuugugugguucuguugggcuucauaaugugggccugccagaaggggaauaucagguguaacauuugcaucuga

SEQ ID NO: 124392 - RNA, 1701 nt, Artificial Sequence; identical to SEQ ID NO: 122646
  derived and/or modified sequence opt3 from hemagglutinin__InfluenzaA__ACH82060

SEQ ID NO: 124393 - RNA, 1701 nt, Artificial Sequence; identical to SEQ ID NO: 124332
  derived and/or modified sequence opt3 from hemagglutinin__InfluenzaA__ACI06123

SEQ ID NO: 124394 - RNA, 1701 nt, Artificial Sequence; identical to SEQ ID NO: 124332
  derived and/or modified sequence opt3 from hemagglutinin__InfluenzaA__ACI06126

SEQ ID NO: 124395 - RNA, 1701 nt, Artificial Sequence; identical to SEQ ID NO: 124332
  derived and/or modified sequence opt3 from hemagglutinin__InfluenzaA__ACI06127

SEQ ID NO: 124396 - RNA, 1701 nt, Artificial Sequence; identical to SEQ ID NO: 124332
  derived and/or modified sequence opt3 from hemagglutinin__InfluenzaA__ACI06129

SEQ ID NO: 124397 - RNA, 1701 nt, Artificial Sequence; identical to SEQ ID NO: 124332
  derived and/or modified sequence opt3 from hemagglutinin__InfluenzaA__ACI06130

SEQ ID NO: 124398 - RNA, 1701 nt, Artificial Sequence; identical to SEQ ID NO: 124332
  derived and/or modified sequence opt3 from hemagglutinin__InfluenzaA__ACI06132

SEQ ID NO: 124399 - RNA, 1701 nt, Artificial Sequence; identical to SEQ ID NO: 124334
  derived and/or modified sequence opt3 from hemagglutinin__InfluenzaA__ACI06133

SEQ ID NO: 124400 - RNA, 1701 nt, Artificial Sequence; identical to SEQ ID NO: 124334
  derived and/or modified sequence opt3 from hemagglutinin__InfluenzaA__ACI06134

SEQ ID NO: 124401 - RNA, 1701 nt, Artificial Sequence; identical to SEQ ID NO: 124334
  derived and/or modified sequence opt3 from hemagglutinin__InfluenzaA__ACI06135

SEQ ID NO: 124402 - RNA, 1701 nt, Artificial Sequence; identical to SEQ ID NO: 124334
  derived and/or modified sequence opt3 from hemagglutinin__InfluenzaA__ACI06136

SEQ ID NO: 124403 - RNA, 1701 nt, Artificial Sequence; identical to SEQ ID NO: 124334
  derived and/or modified sequence opt3 from hemagglutinin__InfluenzaA__ACI06137

SEQ ID NO: 124404 - RNA, 1701 nt, Artificial Sequence; identical to SEQ ID NO: 124334
  derived and/or modified sequence opt3 from hemagglutinin__InfluenzaA__ACI06138

SEQ ID NO: 124405 - RNA, 1701 nt, Artificial Sequence; identical to SEQ ID NO: 124334
  derived and/or modified sequence opt3 from hemagglutinin__InfluenzaA__ACI06139

SEQ ID NO: 124406 - RNA, 1701 nt, Artificial Sequence; identical to SEQ ID NO: 124334
  derived and/or modified sequence opt3 from hemagglutinin__InfluenzaA__ACI06140

SEQ ID NO: 124407 - RNA, 1701 nt, Artificial Sequence; identical to SEQ ID NO: 124334
  derived and/or modified sequence opt3 from hemagglutinin__InfluenzaA__ACI06141

SEQ ID NO: 124408 - RNA, 1701 nt, Artificial Sequence; identical to SEQ ID NO: 124334
  derived and/or modified sequence opt3 from hemagglutinin__InfluenzaA__ACI06142

SEQ ID NO: 124409 - RNA, 1701 nt, Artificial Sequence; identical to SEQ ID NO: 124334
  derived and/or modified sequence opt3 from hemagglutinin__InfluenzaA__ACI06143

SEQ ID NO: 124410 - RNA, 1701 nt, Artificial Sequence
  derived and/or modified sequence opt3 from hemagglutinin__InfluenzaA__ACI06144
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaacuccaaugggaaccucaucgccccgaggggauacuuuaaaaugcggacuggcaagagcucgaucaugcgcucugacgcucccauugauacauguauauccgagugcaucaccccuaauggcucaauuccaaacgacaaacccuuccagaauguuaacaagaucacguacggggccuguccuaaauaugugaagcagaauacccugaaacuugcgacaggaaugcgaaacguaccagaaaagcagacuagaggucuguuuggcgcaauagccggguucauugagaauggaugggaaggcaugaucgaugguugguacggguuuaggcaccaaaacagugagggcaccggacaggcugccgaccuuaagagcacacaggcagcuaucgaucaaauuaauggcaaacucaaccgggugaucgagaagacuaaugaaaaauuccaccagauugagaaggaguucuccgaagucgaagggcguauacaggaccuggagaaauauguggaggauaccaagaucgacuuauggucuuacaacgccgaacugcucguugcgcuugagaaucagcauacaauugaucugaccgacagcgaaaugaaccgcuuguuugagaagacuagaaggcaacuacgggaaaacgccgaggauaugggaaaugguugcuucaaaaucuaucacaagugugacaacgcaugcaucgagucaauucgaaauggcacguacgaccaugauguguaucgcgacgaagcucugaacaauagauuucagauaaaaggggucgagcucaagaguggauacaaagauuggauccuguggauuuccuucgccaucagcugcuuucuucugugugugguauugcucggcuucauuaugugggcuugccagagggguaacauccgguguaauauaugcaucuga

SEQ ID NO: 124411 - RNA, 1701 nt, Artificial Sequence; identical to SEQ ID NO: 124334
  derived and/or modified sequence opt3 from hemagglutinin__InfluenzaA__ACI06145

SEQ ID NO: 124412 - RNA, 1701 nt, Artificial Sequence
  derived and/or modified sequence opt3 from hemagglutinin__InfluenzaA__ACI06146
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucaagcccuuggguccggggccugaguucucgcauauccauuuauuggaccaucgugaagccaggugacgugcuagucauuaacagcaaugggaaccucaucgccccgagaggauacuuuaaaaugaggacuggcaagucgucuaucaugcgguccgacgcucccauugauacauguauaucagagugcaucaccccuaauggcaguauuccaaacgacaaacccuuccagaauguuaacaagaucacguacggggccuguccuaaauaugugaagcagaauacccugaaacuugcgacaggaaugcgcaacguaccagaaaagcagacucgaggucuguuuggcgcaauagccggguucauugagaauggaugggaaggcaugaucgaugguugguacggguuuagacaccaaaacuaugagggcaccggacaggcugccgaccuuaagagcacacaggcagcuaucgaucaaauuaauggcaaacucaacagggugaucgagaagacuaaugaaaaauuccaccagauugagaaggaguucuccgaagucgaagggcggauacaggaccuggagaaauacguggaggauaccaagaucgacuuauggucuuauaacgccgaacugcucguugcgcuugagaaucagcauacaauugaucugaccgacagcgaaaugaacaaguuguuugagaaaacucgucgccaacuaagagaaaacgccgaggauaugggaaaugguugcuucaagaucuaccacaaaugugacaacgcaugcaucgagucaauuaggaauggcacguaugaccaugauguguaccgggacgaagcucugaacaaucgauuucagauaaagggggucgagcucaaaaguggauacaaggauuggauccuguggauuuccuucgccaucagcugcuuucuucugugugugguauugcucggcuucauuaugugggcuugccagcgcgguaacaucagauguaauauaugcaucuga

SEQ ID NO: 124413 - RNA, 1701 nt, Artificial Sequence; identical to SEQ ID NO: 124334
  derived and/or modified sequence opt3 from hemagglutinin__InfluenzaA__ACI06147

SEQ ID NO: 124414 - RNA, 1701 nt, Artificial Sequence; identical to SEQ ID NO: 124334
  derived and/or modified sequence opt3 from hemagglutinin__InfluenzaA__ACI06148

SEQ ID NO: 124415 - RNA, 1701 nt, Artificial Sequence
  derived and/or modified sequence opt3 from hemagglutinin__InfluenzaA__ACI06149
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccggcagacaaucauucccaacaucggaucacgcccuugggucagaggccugagcaguaggauaucuauuuauuggaccaucgugaagccaggugacgugcuagucauuaacuccaaugggaaccucaucgccccgcggggauacuuuaaaaugcgcacuggcaagagcucgaucaugcgaucugacgcucccauugauacauguauauccgagugcaucaccccuaauggcucaauuccaaacgacaaacccuuccaaaauguuaacaagaucacguacggggccuguccuaaauaugugaagcagaauacccugaaacuugcgacaggaaugagaaacguaccagaaaagcagacuaggggucuguuuggcgcaauagccggguucauugagaauggaugggaaggcaugaucgaugguugguacggguuucggcaccagaacagugagggcaccggacaagcugccgaccuuaagagcacacaggcagcuaucgaucagauuaauggcaaacucaaccgugugaucgagaagacuaaugaaaaauuccaccaaauugagaaggaguucuccgaagucgaagggcgcauacaggaccuggagaaauauguggaggauaccaagaucgacuuauggucuuacaacgccgaacugcucguugcgcuugagaaucagcauacaauugaucugaccgacagcgaaaugaacaaguuguuugagaaaacuagaaggcagcuacgggaaaacgccgaggauaugggaaaugguugcuucaagaucuaucacaaaugugacaacgcaugcaucgagucaauucgaaauggcacguacgaccaugauguguaucgcgacgaagcucugaacaauagauuucaaauaaagggggucgagcucaaaaguggauacaaggauuggauccuguggauuuccuucgccaucagcugcuuucuucugugugugguauugcucggcuucauuaugugggcuugccagagggguaacauccgguguaauauaugcaucuga

SEQ ID NO: 124416 - RNA, 1701 nt, Artificial Sequence; identical to SEQ ID NO: 124345
  derived and/or modified sequence opt3 from hemagglutinin__InfluenzaA__ACI06151

SEQ ID NO: 124417 - RNA, 1701 nt, Artificial Sequence; identical to SEQ ID NO: 124345
  derived and/or modified sequence opt3 from hemagglutinin__InfluenzaA__ACI06152

SEQ ID NO: 124418 - RNA, 1701 nt, Artificial Sequence
  derived and/or modified sequence opt3 from hemagglutinin__InfluenzaA__ACI06153
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgagcuagugauuaacuccaaugggaaccucaucgccccgaggggauacuuuaaaaugcggacuggcaagagcucgaucaugcgcucugacgcucccauugauacauguauauccgaaugcaucaccccuaauggcucaauuccaaacgacaaacccuuccagaaugucaacaagaucacguacggggccuguccuaaauauguuaagcagaauacccugaaacuugcgacaggaaugcgaaacgugccagagaaacagacuagaggucuguuuggcgcaauagccggguucauugaaaauggaugggagggcaugaucgaugguugguacggguuuaggcaccaaaacagugagggcaccggacaggcugccgaccuuaagagcacacaggcagcuaucgaucaaauuaauggcaaacucaaccggguaaucgaaaagacuaaugagaaauuccaccagauugaaaaggaguucuccgaaguggaggggcguauacaggaccuggagaaauaugucgaagauaccaagaucgacuuauggucuuacaacgccgagcugcucguggcgcuugaaaaucagcauacaauugaucugaccgacagcgagaugaacaaguuguuugaaaagacucgcagacaacuaagggagaacgccgaggauaugggaaaugguugcuucaagaucuaucacaaaugugacaacgcaugcaucgaaucaauucggaauggcacguacgaccaugauguuuaucgagacgaggcucugaacaaucgcuuucagauaaaggggguggaacucaaaaguggauacaaggauuggauccuguggauuuccuucgccaucagcugcuuucuucugugugucguguugcucggcuucauuaugugggcuugccagagagguaacaucagguguaauauaugcaucuga

SEQ ID NO: 124419 - RNA, 1701 nt, Artificial Sequence
  derived and/or modified sequence opt3 from hemagglutinin__InfluenzaA__ACI06155
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucgagucacggccuuggguccgcggacugagcaguagaauaucuauuuauuggaccaucgugaagccaggcgacgugcuagucauuaacuccaaugguaaccucaucgccccgaggggguacuuuaaaaugcggacuggaaagagcucgaucguucgcucugacgcucccauugauacauguauauccgaaugcaucaccccuaauggcucaauuccaaacgacaaacccuuccagaaugugaacaagaucacguacggcgccuguccuaaauauguaaagcagaauacccugaaacuugcgacagggaugcgaaacgugccagagaaacagacuagaggacuguuuggugcaauagccggcuucauugaaaaugggugggagggaaugaucgauggcugguacgguuuuaggcaccaaaacagugaggggaccggccaggcugccgaccuuaagagcacacaggcagcuaucgaucaaauuaauggaaaacucaaccgggucaucgaaaagacuaaugagaaauuccaccagauugaaaaggaguucuccgaaguggagggccguauacaggaccuggagaaauauguugaagauaccaagaucgacuuauggucuuacaacgccgagcugcucguggcgcuugaaaaucagcauacaauugaucugaccgacagcgagaugaacaaguuguuugaaaagacucgcagacaacuaagggagaacgccgaggauauggggaauggaugcuucaagaucuaucacaaaugugacaacgcaugcaucgaaucaauucggaaugguacguacgaccaugaugucuaucgagacgaggcucugaacaaucgcuuucagauaaagggcguggaacucaaaaguggguacaaggauuggauccuguggauuuccuucgccaucagcugcuuucuucuguguguaguuuugcucggauucauuaugugggcuugccagagaggcaacaucagguguaauauaugcaucuga

SEQ ID NO: 124420 - RNA, 1701 nt, Artificial Sequence; identical to SEQ ID NO: 124345
  derived and/or modified sequence opt3 from hemagglutinin__InfluenzaA__ACI06156

SEQ ID NO: 124421 - RNA, 1701 nt, Artificial Sequence; identical to SEQ ID NO: 124345
  derived and/or modified sequence opt3 from hemagglutinin__InfluenzaA__ACI06157

SEQ ID NO: 124422 - RNA, 1701 nt, Artificial Sequence; identical to SEQ ID NO: 124345
  derived and/or modified sequence opt3 from hemagglutinin__InfluenzaA__ACI06158

SEQ ID NO: 124423 - RNA, 1701 nt, Artificial Sequence; identical to SEQ ID NO: 124345
  derived and/or modified sequence opt3 from hemagglutinin__InfluenzaA__ACI06159

SEQ ID NO: 124424 - RNA, 1701 nt, Artificial Sequence; identical to SEQ ID NO: 124334
  derived and/or modified sequence opt3 from hemagglutinin__InfluenzaA__ACI06160

SEQ ID NO: 124425 - RNA, 1701 nt, Artificial Sequence
  derived and/or modified sequence opt3 from hemagglutinin__InfluenzaA__ACI06161
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucgagucacggccuuggguccgcggacugagcaguagaauaucuauuuauuggaccaucgugaagccaggcgacgugcuagucauuaacuccaaugguaaccucaucgccccgaggggguacuuuaaaaugcggacuggaaagagcucgaucaugcgcucugacgcucccauugauacauguauauccgaaugcaucaccccuaauggcucaauuccaaacgacaaacccuuccagaauguuaacaagaucacguacggcgccuguccuaaauaugugaagcagaauacccugaaacuugcgacagggaugcgaaacguaccagagaaacagacuagaggacuguuuggugcaauagccggcuucauugaaaaugggugggagggaaugaucgauggcugguacgguuuuaggcaccaaaacagugaggggaccggccaggcugccgaccuuaagagcacacaggcagcuaucgaucaaauuaauggaaaacucaaccgggugaucgaaaagacuaaugagaaauuccaccagauugaaaaggaguucuccgaagucgagggccguauacaggaccuggagaaauauguggaagauaccaagaucgacuuauggucuuacaacgccgagcugcucguugcgcuugaaaaucagcauacaauugaucugaccgacagcgagaugaacaaguuguuugaaaagacucgcagacaacuaagggagaacgccgaggauauggggaauggaugcuucaagaucuaucacaaaugugacaacgcaugcaucgaaucaauucggaaggguacguacgaccaugauguguaucgagacgaggcucugaauaaccgcuuucagauaaaaggcgucgaacucaagaguggguacaaggauuggauccuguggauuuccuucgccaucagcugcuuucuucugugugugguauugcucggauucauuaugugggcuugccagagaggcaauaucagguguaacauaugcaucuga

SEQ ID NO: 124426 - RNA, 1701 nt, Artificial Sequence
  derived and/or modified sequence opt3 from hemagglutinin__InfluenzaA__ACI06162
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccagucuuuacguacaggcaagcgggcguguuacggugucuacuagaaggucccagcaaacaaucauucccaacaucgagucacggccuuggguccgcggacugagcaguagaauaucuauuuauuggaccaucgugaacccaggcgacgugcuagucauuaauuccaacgguaaucucaucgccccgaggggguacuuuaagaugcggacuggaaaaagcucgaucaugcgcucugacgcucccauugauacauguauauccgaaugcaucaccccuaacggcucaauuccaaaugacaagcccuuccagaacguuaauaaaaucacguacggcgccuguccuaaguaugugaaacagaacacccugaaacuugcgacagggaugcgaaauguaccagagaagcagacuagaggacuguuuggugcaauagccggcuucauugaaaacgggugggagggaaugaucgauggcugguacgguuuuaggcaccaaaauagugaggggaccggccaggcugccgacuugaaaagcacacaggcagcuaucgaucaaauuaacggaaagcucaaucgggugaucgaaaagacuaacgagaaguuccaccagauugaaaaagaguucuccgaagucgagggccguauacaggaccuggagaaguauguggaagauaccaaaaucgacuuauggucuuacaaugccgagcugcucguugcgcuugaaaaccagcauacaauugaucugaccgacagcgagaugaacaaguuguuugaaaagacucgcagacaacuaagggagaaugccgaggauauggggaacggaugcuucaaaaucuaucacaagugugacaaugcaugcaucgaaucaauucggaacgguacguacgaccaugauguguaucgagacgaggcucugaauaaccgcuuucagauaaaaggcgucgaacucaagaguggguacaaagauuggauccuguggauuuccuucgccaucagcugcuuucuucugugugugguauugcucggauucauuaugugggcuugccagagaggcaauaucagguguaacauaugcaucuga

SEQ ID NO: 124427 - RNA, 1701 nt, Artificial Sequence
  derived and/or modified sequence opt3 from hemagglutinin__InfluenzaA__ACI06163
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaacuccaaugggaaccucaucgccccgaggggauacuuuaaaaugcggacuggcaagagcucgaucaugcgcucugacgcucccauugauacauguauauccgagugcaucaccccuaauggcucaauuccaaacgacaaacccuuccagaauguuaacaagaucacguacggggccuguccuaaauaugugaagcagaauacccugaaacuugcgacaggaaugcgaaacguaccagaaaagcagacuagaggucuguuuggcgcaauagccggguucauugagaauggaugggaaggcaugaucgaugguugguacggguuuaggcaccaaaacagugagggcaccggacaggcugccgaccuuaagagcacacaggcagcuaucgaucaaauuaauggcaaacucaaccgggugaucgagaagacuaaugaaaaauuccaccagauugagaaggaguucuccgaagucgaagggcguauacaggaccuggagaaauauguggaggauaccaagaucgacuuauggucuuacaacgccgaacugcucguugcgcuugagaaucagcauacaauugaucugaccgacagcgaaaugaacaaguuguuugagaaaacucgcagacaacuaagggaaaacgccgaggauaugggaaaugguugcuucaagaucuaucacaaaugugacaacgcaugcaucgagucaauucggaagggcacguacgaccaugauguguaucgagacgaagcucugaauaaccgcuuucagauaaaaggggucgagcucaagaguggauacaaggauuggauccuguggauuuccuucgccaucagcugcuuucuucugugugugguauugcucggcuucauuaugugggcuugccagagagguaauaucagguguaacauaugcaucuga

SEQ ID NO: 124428 - RNA, 1701 nt, Artificial Sequence
  derived and/or modified sequence opt3 from hemagglutinin__InfluenzaA__ACI06164
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaacuuuauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaaacauuuauuggaccaucgugaagccaggugacgugcuagucauuaauucuaacgggaaucucaucgccccgaggggauacuuuaagaugcggaacggcaaguccagcaucaugcgcucggacgcucccauugauacuuguauaucugagugcaucacaccuaauggcuccauuccaaacgacaaacccuuccagaauguuaacaagaucaccuacggggccuguccuaaauaugugaagcagaauacgcugaaacuugcgaccggaaugcgaaacguaccagaaaagcagacaagaggucuguuuggcgcaauagccggguucauugagaauggaugggaaggcaugaucgaugguugguacggguuuaggcaccaaaacucagagggcacuggacaggcugccgacuugaagaguacccaggcagcuaucgaucaaauuaauggcaaacucaaccgggugaucgagaagacaaaugaaaaauuccaccagauugagaaggaguucagcgaagucgaagggcguauacaggaccuggagaaauauguggaggauacuaagaucgacuuaugguccuacaacgccgaacugcucguugcgcuugagaaccagcauaccauugaucugacagacucugaaaugaauaaguuguuugagaaaacccgcagacaacuaagggaaaacgccgaggauaugggaaaugguugcuucaagaucuaucacaaaugugacaacgcaugcaucgagagcauucggaauggcacuuacgaccaugauguguaucgagacgaagcucugaacaaucgcuuucagauaaagggggucgagcucaaaucaggauacaaggauuggauccuguggauuaguuucgccaucuccugcuuucuucugugugugguauugcucggcuucauuaugugggcuugccagagagguaacaucagguguaauauaugcaucuga

SEQ ID NO: 124429 - RNA, 1701 nt, Artificial Sequence
  derived and/or modified sequence opt3 from hemagglutinin__InfluenzaA__ACI06165
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaacuccaaugggaaccucaucgccccgaggggauacuuuaaaaugcggaauggcaagagcucgaucaugcgcucugacgcucccauugauacuuguauauccgagugcaucacaccuaacggcucaauuccaaaugacaaacccuuccagaacguuaauaagaucaccuacggggccuguccuaaauaugugaagcagaacacgcugaaacuugcgaccggaaugcgaaauguaccagaaaagcagacaagaggucuguuuggcgcaauagccggguucauugagaacggaugggaaggcaugaucgaugguugguacggguuuaggcaccaaaauagugagggcacuggacaggcugccgaccuuaagagcacccaggcagcuaucgaucaaauuaacggcaaacucaaucgggugaucgagaagacaaacgaaaaauuccaccagauugagaaggaguucuccgaagucgaagggcguauacaggaccuggagaaauauguggaggauacuaagaucgacuuauggucuuacaaugccgaacugcucguugcgcuugagaaccagcauaccauugaucugacagacagcgaaaugaacaaguuguuugagaaaacccgcagacaacuaagggaaaaugccgaggauaugggaaacgguugcuucaagaucuaucacaaaugugacaaugcaugcaucgagucaauucggaacggcacuuacgaccaugauguguaucgagacgaagcucugaauaaccgcuuucagauaaagggggucgagcucaaaaguggauacaaggauuggauccuguggauuuccuucgccaucagcugcuuucuucugugugugguauugcucggcuucauuaugugggcuugccagagagguaauaucagguguaacauaugcaucuga

SEQ ID NO: 124430 - RNA, 1701 nt, Artificial Sequence
  derived and/or modified sequence opt3 from hemagglutinin__InfluenzaA__ACI06166
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaacuuuauauuuggggcgugcaccauccaucaacaaaucaagagcagaccaguuuguacguacaggcaagcgggcguguuacggugucuacuagaaggucccagcaaacaaucauucccaacaucggaucacggccuuggauacgcggccugagcaguagaauuaacaucuauuggaccauugucaagccaggugacgugcuagugaucaauucuaacgggaaucucaucgccccgaggggauacuuuaagaugcggaacggcaaguccagcauuaugcgcucggacgcucccauagauacuuguaucucugagugcauuacaccuaauggcuccaucccaaacgacaaacccuuccagaaugucaacaagauaaccuacggggccuguccuaaauauguuaagcagaauacgcugaaacuugcgaccggaaugcgaaacgugccagaaaagcagacaagaggucuguuuggcgcaauugccggguucaucgagaauggaugggaaggcaugaucgaugguugguacggguuuaggcaccaaaacucagagggcacuggacaggcugccgacuugaagaguacccaggcagcuauugaucaaaucaauggcaaacucaaccggguaauugagaagacaaaugaaaaauuccaccagauagagaaggaguucagcgaaguggaagggcguauccaggaccuggagaaauaugucgaggauacuaagauugacuuaugguccuacaacgccgaacugcucguggcgcuugagaaccagcauaccaucgaucugacagacucugaaaugaauaaguuguuugagaaaacccgcagacaacuaagggaaaacgccgaggauaugggaaaugguugcuucaagaucuaucacaaaugugacaacgcaugcauugagagcauacggaauggcacuuacgaccaugauguuuaucgagacgaagcucugaacaaucgcuuucagaucaaggggguggagcucaaaucaggauacaaggauuggauucuguggaucaguuucgccauuuccugcuuucuucugugugucguguugcucggcuucaucaugugggcuugccagagagguaacauaagguguaauaucugcauuuga

SEQ ID NO: 124431 - RNA, 1701 nt, Artificial Sequence; identical to SEQ ID NO: 124415
  derived and/or modified sequence opt3 from hemagglutinin__InfluenzaA__ACI06167

SEQ ID NO: 124432 - RNA, 1701 nt, Artificial Sequence
  derived and/or modified sequence opt3 from hemagglutinin__InfluenzaA__ACI06168
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaacuccaaugggaaccucaucgccccgaggggauacuuuaaaaugcggacuggcaagagcucgaucaugcgcucugacgcucccauugauacauguauauccgagugcaucaccccuaauggcucaauuccaaacgacaaacccuuccagaauguuaacaagaucacguacggggccuguccuaaauaugugaagcagaauacccugaaacuugcgacaggaaugcgaaacguaccagaaaagcagacuagaggucuguuuggcgcaauagccggguucauugagaauggaugggaaggcaugaucgaugguugguacggguuuaggcaccaaaacagugagggcaccggacaggcugccgaccuuaagagcacacaggcagcuaucgaucaaauuaauggcaaacucaaccgggugaucgagaagacuaaugaaaaauuccaccagauugagaaggaguucuccgaagucgaagggcguauacaggaccuggagaaauauguggaggauaccaagaucgacuuauggucuuacaacgccgaacugcucguugcgcuugagaaucagcauacaauugaucugaccgacagcgaaaugaacaaguuguuugagaaaacucgcaagcaacuaagagaaaacgccgaggauaugggaaaugguugcuucaaaaucuaucacaagugugacaacgcaugcaucgagucaauuaggaauggcacguacgaccaugauguguaucgggacgaagcucugaacaaucgauuucagauaaaaggggucgagcucaagaguggauacaaggauuggauccuguggauuuccuucgccaucagcugcuuucuucugugugugguauugcucggcuucauuaugugggcuugccagcgcgguaacaucagauguaauauaugcaucuga

SEQ ID NO: 124433 - RNA, 1701 nt, Artificial Sequence; identical to SEQ ID NO: 124334
  derived and/or modified sequence opt3 from hemagglutinin__InfluenzaA__ACI06169

SEQ ID NO: 124434 - RNA, 1701 nt, Artificial Sequence; identical to SEQ ID NO: 124351
  derived and/or modified sequence opt3 from hemagglutinin__InfluenzaA__ACI06171

SEQ ID NO: 124435 - RNA, 1701 nt, Artificial Sequence; identical to SEQ ID NO: 124351
  derived and/or modified sequence opt3 from hemagglutinin__InfluenzaA__ACI06172

SEQ ID NO: 124436 - RNA, 1701 nt, Artificial Sequence
  derived and/or modified sequence opt3 from hemagglutinin__InfluenzaA__ACI06173
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagagauuaacuccaaugggaaccucaucgccccgaggggauacuuuaaaaugcggacuggcaagagcucgaucaugcgcucugacgcucccauugauacauguauauccgaaugcaucaccccuaauggcucaauuccaaacgacaaacccuuccagaaugucaacaagaucacguacggggccuguccuaaauauguuaagcagaauacccugaaacuugcgacaggaaugcgaaacgugccagagaaacagacuagaggucuguuuggcgcaauagccggguucauugaaaauggaugggagggcaugaucgaugguugguacggguuuaggcaccaaaacagugagggcaccggacaggcugccgaccuuaagagcacacaggcagcuaucgaucaaauuaauggcaaacucaaccggguaaucgaaaagacuaaugagaaauuccaccagauugaaaaggaguucuccgaaguggaggggcguauacaggaccuggagaaauaugucgaagauaccaagaucgacuuauggucuuacaacgccgagcugcucguggcgcuugaaaaucagcauacaauugaucugaccgacagcgagaugaacaaguuguuugaaaagacucgcagacaacuaagggagaacgccgaggauaugggaaaugguugcuucaagaucuaucacaaaugugacaacgcaugcaucgaaucaauucggaauggcacguacgaccaugauguuuaucgagacgaggcucugaacaaucgcuuucagauaaaggggguggaacucaaaaguggauacaaggauuggauccuguggauuuccuucgccaucagcugcuuucuucugugugucguguugcucggcuucauuaugugggcuugccagagagguaacaucagguguaauauaugcaucuga

SEQ ID NO: 124437 - RNA, 1701 nt, Artificial Sequence; identical to SEQ ID NO: 124351
  derived and/or modified sequence opt3 from hemagglutinin__InfluenzaA__ACI06174

SEQ ID NO: 124438 - RNA, 1701 nt, Artificial Sequence; identical to SEQ ID NO: 124352
  derived and/or modified sequence opt3 from hemagglutinin__InfluenzaA__ACI06175

SEQ ID NO: 124439 - RNA, 1701 nt, Artificial Sequence; identical to SEQ ID NO: 124352
  derived and/or modified sequence opt3 from hemagglutinin__InfluenzaA__ACI06176

SEQ ID NO: 124440 - RNA, 1701 nt, Artificial Sequence; identical to SEQ ID NO: 124352
  derived and/or modified sequence opt3 from hemagglutinin__InfluenzaA__ACI06177

SEQ ID NO: 124441 - RNA, 1689 nt, Artificial Sequence
  derived and/or modified sequence opt3 from hemagglutinin__InfluenzaA__ACI25724
auggccaucauuuaccugauacuccuuuucgcuaccgugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauucccccucuagaacucggcgauugcuccauagcgggguggcugcuuggaaauccagagugugaccggcuguugcgcguaccggaauggucuuacaucauggagcgagagaacccccguuauucacucugcuacccuggcagucugaaugauuaugaagaacugaaacaucucuuaagcuccgugaagcacuuugaaaaggucagaauccugccaaaagacagguggacucaacauaccacaaccggugggucuaaggcuugugccgugucgggaaaacccucauucuuucggaacaugguuuggcuuacuaagaaaggcccuaauuacccaguggcaaagggcagcuauaacaauacaaguggggagcagauguugaucauuuggggaguccaccaccccaaggaugaggccgaacagcgcgcucuguaccaggagguggguaccuacguauccgcaucuacgagcacucuaaacaaaagauccaucccugaaauagccgcuaggccagagguuaauggccucgggucacggauggaauuuaguuggacccugcuugacgugugggauacaauuaacuucgagagcacuggaaaucuggucgccccggaguauggcuucaagaucucuaaacgcgguuccucagggauuaugaagaccgaaggaacauugggcaacugcgagaccaaaugucaaacgccccucggcgcgaucaacacuacacugccuuuucauaaugugcacccauuaaccaucggggaaugccccaaguacgugaaaagcgagaagcugguccucgcaacuggacuucgaaacguuccucagauugaaaguagaggucuguucggcgccauagcuggguuuaucgagggaggcuggcaggguaugguggacgggugguauggcuaccaucacucuaaugaucagggauccggcuaugccgcagacaaggagagcacacaaaaggcuuucgaugggauuaccaacaaaguaaauucggugaucgaaaagaugaacacgcaguuugaggccgucggaaaagaguucaauaacuuggagaaaaggcuagaaaaucugaacaagaagauggaggacgguuuucucgacguguggaccuacaaugcggagcugcuuguucugauggaaaacgagcggacauuggauuuccacgacucuaaugugaaaaaccucuaugaaaagguccguaugcagcugcgcgauaaugugaaagaguuaggcaacggguguuucgaguuuuaccauaagugcgacgaugaauguaugaacuccguuaaaaauggaacuuacgacuauccaaaguacgaggaagagucaaagcugaaaagaaacgaaauaaagggcguaaaacuaaguagcauggguguguaucagauucucgccaucuacgcaaccgucgcugggucccugucucuugccaucaugguggcuggcauuagcuucuggaugugcucaaauggaaguuugcaaugcaggaucuguauuuga

SEQ ID NO: 124442 - RNA, 1701 nt, Artificial Sequence
  derived and/or modified sequence opt3 from hemagglutinin__InfluenzaA__ACI25746
augaagaccaucauugcccugagcuacauauucugccucgcucuuggccaguaucugcccgggaacgacaauuccacagcaacuuuguguuuaggacaccaugccgugccuaacgguacgcuggucaaaaccaucacagaugaccaaauugagguuacuaaugcgaccgaacuugugcagucuucaaguacaggcaagaucugcaacaauccacacaggauucucgaugggaucgacuguacccugauagaugcucuacugggagacccgcauugcgauguauuucagaacgagacuugggacuuguucguggaaagaagcaaagccuuuuccaauuguuaccccuaugaugucccugacuacgcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaucccgugcugaaugucaccaugccuaacaaugauaacuucgacaaguuguacauuuggggcgugcaccauccaucaacaaaucaagagcagaccaguuuguauguacaggcaagcgggcguguuacggugucuacuagaaggucccagcaaacaaucauucccaacaucggaucacggccuuggguccgcggccugagcaguagaauaucuauuuacuggaccaucgugaagccaggugaugugcuagucauugacuccaacgggaaucucaucgccccgaggggauacuuuaaaaugcggacuggcaagagcucgaucaugcgcucugacgcucccauugauacauguauauccgagugcaucaccccuaacggcucaauuccaaaugacaaacccuuccagaacguuaauaagaucacguauggggccuguccuaaauacgugaagcagaacacccugaaacuugcgacaggaaugcgaaauguaccagaaaagcagacuagaggucuguuuggcgcaauagccggguucauugagaacggaugggaaggcaugaucgaugguugguauggguuuaggcaccaaaauagugagggcaccggacaggcugccgaccuuaagagcacacaggcagcuaucgaucaaauuaacggcaaacucaaucgggugaucgagaagacuaacgaaaaauuccaccagauugagaaggaguucuccgaagucgaagggcguauacaggaccuggagaaauacguggaggauaccaagaucgacuuauggucuuauaaugccgaacugcucguugcgcuugagaaccagcauacaauugaucugaccgacagcgaaaugaauaaguuguuugagaaaacucgcagacaacuaagggaaaacgccgaggauaugggaaacgguugcuucaagaucuaccacaaaugugacaaugcaugcaucgagucaauucggaacggcacguaugaccaugauguguaccgagacgaagcucugaauaaccgcuuucagauaaagggggucgagcucaaaaguggauacaaggauuggauccuguggauuuccuucgccaucagcugcuuucuucugugugugguauugcucggcuucauuaugugggcuugccagagagguaauaucagguguaacauaugcaucuga

SEQ ID NO: 124443 - RNA, 1701 nt, Artificial Sequence
  derived and/or modified sequence opt3 from hemagglutinin__InfluenzaA__ACI25757
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccuggugcuuaaugucaccaugcccaacaaugacaacuucgauaaguuguauauuuggggcgugcaccauccuucaacaaaucaagagcagaccagucuguacguacaggcaagcgggcguguuacggugucuacuagaaggucccagcaaacaaucauuccaaacaucggaucacggcccuggguccgcggccuaagcaguagaauaucuauuuauuggaccaucgugaagccuggugacgugcucgucauuaacuccaaugggaaccugaucgccccaaggggauacuuuaaaaugcggacuggcaagagcucgaucaugcgcucugacgcuccgauugauacauguauauccgagugcaucacccccaauggcucaauuccuaacgacaaaccauuccagaauguuaacaagaucacguacggggccugucccaaauaugugaagcagaauacccuuaagcuggcgacaggaaugcgaaacguaccugaaaaacagacuagagguuuguuuggcgcaauagccggguucauugagaauggaugggaaggcaugaucgaugguugguacggguuuaggcaccaaaacagugagggcaccggacaggcugccgaccucaagagcacacaggcagcuaucgaucaaauuaauggcaaacugaaccgggugaucgagaagacuaaugaaaaauuccaccagauugagaaggaguucuccgaagucgaagggcguauacaggacuuagagaaauauguggaggauaccaagaucgaccuguggucuuacaacgccgaacuccuuguugcgcuggagaaucagcauacaauugauuugaccgacagcgaaaugaacaagcuauuugagaaaacucgcagacaacugagggaaaacgccgaggauaugggaaaugguugcuucaagaucuaucacaaaugugacaacgcaugcaucgagucaauucggaauggcacguacaaccaugacguguaucgagaugaagcucucaauaaccgcuuucagauaaagggggucgagcugaaaaguggauacaaggacuggauccuuuggauuuccuucgccaucagcugcuuucuguugugugugguacuccugggcuucauuaugugggcuugccagagagguaauaucagguguaacauaugcaucuga

SEQ ID NO: 124444 - RNA, 1701 nt, Artificial Sequence; identical to SEQ ID NO: 124332
  derived and/or modified sequence opt3 from hemagglutinin__InfluenzaA__ACI25768

SEQ ID NO: 124445 - RNA, 1701 nt, Artificial Sequence
  derived and/or modified sequence opt3 from hemagglutinin__InfluenzaA__ACI25779
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucuggucacggccuuggguccgcggacugagcaguagaauaucuauuuauuggaccaucgugaagccaggcgacgugcuagucauuaacuccaaugguaaccucaucgccccgaggggguacuuuaaaaugcggacuggaaagagcucgaucaugcgcucugacgcucccauugauacauguauauccgagugcaucaccccuaauggcucaauuccaaacgacaaacccuuccagaauguuaacaagaucacguacggcgccuguccuaaauaugugaagcagaauacccugaaacuugcgacagggaugcgaaacguaccagaaaagcagacuagaggacuguuuggugcaauagccggcuucauugagaaugggugggaaggaaugaucgauggcugguacgguuuuaggcaccaaaacagugaggggaccggccaggcugccgaccuuaagagcacacaggcagcuaucgaucaaauuaauggaaaacucaaccgggugaucgagaagacuaaugaaaaauuccaccagauugagaaggaguucuccgaagucgaaggccguauacaggaccuggagaaauauguggaggauaccaagaucgacuuauggucuuacaacgccgaacugcucguugcgcuugagaaucagcauacaauugaucugaccgacagcgaaaugaacaaguuguuugagaaaacucgcagacaacuaagggaaaacgccgaggauauggggaauggaugcuucaagaucuaucacaaaugugacaacgcaugcaucgagucaauucggaaugguacguacgaccaugauguguaucgagacgaagcucugaacaaucgcuuucagauaaagggcgucgagcucaaaaguggguacaaggauuggauccuguggauuuccuucgccaucagcugcuuucuucugugugugguauugcucggauucauuaugugggcuugccagagaggcaacaucagguguaauauaugcaucuga

SEQ ID NO: 124446 - RNA, 1701 nt, Artificial Sequence
  derived and/or modified sequence opt3 from hemagglutinin__InfluenzaA__ACI25790
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucuggucacggccuuggguccgcggacugagcaguagaauaucuauuuauuggaccaucgugaagccaggcgacgugcuagucauuaacuccaaugguaaccucaucgccccgaggggguacuuuaaaaugcggacuggaaagagcucgaucaugcgcucugacgcucccauugauacauguauauccgagugcaucaccccuaauggcucaauuccaaacgacaaacccuuccagaauguuaacaagaucacguacggcgccuguccuaaauaugugaagcagaauacccugaaacuugcgacagggaugcgaaacguaccagaaaagcagacuagaggacuguuuggugcaauagccggcuucauugagaaugggugggaaggaaugaucgauggcugguacgguuuuaggcaccaaaacagugaggggaccggccaggcugccgaccuuaagagcacacaggcagcuaucgaucaaauuaauggaaaacucaaccgggugaucgagaagacuaaugaaaaauuccaccagauugagaaggaguucuccgaagucgaaggccguauacaggaccuggagaaauauguggaggauaccaagaucgacuuauggucuuacaacgccgaacugcucguugcgcuugagaaucagcauacaauugaucugaccgacagcgaaaugaacaaguuguuugagaaaacucgcagacaacuaagggaaaacgccgaggauauggggaauggaugcuucaagaucuaucacaaaugugacaacgcaugcaucgagucaauucggagugguacguacgaccaugauguguaucgagacgaagcucugaauaaccgcuuucagauaaagggcgucgagcucaaauccggguacaaggauuggauccuguggauuagcuucgccaucucuugcuuucuucugugugugguauugcucggauucauuaugugggcuugccagagaggcaauaucagguguaacauaugcaucuga

SEQ ID NO: 124447 - RNA, 1701 nt, Artificial Sequence
  derived and/or modified sequence opt3 from hemagglutinin__InfluenzaA__ACI25801
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucaacuguacccugauagaugcucuacugggagacccgcauugcgauguauuucagaaugagacuugggacuuguucguggaaagaagcaaagccuuuuccaacuguuaucccuacgaugucccugacuaugcaucucuccggucgcugguggccucaagcggcacacuggaguucaucaccgaagauuuuacguggacugguguuacccagaaugggggaaguaacgcuugcaagcgcggcccaggcuccggguucuuuucucgacucaauugguuaacaaaaagcggauccacuuaccccgugcuggacgucaccaugccuaacaaugauaacuucgacaaguuguauauuuggggugugcaccauccaucaacaaaucaagagcagaccaguuuguacguacaggcaagcggccguguuacggugucuacuagaaggucccagcaaacaaucauucccaacaucgggucacggccuuggguccgcggacugagcaguagaauaucuauuuauuggaccaucgugaagccaggcgacgugcuagucauuaacuccaaugguaaccucaucgccccgaggggguacuuuaaaaugcggacuggaaagagcucgaucaugcgcucugaugcucccauugacacauguauauccgagugcaucaccccuaauggcucaauuccaaacgauaaacccuuccagaauguuaacaagaucacguacggcgccuguccuaaauaugugaagcagaauacccugaaacuugcgacagggaugcgaaacguaccagaaaagcagacuagaggacuguuuggugcaauagccggcuucauugagaaugggugggaaggaaugaucgacggcugguacgguuuuaggcaccaaaacagugaggggaccggccaggcugccgaucuuaagagcacacaggcagcuaucgaccaaauuaauggaaaacucaaccgggugaucgagaagacuaaugaaaaauuccaccagauugagaaggaguucuccgaagucgaaggccguauacaggaucuggagaaauauguggaggacaccaagaucgauuuauggucuuacaacgccgaacugcucguugcgcuugagaaucagcauacaauugaccugaccgauagcgaaaugaacaaguuguuugagaaaacucgcagacaacuaagggaaaacgccgaggacauggggaauggaugcuucaagaucuaucacaaaugugacaacgcaugcaucgagucaauucggaaugguacguacgaucaugacguguaucgagaugaagcucugaacaaucgcuuucagauaaagggcgucgagcucaaaaguggguacaaggacuggauccuguggauuuccuucgccaucagcugcuuucuucugugugugguauugcucggauucauuaugugggcuugccagagaggcaacaucagguguaauauaugcaucuga

SEQ ID NO: 124448 - RNA, 1689 nt, Artificial Sequence; identical to SEQ ID NO: 124366
  derived and/or modified sequence opt3 from hemagglutinin__InfluenzaA__ACI26274

SEQ ID NO: 124449 - RNA, 1698 nt, Artificial Sequence
  derived and/or modified sequence opt3 from hemagglutinin__InfluenzaA__ACI26307
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcauccggcgcuccaacaauucauuuuucagucgacugaacuggcucacccauuuaaaguuuaaguauccagcucugaaugugacaaugcccaacaacgagaaauucgacaaacuuuacauuuggggaguccaccauccugugacugauaaugaccagaucuuuuuguaugcacagagcggccguauuaccguaucuacaaaaagaucccaacagaccguuaucccaaacauaggcucaaggccccgggugcgcaauagcccuaguagaauuucuaucuacuggacgauugucaagccaggggauauccugcuaaucaacuccacuggaaaucucauugccccgagggguuacuucaaaauacggagcggcaagucgucuaucaugcgcuccgacgcucccauugggaaguguaacucagaaugcaucacaccuaauggaaguauaccaaacgacaaacccuuucagaaugugaaccgaauuaccuauggcgccuguccuagauacgugaagcagaauacucugaaacuugcgacagguaugaggaacgucccagagaagcaaacccgggggaucuucggagcaaucgccggcuuuauugaaaauggcugggaggggaugguugauggaugguaugguuuccgucaccagaacagcgagggcaucgggcaggcugccgaccugaaauccacgcaagcagcuauugaucagauaaauggaaaguugaaccgccucaucggcaaaaccaacgaaaaguuccaccagauugagaaggaauuuucugagguggaagguagaauccaggaccuggagaaauacguagaggauacaaagaucgacuuauggagcuauaaugccgaacugcucguggcgcuugagaaccaacauacuauugaucugaccgacucagaaaugaauaaauuguucgagaagacuaaaaagcagcuaagggaaaacgccgaggauauggggaauggcugcuuuaagauauaccacaaaugugacaacgcaugcaucggaaguauucggaauggcacauaugaucaugacgucuaccgagacgaggcucugaacaaucgcuuccagaucaaggggguggaacucaaauccggauacaaggauuggauucuguggaucagcuuugccauaucuugcuuccuucuguguguugcuuugcucgguuuuaucaugugggccugccagaaaggcaacauuagauguaauaucugcauuuga

SEQ ID NO: 124450 - RNA, 1701 nt, Artificial Sequence
  derived and/or modified sequence opt3 from hemagglutinin__InfluenzaA__ACI26362
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucaugacguguaccgcgacgaggcucugaacaauagauuccagaucaaaggagucgaacucaagagugguuacaaagauuggauucuguggaucuccuuugccauaagcugcuuccuucuguguguggcauugcucggcuuuaucaugugggccugccaaaaggggaacauuagguguaauaucugcauuuga

SEQ ID NO: 124451 - RNA, 1701 nt, Artificial Sequence
  derived and/or modified sequence opt3 from hemagglutinin__InfluenzaA__ACI26373
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacugggcugguguuacacagaaugggaccucuagcgcaugcauccggaaguccaacaauucauuuuucagucgccugaacuggcucacgcauuuaaaguuuaaauauccagcccugaaugugacuaugcccaacaacgagcaguucgacaaacuuuacauuuggggaguccaccauccuggcaccgauaaugaccagaucuuuuuguaugcucaagccagcggccgaauuacagugucuacuaagcguucccagcagaccguaaucccaaacauagggucaagacccaggguucggaauauuccuagccgcaucaguauuuacuggacaaucgugaagccaggagauauccugcuaauuaacucuaccgguaaucucauagcgccgagaggcuacuucaaaaucagguccggaaagagcucgauuaugcggucugacgcacccaucgggaaguguaacuccgaaugcauaacgccuaauggcucaauuccaaacgacaaacccuuucagaaugucaaccgcaucacuuauggugccuguccucgauacgugaagcaaaauacacugaaacuugcuaccgggaugagaaacgugccagagaagcagacuaggggaaucuucggcgccauugcaggcuuuaucgaaaaugggugggagggaauggucgaugguugguauggcuuccggcaccagaacagugaggggcguggacaagcugccgaccugaaaagcacacaggcggccauugaucagauaaauggcaaguugaaccgccucaucgguaaaaccaacgaaaaguuccaccagauugagaaggaauuuuccgagguugaagggagaauccaagaccuggagaaauacguggaggauacgaagaucgacuuauggucuuauaaugcagaacugcucguagcucuugagaaccagcauaccauugaucugacagacagcgaaaugaauaaauuguucgagaagacuaaaaagcagcuaagggaaaacgccgaggauaugggcaauggaugcuuuaagauauaccacaaaugugacaacgcuugcaucggcucaauucggaaugggaccuaugaucaugacguguaccgagacgaggcccugaacaaucgcuuccagaucaagggagucgaacucaaaagugguuacaaggauuggauucuguggaucuccuuugcaauaagcugcuuccuucuguguguggccuugcucggcuuuaucaugugggcuugccaaaaagggaacauuagauguaauaucugcauuuga

SEQ ID NO: 124452 - RNA, 1701 nt, Artificial Sequence; identical to SEQ ID NO: 124317
  derived and/or modified sequence opt3 from hemagglutinin__InfluenzaA__ACI26395

SEQ ID NO: 124453 - RNA, 1701 nt, Artificial Sequence
  derived and/or modified sequence opt3 from hemagglutinin__InfluenzaA__ACI26406
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaagcacccagcacugaaugugaccaugcccaacaacgagaaauucgacaaacuuuauauuuggggaguccaucacccuggcacagauaaugaccagaucuuuuuguacgcccaggcuagcggccguauuacugugucuaccaagagaucccaacagacaguaaucccaaacauagggucaaggccccggguucgcaauauuccuagcagaaucaguauuuauuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauacggugcauguccuagauaugugaagcagaauacccugaaacuugccacugggaugaggaacgugccagagaagcaaacacggggaaucuucggcgcuauugccggcuuuaucgaaaaugggugggagggaauggucgaugguugguacggcuuccgucaccagaacagugaggggauuggacaggcagcugaccugaaaagcacccaagccgcgauagaucagaucaauggcaaguugaaccgccucauugguaaaacgaacgaaaaguuccaucagaucgagaaggaauuuuccgagguugaagggagaauccaggaccuggagaaauauguggaggauaccaagauugacuuauggucuuacaaugccgaacugcucguagcacuugagaaccaacacacaauagaucugacugacagcgaaaugaauaaauuguucgagaagaccaaaaagcagcuaagggaaaacgcugaggauaugggcaauggaugcuuuaagaucuaucauaaaugugacaacgccugcauuggcucaauccggaaugggacauacgaucacgacguguaucgagacgaggcucugaacaaucgcuuccagauuaagggagucgaacucaaaagugguuacaaggauuggauccuguggauauccuuugccaucagcugcuuccuucuguguguggcauugcucggcuuuauuaugugggccugccagaaagggaacaucagauguaauauuugcaucuga

SEQ ID NO: 124454 - RNA, 1701 nt, Artificial Sequence; identical to SEQ ID NO: 123944
  derived and/or modified sequence opt3 from hemagglutinin__InfluenzaA__ACI26417

SEQ ID NO: 124455 - RNA, 1701 nt, Artificial Sequence
  derived and/or modified sequence opt3 from hemagglutinin__InfluenzaA__ACI26428
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucuagcugcaagcggcgcuccaacaauucauuuuucagucgacugaacuggcucacucauuuaaaguuuaaauauccagcucugaaugugaccaugcccaacaacgagaaguucgacaaacuuuacauuuggggcguccaccauccugugacagauaaugaccagauccguuuguaugcacaggccagcggcagaauuacuguaucuaccaagaggucccaacagacaguuaucccaaacauaggguaccggccccgcgugagagauauuccuucaaggaucagcauuuacuggaccaucgucaaaccaggagacauccugcuaauuaauaguacggguaaccucauagcuccgcggggcuauuuuaagauccgcucugggaaguccagcauuaugcgaucggacgcccccaucggaaaauguaauucugagugcauaacuccuaacggcuccauuccaaaugauaagcccuuccagaacgugaauagaaucacauacggugcguguccuagguaugugaaacagaacacccugaaacuugcaacugggaugcggaaugucccagaaaagcaaacacguggaaucuuuggcgccauugcuggcuucaucgagaacgggugggaaggaaugguugacgguugguacggcuuucgccaccaaaauucagaggggauuggacaggccgcagaucugaagaguacccaggcugccauaaaccagaucaauggcaaauugaacagacucauugguaagacgaacgagaaguuccaccagaucgaaaaagaguucagcgaaguggaggggaggauccaggaccuggaaaaguauguagaggauaccaaaauugacuuaugguccuacaaugcggagcugcucguggcccuugaaaaccaacauacaauagaucugacugacucugagaugaauaaguuguuugaacggaccaaaaagcagcuacgagagaacgcagaagauaugggcaauggaugcuucaagaucuaucacaaaugugacaacgcuugcauuggcagcauccgcaaugggacauacgaucaugacgucuacagagacgaggcccugaacaauagguuucagauuaagggaguggagcucaaaucagguuauaaggauuggauccuguggauaaguuucgcuaucuccugcuuucuucuguguguuguguugcucggcuucauuaugugggccugccagaaagggaacauccgguguaauauuugcaucuga

SEQ ID NO: 124456 - RNA, 1698 nt, Artificial Sequence
  derived and/or modified sequence opt3 from hemagglutinin__InfluenzaA__ACI26439
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacgggaaaucaaguuuuuauaagaauuuacuguggcuuaccggcaaaaacggauuguaccccaaucugagcaagucuuaugcaaacaauaaagaaaaggagguucuaguacucuggggcgugcaccacccuccaaacaucgggaaccagcgggcccuguaccauacggaaaaugcuuacgucuccguggugucaagccacuauagucgcaaguucacucccgagauagcaaaacgaccuaagguccgugaucaggaaggaagaaucaacuacuauuggacccuucuggagccaggugacacaauuaucuuugaggccaauggcaacuugauugcuccgagguacgccuucgcgcucucucggggguuuggauccggcaucauaaauagcaacgcacccauggaugaaugugacgccaaaugccagacuccucaaggugcuauuaauucgucucugccauuccagaacguucaucccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaccaccagaacgagcaaggcagcgguuacgccgcggaccagaaguccacgcagaaugccauaaacgggaucacuaauaaagugaacucuguuauugaaaagaugaauacacaguuuaccgcagugggcaaggaguucaacaaacuugagcgccgaauggaaaaccugaauaagaaagucgaugacggauucaucgauguguggacuuacaacgcugaguugcuaguacugcucgaaaaugagagaacacuggacuuucaugacagcaacguuaagaaucuuuaugaaaaagugaagucacaacugaagaacaaugccaaagagauaggcaacgggugcuucgaguuuuaccacaaguguaaugaugaaugcauggagagugucaaaaacggaaccuaugacuaccccaaguauuccgaagagagcaaauugucuagggagaagauugauggugugaagcucgaaucaaugggcgucuaccagauccuggcuaucuauaguacgguggccagcuccuuaguucugcuagugucucucggggcaauuucguucuggaugugcagcaauggaucccugcagugucggaucugcauuuga

SEQ ID NO: 124457 - RNA, 1698 nt, Artificial Sequence; identical to SEQ ID NO: 124456
  derived and/or modified sequence opt3 from hemagglutinin__InfluenzaA__ACI26450

SEQ ID NO: 124458 - RNA, 1701 nt, Artificial Sequence
  derived and/or modified sequence opt3 from hemagglutinin__InfluenzaA__ACI26461
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcauccggcgcuccaacaauucauuuuucagucgacugaacuggcucacccauuuaaaguuuaaguauccagcucugaaugugacaaugcccaacaacgagaaauucgacaaacuuuacauuuggggaguccaccauccuggcacugauaaugaccagaucuuuccauaugcacaggccagcggccguauuaccgugucuacaaaaagaucccaacagaccguaauccccaacauagggucaaggccucggguucgcaauauuccaagcagaaucaguauuuacuggacgaucgugaagccgggagauaucuugcugauuaacucuacugguaaucuaauagcucccaggggcuacuucaaaauccgguccgggaaaagcucgauuaugcgcucugacgccccuaucggaaaguguaacuccgaaugcauaacaccaaauggcucaauucccaacgacaaaccuuuucagaaugucaaccgaaucaccuauggugcguguccaagauacgugaagcagaauacucucaaacuggcaacagggaugaggaacgugcccgagaagcaaacccggggaaucuucggcgccauugcuggcuuuaucgaaaaugggugggagggaauggucgaugguugguauggcuuccgucaccagaacagugaggggauuggacaggccgcagaccuuaaaagcacgcaagcugccauagaucagaucaauggcaagcugaaccgcuugauugguaaaaccaacgaaaaguuccaccagaucgagaaggaauuuuccgagguugaagggagaauccaggaccucgagaaauacguggaggauacaaagauugaccuguggucuuauaaugcggaauuacugguagcccucgagaaccaacauacuauagaucuuaccgacagcgaaaugaauaaacuguucgagaagacaaagaagcaguugagggaaaacgcagaggauaugggcaauggaugcuuuaagaucuaccacaaaugugacaacgcuugcauuggcucaauccggaaugggacuuaugaucauaacguguaccgagacgaggcccuaaauaaccgcuuccagauuaagggagucgaacugaaaagugguuacaaggacuggauccucuggauauccuuugcuaucagcugcuuccugcuuuguguggcccuguugggcuuuauuaugugggcaugccagaaagggaauaucagauguaacauuugcaucuga

SEQ ID NO: 124459 - RNA, 1698 nt, Artificial Sequence
  derived and/or modified sequence opt3 from hemagglutinin__InfluenzaA__ACI26472
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcauccggcgcuccaacaauucauuuuucagucgacugaacuggcucacccauuuaaaguuuaaguauccagcucugaaugugacaaugcccaacaacgagaaauucgacaaacuuuacauuuggggaguccaccauccugugacugauaaugaccagaucuuuuuguaugcacagagcggccguauuaccguaucuacaaaaagaucccaacagaccguuaucccaaacauaggcuacaggccccgggugcgcaauauuccuucaagaaucagcauuuacuggacgaucgucaagccaggggauauccugcuaauuaacaguacuggaaaucucauagccccgagggguuauuucaaaauccggucuggcaaguccagcauuaugcgcucggacgcucccaucgggaaguguaacucugaaugcauaacaccuaauggauccauuccaaacgacaaacccuuucagaaugugaaccgaaucaccuacggcgccuguccuagauaugugaagcagaauacucugaaacuugcgacagguaugaggaacgucccagagaagcaaacccgggggaucuucggagcaauugccggcuuuaucgaaaauggcugggaggggaugguugauggaugguacgguuuccgucaccagaacucagagggcauugggcaggcugccgaccugaaaaguacgcaagcagcuauagaucagaucaauggaaaguugaaccgccucauuggcaaaaccaacgaaaaguuccaccagaucgagaaggaauuuagcgagguggaagguagaauccaggaccuggagaaauauguagaggauacaaagauugacuuaugguccuacaaugccgaacugcucguggcgcuugagaaccaacauacuauagaucugaccgacucugaaaugaauaaauuguucgagaagacuaaaaagcagcuaagggaaaacgccgaggauauggggaauggcugcuuuaagaucuaucacaaaugugacaacgcaugcauuggaagcauccggaauggcacauacgaucaugacgucuaccgagacgaggcucugaacaaucgcuuccagauuaaggggguggaacucaaaucaggauauaaggauuggauccuguggauaaguuuugccaucuccugcuuccuucuguguguugcuuugcucgguuuuauuaugugggccugccagaaaggcaacaucagauguaauauuugcaucuga

SEQ ID NO: 124460 - RNA, 1701 nt, Artificial Sequence; identical to SEQ ID NO: 124451
  derived and/or modified sequence opt3 from hemagglutinin__InfluenzaA__ACI26483

SEQ ID NO: 124461 - RNA, 1701 nt, Artificial Sequence
  derived and/or modified sequence opt3 from hemagglutinin__InfluenzaA__ACI26505
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacugggcugguguuacacagaaugggaccucuagcgcaugcauccggaaguccaacaauucauuuuucagucgccugaacuggcucacgcauuuaaaguuuaaauauccagcccugaaugugacuaugcccaacaacgagcaguucgacaaacuuuacauuuggggaguccaccauccuggcaccgauaaugaccagaucuuuuuguaugcucaagccagcggccgaauuacagugucuacuaagcguucccagcagaccguaaucccaaacauagggucaagacccaggguucggaauauuccuagccgcaucaguauuuacuggacaaucgugaagccaggagauauccugcuaauuaacucuaccgguaaucucauagcgccgagaggcuacuucaaaaucagguccggaaagagcucgauuaugcggucugacgcacccaucgggaaguguaacuccgaaugcauaacgccuaauggcucaauuccaaacgacaaacccuuucagaaugucaaccgcaucacuuauggugccuguccucgauacgugaagcaaaauacacugaaacuugcuaccgggaugagaaacgugccagagaagcagacuaggggaaucuucggcgccauugcaggcuuuaucgaaaaugggugggagggaauggucgaugguugguauggcuuccggcaccagaacagugaggggcguggacaagcugccgaccugaaaagcacacaggcggccauugaucagauaaauggcaaguugaaccgccucaucgguaaaaccaacgaaaaguuccaccagauugagaaggaauuuuccgagguugaagggagaauccaagaccuggagaaauacguggaggauacgaagaucgacuuauggucuuauaaugcagaacugcucguagcucuugagaaccagcauaccauugaucugacagacagcgaaaugaauaaauuguucgagaagacuaaaaagcagcuaagggaaaacgccgaggauaugggcaauggaugcuuuaagauauaccacaaaugugacaacgcuugcauccggucaauucgaaauggcaccuaugaucaugacguguaccgcgacgaggcccugaacaauagauuccagaucaagggggucgaacucaaaaguggauacaaggauuggauucuguggaucuccuuugcaauaagcugcuuccuucuguguguggccuugcucgguuuuaucaugugggcuugccaaaaaggcaacauuagguguaauaucugcauuuga

SEQ ID NO: 124462 - RNA, 1701 nt, Artificial Sequence; identical to SEQ ID NO: 124450
  derived and/or modified sequence opt3 from hemagglutinin__InfluenzaA__ACI26516

SEQ ID NO: 124463 - RNA, 1701 nt, Artificial Sequence; identical to SEQ ID NO: 124451
  derived and/or modified sequence opt3 from hemagglutinin__InfluenzaA__ACI26527

SEQ ID NO: 124464 - RNA, 1701 nt, Artificial Sequence
  derived and/or modified sequence opt3 from hemagglutinin__InfluenzaA__ACI26538
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagauaaacagacacggggaaucuucggcgcuauugccggcuuuaucgagaaugggugggaaggaauggucgacgguugguauggcuuccgucaccagaacagugaggggcgcggacaagcagcugaucuuaagagcacccaggccgcgauugaccagauaaauggcaaauugaacagacucaucgguaagacgaacgagaaauuccaccagauugaaaaggaguuuuccgaaguugaggggaggauccaagaucuggaaaaguacguggaggacaccaaaaucgauuuauggucuuauaaugccgagcugcucguagcacuugaaaaccagcauacaauugaccugacugauagcgagaugaauaaguuguucgagaaaaccaagaaacagcuacgggaaaacgcugaagacaugggcaauggaugcuuuaagauauaccacaagugugauaacgccugcaucggcucaauucgaaaugggacauaugaccaugacguguaccgcgaugaggcucugaacaauagauuccagaucaaaggagucgagcucaagagugguuacaaagacuggauucuguggaucuccuuugccauaagcugcuuccuucuguguguggcauugcucggcuuuaucaugugggccugccaaaaggggaacauuagguguaauaucugcauuuga

SEQ ID NO: 124465 - RNA, 1701 nt, Artificial Sequence
  derived and/or modified sequence opt3 from hemagglutinin__InfluenzaA__ACI26549
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucuuauagcugcaagcgaggcuccgugaacucauucuuuagucgucugaauuggcuccacgagagcgaguacaaguauccagcuuuaaacgucacgaugcccaauaacggcaaauucgauaagcuguacaucuggggagugcaucacccuucuacugacagagaacaaaccaaacuuuacguaagggcauccgggcggguuacagugucaacuaagcgcagccagcagaccgucauuccaaauaucgguaguagacccugggugaggggcuugucuucccggauuagcaucuauuggacaauagugaaaccuggggauauucugcuaaucaacucgaccggaaaccucauugccccacgcggcuacuuuaagauccgaacggguaagucuuccaucaugagaucagacgcuccgauugggacuuguaguagcgagugcauaacacccaauggauccaucccuaacgacaaaccauuccagaaugucaacaagauuaccuauggcgccugucccagguacguuaaacaaaauacucugaagcuggcgacaggcaugcggaacgugccugaaaaacagacccgugggaucuuuggagcaauagccgguuucauugagaauggcugggaggggaugguagauggaugguauggcuuucgccaccagaacucugaagguacggggcaggcugccgaccuuaagagcacccaagcagcuaucgaucagaucaauggcaaauugaacagacucauugagaagacaaaugaaaaguuccaucagaucgagaaagaguucucagaaguggagggaaggauucaagaccuggaagaguacgucgaagauacuaagauagacuuauggaguuauaacgccgagcugcucguggcgcuugaaaaucagcacaccaucgaucugacagacuccgagaugaacaaauuguuugagaagacucggaaacagcuacgagaaaaugccgaggauaugggcaacgggugcuucaagauuuaccauaagugugacaacgcaugcaucggaagcauccgcaaugguaccuacgaucacgacguuuauagagacgaagcucugaacaauagguuucagauuaaaggcguggagcucaagucuggguacaaagauuggauacuguggaucucauucgccauuaguugcuuucuucugugugucguguugcucggauucaucaugugggcuugccaaaagggcaacauucgguguaauaucugcauauga

SEQ ID NO: 124466 - RNA, 1701 nt, Artificial Sequence
  derived and/or modified sequence opt3 from hemagglutinin__InfluenzaA__ACI26560
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacgagagugaguacaaguauccagccuuaaacgucaccaugcccaauaacggcaaauucgauaagcuguacaucuggggagugcaucacccuauuacggacagagaacaaacuaaucuuuacguaagggcuagcgggcggguuaccgugucuacaaaacgcucccagcagacugucaucccaaacauugguucaagacccugggugaggggcuugagcagucggaucucuauauauuggaccauugugaagccuggggauauccugcuaauuaacuccacaggaaaucucaucgccccacgcggcuacuuuaaaauccgaaccgguaagagcucgauuaugagaucugacgcgccgauagggacguguuccucagagugcaucacucccaacggaaguauuccuaaugacaagccauuccagaacgucaauaggaucacauauggcgcauguccccgguacguuaaacaaaacacccugaaacuugccacuggcaugcguaaugugccugaaaagcagacacgcgggauauuuggagcuauugccgguuucaucgagaacggcugggaggggaugguagauggaugguauggcuuuagacaccagaauagcgaagguaccgggcaggcagcugaccugaaguccacgcaagccgcgaucgaucagauuaacggcaaauugaauaggcucaucgagaagaccaacgaaaaauuccaucagauugagaaggaguucucugaaguggagggacggauacaagaccuggaaaaguacgucgaggauacaaaaaucgacuuauggagcuauaaugccgaacugcucguggcacuugagaaccagcacacuauugaucugaccgacucagaaaugaauaaguuguuugagaaaacacgaaagcagcuacgcgagaacgcugaagauaugggcaacgggugcuucaaaaucuaccauaagugugacaaugccugcaucggaaguauuagaaacgguacuuacgaucacgacguuuauagggacgaggcucugaauaaccgguuucagauaaagggcguggaacucaaauccggguacaaggauuggauccuguggauuagcuucgccaucucuugcuuucuucugugugucguguugcucggauucauuaugugggcaugccaaaaaggcaauauccgcuguaacauaugcaucuga

SEQ ID NO: 124467 - RNA, 1701 nt, Artificial Sequence
  derived and/or modified sequence opt3 from hemagglutinin__InfluenzaA__ACI26571
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacgagagugaguacaaguauccagccuuaaacgucaccaugcccaauaacggcaaauucgauaagcuguacaucuggggagugcaucacccuagcacggacagagaacaaacuaaacuuuacguaagggcuucugggcggguuaccguguccacaaagcgcucacagcagacugucauuccaaauaucgguagcagacccugggugaggggcuugaguucucggauuuccaucuauuggaccauagugaaaccuggggauauucugcuaaucaacagcacaggaaaccucauugccccacgcggcuacuuuaagauccgaaccgguaagucgucuaucaugagauccgacgcgccgauugggacguguucaagugagugcauaacucccaauggaagcaucccuaacgacaaaccauuccagaaugucaacaggauuacauauggcgcauguccccgguacguuaagcaaaauacccugaaacuugccacuggcaugcguaacgugccugaaaagcagacacgcgggaucuuuggagcuauagccgguuucauugagaauggcugggaggggaugguagauggaugguauggcuuuagacaccagaacuccgaagguaccgggcaggcagcugaccugaaaucuacgcaagccgcgaucgaucagaucaauggcaaguugaacaggcucauugagaaaaccaaugaaaaguuccaucagaucgagaaggaguucagcgaaguggagggacggauucaagaccuggaaaaauacgucgaggauacaaagauagacuuauggucauauaacgccgaacugcucguggcacuugagaaucagcacacuaucgaucugaccgacagugaaaugaacaaauuguuugagaagacacgaaaacagcuacgcgagaaugcugaagauaugggcaacgggugcuucaagauuuaccauaagugugacaacgccugcaucggauccaucagaaaugguacuuacaaccacgauguuuauagggacgaggcucugaauaaccgguuucagauuaaaggcguggaacucaagagcggguacaaagacuggauacuguggaucucuuucgccauuucaugcuuucuucugugugucguguugcucggauucaucaugugggcaugccaaaagggcaauauucgcuguaacaucugcauauga

SEQ ID NO: 124468 - RNA, 1701 nt, Artificial Sequence
  derived and/or modified sequence opt3 from hemagglutinin__InfluenzaA__ACI26593
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagacuucaauuggaccgguguugcucaguccggggagucuuaugcaugcaagcgaggaagcgugaaguccuuuuucucacgucucaacugguuacacaaaagugauuacaaguauccagcccugaaugucacgaugcccaacaauggcaaauuugacaaacuuuacauauggggcgugcaucacccuagcacugauagagagcaaaccucuuuguacguaagggcuuccgggcggguuacagugucaacuaaacgcagccagcagaccgucaucccaaacauuggaaguagacccugggugaggggucugucuucccggaucagcauuuauuggacaaucgugaagccuggcgacauacuacucauuaauucgaccgggaaccugaucgccccacgcggauacuucaagauucgaacgggcaaaucuuccaucaugagaucagacgcgccgaucgguacuuguaguagcgaaugcauuacacccaacggguccauaccuaaugauaagccauuucagaacgucaauaggaucaccuauggagcauguccccgguacguuaaacaaaacacucuuaagcuggccacaggcaugcguaaugugccugagaaacagacccgcggcauuuucggggcuaucgccggauuuauagaaaacgguugggagggcaugguagacgggugguauggauucagacaccagaauagcgagggcacgggucaggcagcugauuugaagucuacccaagccgcgauugaccagaucaacgggaaacucaauaggcugaucgaaaagacaaacgagaaguuucaucagauugaaaaagaguucucagaaguggagggccggauccaagauuuagagaaguacgucgaagacacuaaaauugaucuguggaguuauaaugccgagcuccuuguggcacuggaaaaccagcacaccauagacuugacagauuccgagaugaauaagcuauucgaaaagacucgaaagcagcugcgcgagaacgcugaggacaugggaaauggcugcuuuaagaucuaccauaaaugugauaacgccugcauugggagcaucagaaacggaaccuacgaccacgacguuuauagggaugaagcucucaauaaccgguuccagaucaaggguguggagcugaaaucuggcuacaaggacuggauucuuuggauaucauuugccaucaguugcuuccuguugugugucgugcuccugggguuuauuaugugggcaugccaaaaaggaaauauccgcuguaacauuugcaucuga

SEQ ID NO: 124469 - RNA, 1698 nt, Artificial Sequence
  derived and/or modified sequence opt3 from hemagglutinin__InfluenzaA__ACI32715
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccgccaaguuacggauggcaacgggacugcgcaauauuccaucaauccagagucgaggccucuucggcgcuaucgccggguuuauugaaggagguuggacuggcaugguggacgggugguacggauaucaucaccagaacgagcaaggcagcgguuacgcggccgaucagaaauccacacagaaugcaauaaacgggaucaccaauaaggucaacacugugauugaaaagaugaauacacaguucaccgcuguuggcaaagaguucucuaaacuugagagaaggauggaaaaccugaauaagaagguggacgauggauuuuuggacaucuggacguacaacgccgagcuacugguccuccuggaaaacgagcggacccuugacuuccacgauagcaaugugaaaaaccuguaugaaaagguaaaaucacaauugaagaauaacgcuaaagagauaggcaaugggugcuuugaguucuaccauaaguguaacgacgaaugcauggagaguguuaagaauggaacauaugauuaccccaaauauuccgaagagagcaagcucaaccgugagaaaauugacggugugaagcuggaaucuaugggcgucuaccagaucuuagccaucuauucaacuguggcaaguagccugguccuacucgugucccugggggccauuucuuuuuggaugugcucgaauggaagccuucagugucgcaucugcauuuga

SEQ ID NO: 124470 - RNA, 1698 nt, Artificial Sequence
  derived and/or modified sequence opt3 from hemagglutinin__InfluenzaA__ACI32716
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccgccaaguuacggauggcaacgggacugcgcaauauuccaucaauccagagucgaggccucuucggcgcuaucgccggguuuauugaaggagguuggacuggcaugguggacgggugguacggauaucaucaccagaacgagcaaggcagcgguuacgcggccgaucagaaauccacacagaaugcaauaaacgggaucaccaauaaggucaacucugugauugaaaagaugaauacucaguucacagcuguuggcaaagaguucagcaaacuugagagaaggauggaaaaccugaauaagaagguggacgauggauuuuuggacaucuggaccuacaacgccgagcuacugguccuccuggaaaacgagcggacgcuugacuuccacgauucaaaugugaaaaaccuguaugaaaagguaaaaagucaauugaagaauaacgcuaaagagauaggcaaugggugcuuugaguucuaccauaaguguaacgacgaaugcauggaguccguuaagaauggaaccuaugauuaccccaaauauagcgaagagucuaagcucaaccgugagaaaauugacggugugaagcuggaaucaaugggcgucuaccagaucuuagccaucuauaguacaguggcaagcucccugguccuacucgugucucugggggccauuucguuuuggaugugcagcaauggaucccuucaguguacuaucugcauuuga

SEQ ID NO: 124471 - RNA, 1698 nt, Artificial Sequence
  derived and/or modified sequence opt3 from hemagglutinin__InfluenzaA__ACI32717
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugucaucguucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuaugaauagcucucugccauuucagaacguucaccccgugaccauuggggaguguccuaaauauguaagguccgccaaguuacggauggcaacgggacugcgcaauaucccaucaauucagagucgaggccucuucggcgcuaucgccggguuuaucgaaggagguuggacuggcaugguggacgggugguacggauaucaucaccagaacgagcaaggcagcgguuacgcggccgaucagaaauccacacagaaugcaauuaacgggauaaccaauaaggucaacucugugaucgaaaagaugaauacucaguucacagcuguuggcaaagaguucagcaaacuugagagaaggauggaaaaccugaauaagaagguggacgauggauuuuuggacauuuggaccuacaacgccgagcuacugguccuccuggaaaacgagcggacgcuugacuuccacgauucaaaugugaaaaaccuguaugaaaagguaaaaagucaauugaagaauaacgcuaaagagaucggcaaugggugcuuugaguucuaccauaaguguaacgacgaaugcauggaguccguuaagaauggaaccuaugauuaccccaaauauagcgaagagucuaagcucaaccgugagaaaauagacggugugaagcuggaaucaaugggcgucuaccagauuuuagccaucuauaguacaguggcaagcucccugguccuacucgugucucugggggccaucaauuuuuggaugugcucgaacggaagccuucaguguaaaauuugcaucuga

SEQ ID NO: 124472 - RNA, 1698 nt, Artificial Sequence
  derived and/or modified sequence opt3 from hemagglutinin__InfluenzaA__ACI32718
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagccaccggugucucugcaagcugcucccacaacgggaagucaaguuuuuaccggaauuuacuguggcuuacgggcaaaaacggauuguaucccaaucugagcaagucuuacgccaacaauaaagaaaaggaggugcuaguacucuggggcguucaucacccuccaaacaucggggaucagcgcgcucuguaccacacugaaaacgcauauguguccgucgugucaagccauuacagucgacguuucacccccgagauagccaaaagaccuaaggugagggaccaggaaggacggaucaauuauuacuggacacuucuggagccaggugauacuauuaucuuugaggcuaacggcaauuugauugccccgcgcuucgcguuugcacucucuagaggguucggauccggcaucauaaccagcaacgcccccauggacgaaugugaugcuaagugccagacaccucaaggugccauuaauucgucucugccauuucagaacguccaccccguuaccaucggggaguguccuaaauaugugagguccgcaaaguuacggauggcuacgggacugcgcaauauuccaucaauccagagucgaggccucuucggcgccaucgcgggguuuauugaaggagguuggacuggcaugguagacgggugguacggauaucaucaccagaacgagcaaggcagcgguuacgccgcagaucagaaauccacacagaaugcuauaaacgggaucaccaauaaggugaacucugucauugaaaagaugaauacucaguucacagccgugggcaaagaguucagcaaacuugagagaaggauggaaaaccugaauaagaagguugacgauggauuuuuggacaucuggaccuacaacgcugagcuacuggugcuccuggaaaacgagcggacgcuugacuuccacgauucaaaugucaaaaaccuguaugaaaaggugaaaagucaauugaagaauaacgccaaagagguaggcaaugggugcuuugaguucuaccauaaguguaacgacgaaugcauggaguccguuaagaauggaaccuaugauuaccccaaauauagcgaagagucuaagcucaaccgugagaaaauagacggugugaagcuggaaucaaugggcgucuaccagauuuuagcaaucuauaguacaguggccagcucccugguccuacucgugucucugggggcuaucucguuuuggaugugcagcaauggaucccuucaguguacuauuugcaucuga

SEQ ID NO: 124473 - RNA, 1698 nt, Artificial Sequence; identical to SEQ ID NO: 124470
  derived and/or modified sequence opt3 from hemagglutinin__InfluenzaA__ACI32719

SEQ ID NO: 124474 - RNA, 1698 nt, Artificial Sequence; identical to SEQ ID NO: 124470
  derived and/or modified sequence opt3 from hemagglutinin__InfluenzaA__ACI32720

SEQ ID NO: 124475 - RNA, 1698 nt, Artificial Sequence
  derived and/or modified sequence opt3 from hemagglutinin__InfluenzaA__ACI32721
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucucuuauuacuggacacuucuggagccaggugauacuauuaucuuugaggccaauggcaacuugauugcuccgcgcuucgccuuugcgcucuccagaggguucggaagcggcaucauaaccucgaaugcacccauggacgaaugugaugccaagugccagacaccucaaggugcuauuaacucuucccugccauuucagaauguucaccccgugaccaucggggaguguccuaaauauguaaggucagccaaguuacggauggcaacgggacugcgcaacauuccaaguauccagagccgaggccucuucggcgcuaucgccggguuuauugaaggagguuggacuggcaugguggacgggugguacggauaucaucaccagaaugagcaaggcuccgguuacgcggccgaucagaaaucuacacagaacgcaauaaaugggaucaccaacaaggucaauagcgugauugaaaagaugaacacucaguucacagcuguuggcaaagaguucucaaaacuugagagaaggauggaaaaucugaacaagaagguggacgauggauuuuuggacaucuggaccuacaaugccgagcuacugguccuccuggaaaacgagcggacgcuugacuuccacgauaguaacgugaaaaaucuguaugaaaagguaaaaucccaauugaagaacaaugcuaaagagauaggcaacgggugcuuugaguucuaccauaaguguaaugacgaaugcauggagagcguuaagaacggaaccuaugauuaccccaaauauucugaagagucaaagcucaaucgugagaaaauugacggugugaagcuggaaaguaugggcgucuaccagaucuuagccaucuauagcacaguggcauccucucugguccuacucgugucgcugggggccauuagcuuuuggaugugcuccaacggaucacuucagugucgcaucugcauuuga

SEQ ID NO: 124476 - RNA, 1698 nt, Artificial Sequence; identical to SEQ ID NO: 124470
  derived and/or modified sequence opt3 from hemagglutinin__InfluenzaA__ACI32722

SEQ ID NO: 124477 - RNA, 1698 nt, Artificial Sequence
  derived and/or modified sequence opt3 from hemagglutinin__InfluenzaA__ACI32723
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccgccaaguuacggauggcaacgggacugcgcaauauuccaucaauccagagucgaggccucuucggcgcuaucgccggguuuauugaaggagguuggacuggcaugguggacgggugguacggauaucaucaccagaacgagcaaggcagcgguuacgcggccgaucagaaauccacacagaaugcaauaaacgggaucaccaauaaggucaacucugugauugaaaagaugaauacucaguucacagcuguuggcaaagaguucagcaaacuugagagaaggauggaaaaccugaauaagaagguggacgauggauuuuuggacaucuggaccuacaacgccgagcuacugguccuccuggaaaacgagcggacgcuugacuuccacgauucaaaugugaaaaaccuguaugaaaagguaaaaagucaauugaagaauaacgcuaaagagauaggcaaugggugcuuugaguucuaccauaaguguaacgacgaaugcauggaguccguuaagaauggaaccuaugauuaccccaaauauagcgaagagucuaagcucaaccgugagaaaauugacggugugaagcuggaaucaaugggcgucuaccagaucuuagccaucuauaguacaguggcaagcucccugguccuacucgugucucugggggccauuucguuuuggaugugcagcaauggaucccuucagugucgcaucugcuucuga

SEQ ID NO: 124478 - RNA, 1698 nt, Artificial Sequence
  derived and/or modified sequence opt3 from hemagglutinin__InfluenzaA__ACI32724
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucugaagccaggugauacuauuaucuuugaggccaacggcaauuugauugcuccgcgcuucgccuuugcgcucucuagaggguucggauccggcaucauaaccagcaacgcacccauggacgagugugaugccaaaugccagacaccucaaggugcuauuaauucgucucugccauuucagaacguucaccccgugaccaucggggaauguccuaaguauguaagguccgccaaauuacggauggcaacgggacugcgcaauauuccaucaauccagagucgaggccucuucggcgcuaucgccggguuuauugagggagguuggacuggcaugguggacgggugguacggauaucaucaccagaacgaacaaggcagcgguuacgcggccgaucagaaguccacacagaaugcaauaaacgggaucaccaauaaagucaacucugugauugagaagaugaauacucaguucacagcuguuggcaaagaguucagcaaacuugaaagaaggauggagaaccugaauaagaaaguggacgauggauuuuuggacaucuggaccuacaacgccgaacuacugguccuccuggagaacgaacggacgcuugacuuccacgauucaaaugugaagaaccuguaugagaaaguaaagagucaauugaaaaauaacgcuaaggaaauaggcaaugggugcuuugaguucuaccauaaguguaacgacgagugcauggaauccguuaaaaauggaaccuaugauuaccccaaguauagcgaggaaucuaaacucaaccgugagaagauugacggugugaaacuggagucaaugggcgucuaccagaucuuagccaucuauaguacaguggcaagcucccugguccuacucgugucucugggggccauuucguuuuggaugugcagcaauggaucccuucaguguaagaucugcauuuga

SEQ ID NO: 124479 - RNA, 1698 nt, Artificial Sequence; identical to SEQ ID NO: 123401
  derived and/or modified sequence opt3 from hemagglutinin__InfluenzaA__ACI32725

SEQ ID NO: 124480 - RNA, 1698 nt, Artificial Sequence
  derived and/or modified sequence opt3 from hemagglutinin__InfluenzaA__ACI32726
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccgccaaguuacggauggcaacgggacugcgcaauauuccaucaauccagagucgaggccucuucggcgcuaucgccggguuuauugaaggagguuggacuggcaugguggacgggugguacggauaucaucaccagaacgagcaaggcagcgguuacgcggccgaucagaaauccacacagaaugcaauaaacgggaucaccaauaaggucaacucugugauugaaaagaugaauacucaguucacagcuguuggcaaagaguucagcaaacuugagaagagaauggaaaaccugaauaagaaaguggacgauggauuuuuggacaucuggaccuacaacgccgagcuacugguccuccuggaaaacgagaggacgcuugacuuccacgauucaaaugugaagaaccuguaugaaaaaguaaagagucaauugaaaaauaacgcuaaggagauaggcaaugggugcuuugaguucuaccauaaguguaacgacgaaugcauggaguccguuaaaaauggaaccuaugauuaccccaaguauagcgaagagucuaaacucaaccgggagaagauugacggugugaaacuggaaucaaugggcaucuaccagaucuuagccauuuauaguacagucacuagcucccuggugcuacucgucucucugggggcaaucucguuuuggaugugcagcaauggaucccuucagugucguauuugcauauga

SEQ ID NO: 124481 - RNA, 1698 nt, Artificial Sequence
  derived and/or modified sequence opt3 from hemagglutinin__InfluenzaA__ACI32727
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucgauuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuccaaacauaggggaucagcgcgcccuguaccacacugaaaacgcuuauguguccgucgugucaagccauuacagucgacguuucacccccgagaucgcaaaaagaccuaaggugagggaccaggaaggacggauuaauuauuacuggacacuucuggagccaggugauacuaucauuuuugaggccaacggcaauuugaucgcuccgcgcuucgccuuugcgcucucuagaggguucggauccggcauaauuaccagcaacgcacccauggacgaaugugaugccaagugccagacaccucaaggugcuaucaauucgucucugccauuucagaacguccaccccguuaccauuggggaguguccuaaauaugugagguccgccaaguuacggauggcaacgggacugcgcaauaucccaucaauccagagucgaggccucuucggcgcuauugccggguuuauagaaggagguuggacuggcaugguagacgggugguacggauaucaucaccagaacgagcaaggcagcgguuacgcggccgaucagaaauccacacagaaugcaaucaacgggauuaccaauaaggugaacucugucaucgaaaagaugaauacucaguucacagcugugggcaaagaguucagcaaacuugagagaaggauggaaaaccugaauaagaagguugacgauggauuuuuggacauauggaccuacaacgccgagcuacuggugcuccuggaaaacgagcggacgcuugacuuccacgauucaaaugucaaaaaccuguaugaaaaggugaaaagucaauugaagaauaacgcuaaagagauuggcaaugggugcuuugaguucuaccauaaguguaacgacgaaugcauggaguccguaaagaauggaaccuaugauuaccccaaauauagcgaagagucuaagcucaaccgugagaaaaucgacgguguuaagcuggaaucaaugggcguguaccagaucuuagccauuuauaguacagucgcaagcucccuggugcuacucgucacucugggggccaucucuuuuuggaugugcucgaauggaagccuucaguguaccauuugcauauga

SEQ ID NO: 124482 - RNA, 1698 nt, Artificial Sequence
  derived and/or modified sequence opt3 from hemagglutinin__InfluenzaA__ACI32729
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuccaaaagagaguuggagcuacaucguugaaaccccgaaucccgagaacggaacuuguuauccuggcuacuuugcugacuaugaggaacugagagagcaacucuccucugugucgucauucgaaagguuugagauuuucccaaaggagagcaguuggcccaaucauacagucaccgguguguccgccucuugcagccacaacgggaaguccucauuuuaccggaauuuacuguggcuuacgggcaaaaacggauuguauccuaaucugaguaagagcuacgcaaacaauaaagaaaaggagguucuaguacucuggggcgugcaucacccacccaacaucggggaucagcgcgcccuguaccacacugaaaacgcuuaugucucugugguguccucacauuacagccgacguuucaccccugagauagcaaaaagaccaaaggucagggaccaggaaggacggaucaauuauuacuggacacuucuggagccgggugauacuauuaucuuugaggccaacggcaauuugauugcuccccgcuucgccuuugcgcucaguagaggguucggaucuggcaucauaaccuccaacgcaccuauggacgaaugugaugccaagugccagacaccacaaggugcuauuaauagcucgcugcccuuucagaacguucacccugugaccaucggggaguguccaaaauauguaaggucugccaaguuacggauggugacgggacugcgcaauauucccuccauccagucacgaggccucuucggcgcaaucgcuggguuuauugaaggagguuggacuggcauggucgacgggugguacggauaucaucaccagaacgagcaaggcagugguuacgccgcggaucagaaaagcacacagaaugccauaaacggggugaccaauaagguuaacuccgugaucgaaaagaugaauacucaguucacagcagucggcaaagaguucaacaaacuugagagaaggauggaaaaucugaacaagaagguggacgauggauuuuuggacauuuggaccuacaacgcugagcuacugguacuccuggaaaaugagcggacgcuugacuuccacgauucuaacguuaaaaaucuguaugaaaaggugaaaagccaauugaagaacaaugccaaagagaucggcaacgggugcuuugaguucuaccauaaguguaaugacgaaugcauggagucagucaagaacggaaccuaugauuacccgaaauauagugaagaguccaagcucaaucgugagaaaauagacggugugaagcuggaaagcaugggcgucuaccagauuuuagcuaucuauucuacaguggccucaagucugguucuacucgugagccugggggcaaucuccuuuuggaugugcucuaacggaucgcuucagugucgcauuugcaucuga

SEQ ID NO: 124483 - RNA, 1698 nt, Artificial Sequence; identical to SEQ ID NO: 124482
  derived and/or modified sequence opt3 from hemagglutinin__InfluenzaA__ACI32730

SEQ ID NO: 124484 - RNA, 1698 nt, Artificial Sequence
  derived and/or modified sequence opt3 from hemagglutinin__InfluenzaA__ACI32731
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacgggaaaucaaguuuuuauaagaauuuacuguggcuuaccggaaagaacggcuuguaccccaaucugagcaagucuuaugcaaacaauaaagaaaaggagguucuaguacucuggggcgugcaccacccuccaaacaucggggaucagaaggcccuguaccauacggaaaacgcuuacgucuccguggugucaagccacuauagucggaaauucaaucccgagauagcaaagcgcccuaaaguccgagaccaggaaggacguaucaacuacuauuggacucuucuggagccaggugauaccauuaucuuugaggccaauggcaacuugauugcuccgagauacgccuucgcgcucucuaggggguuuggauccggcaucauaaauagcaacgcacccauggacgaaugugaugccaagugccagacaccucaaggugcuauuaauucgucucugccauuccagaacguucaucccgugacuaucggggaguguccuaaauauguacgguccgccaaguuacgcauggugaccggacugagaaauauuccaucaauccagaguaggggccucuuuggcgcaaucgcuggguucauugaaggagguuggacaggcauggucgacgggugguacggauaucaccaccagaacgagcaaggcagcgguuacgccgcggaucagaaauccacccagaaugccauaaacgggaucacgaauaaggugaacucuguuauugaaaagaugaauacucaguuuacagcagugggcaaagaguucaacaaacuugagcggcgcauggaaaaccugaauaaaaaggucgacgauggauucaucgacauauggaccuacaacgcugaguugcuagugcugcucgaaaaugagcgaacucuggacuuucaugauagcaacguuaaaaaucuuuaugaaaagguaaagucacaacugaaaaacaaugccaaggagauuggcaacgggugcuucgaguuuuaccacaaauguaaugacgaaugcauggagagugugaagaacggaacauaugauuaccccaaauauuccgaagagagcaaguugaauagagagaagaucgacggugucaaacucgaaucuaugggcguguaccagauccuggcuauuuauucaaccgucgccaguagcuuagugcugcuaguuucccucggggcaaucucuuucuggaugugcucgaacggaagccugcaguguaagauuugcauauga

SEQ ID NO: 124485 - RNA, 1698 nt, Artificial Sequence
  derived and/or modified sequence opt3 from hemagglutinin__InfluenzaA__ACI32732
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccgccaaguuacggauggugacgggacugcgcaauauuccaucaauccagagucgaggccucuucggcgcaaucgcuggguuuauugaaggagguuggacuggcauggucgacgggugguacggauaucaucaccagaacgagcaaggcagcgguuacgccgcggaucagaaauccacacagaaugccauaaacgggaucaccaauaaggugaacucuguuauugaaaagaugaauacucaguucacagcagugggcaaagaguucaacaaacuugagagaaggauggaaaaucugaacaagaaggucgacgauggauuuuuggacaucuggaccuacaacgcugagcuacuggugcuccuggaaaaugagcggacgcuugacuuccacgauagcaacguuaaaaaucuguaugaaaagguaaaaucacaauugaagaacaaugccaaagagauaggcaacgggugcuuugaguucuaccauaaguguaaugacgaaugcauggagagugugaagaacggaaccuaugauuaccccaaauauuccgaagagagcaagcucaaucgugagaaaauugacggugucaagcuggaaucuaugggcguguaccagaucuuagcuaucuauucaacagucgccaguagccuggugcuacucguuucccugggggcaauuucuuuuuggaugugcucgaacggaagccuucaguguacuaucugcauuuga

SEQ ID NO: 124486 - RNA, 1698 nt, Artificial Sequence
  derived and/or modified sequence opt3 from hemagglutinin__InfluenzaA__ACI32733
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacgggaaaucaaguuuuuauaagaauuuacuguggcuuaccggaaagaacggcuuguaccccaaucugagcaagucuuaugcaaacaauaaagaaaaggagguucuaguacucuggggcgugcaccacccuccaaacaucggggaucagaaggcccuguaccauacggaaaacgcuuacgucuccguggugucaagccacuauagucggaaauucaauucugagauagcaaagcgccccaaaguccgagaccaggaaggacguaucaacuacuauuggacucuucuggagccuggugauaccauuaucuuugaggccaauggcaacuugauugcuccaagauacgccuucgcgcucuccaggggguuuggaagcggcaucauaaauucgaacgcaccgauggacgaaugugaugccaagugccagacaccccaaggugcuauuaauucuucccugccuuuccagaacguucauccagugacuaucggggagugucccaaauauguacggucagccaaguuacgcauggugaccggacugagaaauauuccuaguauccagagcaggggccucuuuggcgcaaucgcuggguucauugaaggagguuggacaggcauggucgacgggugguacggauaucaccaccagaacgagcaaggcuccgguuacgccgcggaucagaaaucuacccagaaugccauaaacgggaucacgaauaaggugaacagcguuauugaaaagaugaauacucaguuuacagcagugggcaaagaguucaacaaacuugagcggcgcauggaaaaccugaauaaaaaggucgacgauggauucaucgacauauggaccuacaacgcugaguugcuagugcugcucgaaaaugagcgaacucuggacuuucaugauucaaacguuaaaaaucuuuaugaaaagguaaagagucaacugaaaaacaaugccaaggagauuggcaacgggugcuucgaguuuuaccacaaauguaaugacgaaugcauggaguccgugaagaacggaacauaugauuacccaaaauauagcgaagagucuaaguugaauagagagaagaucgacggugucaaacucgaaucaaugggcguguaccagauccuggcuauuuauaguaccgucgccagcuccuuagugcugcuaguuucucucggggcaaucucguucuggaugugcagcaacggaucccugcaguguacgauuugcauauga

SEQ ID NO: 124487 - RNA, 1698 nt, Artificial Sequence
  derived and/or modified sequence opt3 from hemagglutinin__InfluenzaA__ACI32734
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcaagucuuacgcaaacaauaaaaagaaagaaguucuaguacucuggggcgugcaucacccuccaaacaucggggaucagaaggcccuguaccacacugagaacgcuuaugucuccguggugucaagccauuacagucgccgauucacccccgaaauagcaaagcguccuaaagucagagaccaggagggaaggaucaauuauuacuggacacuucuggaaccaggugauacuauuaucuuugaggccaacggcaauuugauugcuccgcgguucgccuuugcgcucucucgcggguucggauccggcaucauaaccagcaacgcacccauggacgagugugaugccaagugccagacaccucaaggugcuauuaauucgucucugccauuucagaacguucaccccgugaccaucggggaauguccuaaauauguaagauccgccaaguuaaggauggugacgggacugcggaauauuccaucaauccagagucgcggccucuucggcgcaaucgcuggguuuauugagggagguuggacuggcauggucgacgggugguacggauaucaucaccagaacgaacaaggcagcgguuacgccgcggaucagaaauccacacagaaugccauaaacgggaucaccaauaaggugaacucuguuauugagaaaaugaauacucaguucacagcagugggcaaggaguucaacaaacuugaacgaagaauggagaaucugaacaaaaaggucgacgauggauuuuuggacaucuggaccuacaacgcugaacuacuggugcuccuggagaaugaaaggacgcuugacuuccacgauagcaacguuaaaaaucuguaugagaagguaaaaucacaauugaagaacaaugccaaggaaauaggcaacgggugcuuugaguucuaccauaaauguaaugacgagugcauggaaagugugaagaacggaaccuaugauuaccccaaauauuccgaggaaagcaagcucaaucgggagaaaauugacggugucaagcuggagucuaugggcguguaccagaucuuagcuaucuauucaacagucgccaguagccuggugcuacucguuucccugggggcaauuucuuuuuggaugugcucgaacggaagccuucaguguacuaucugcauuuga

SEQ ID NO: 124488 - RNA, 1698 nt, Artificial Sequence
  derived and/or modified sequence opt3 from hemagglutinin__InfluenzaA__ACI32736
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacugccacaggugucucugcaagcugcucccauaacgggaagucaaguuuuuauaaaaauuuacuguggcuuaccggaaagaacggcuuguaccccaaucugagcaaaucuuaugccaacaauaaggaaaaagaggugcuaguacucuggggcguucaccacccuccaaacaucggggaucagcgcgcucuguaccauacggaaaacgcauacguguccgucgugucaagccacuauagucgaaaguucacucccgagauagccaagcguccuaaagugagagaccaggaaggaaggaucaauuacuauuggacccuucuggagccaggugauacaauuaucuuugaggcuaacggcaauuugauugccccgcgguacgcguucgcacucucucgcggguuuggauccggcaucauaaacagcaaugcccccauggacgaaugugaugcuaagugccagacuccucaaggugccauuaacucgucucugccauuccagaauguccaucccguuaccaucggggaguguccuaaauaugugagauccgcaaaguuaaggaugguaacaggacugcggaacauuccaucaauccagagucgcggccucuuuggcgcuaucgccggguucauugaaggagguuggaccggcaugguggacgggugguacggauaucaccaccagaaugagcaaggcagcgguuacgcggccgaucagaaauccacgcagaacgcaauaaaugggaucacuaacaaggucaauucugugauugaaaagaugaacacacaguuuaccgcuguuggcaaggaguucaauaaacuugagcgaagaauggaaaaccugaacaaaaagguggacgauggauucaucgacauauggacuuacaaugccgaguugcuaguccugcucgaaaacgagaggacacuggacuuucaugauagcaaugugcggaaccuuuaugaaaaaguaaagucacaacugaaaaauaacgcuaaggagauuggcaaugggugcuucgaguuuuaccacaaguguaacgacgaaugcauggagaguguuaaaaauggaaccuaugauuaccccaaguauuccgaagagagcaaauugaaccgugagaagaucgacggugugaaacucgaaucuaugggcgucuaccagauccuggccauuuauucaacgguggcaaguagcuuaguccugcuagugucccucggggccaucucuuucuggaugugcucgaauggaagccugcagugucgcauuugcauauga

SEQ ID NO: 124489 - RNA, 1698 nt, Artificial Sequence
  derived and/or modified sequence opt3 from hemagglutinin__InfluenzaA__ACI32737
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuccaaaagagaguuggagcuacaucguugaaauuccgaaccccgagaauggaaccuguuauccuggcuacuuugcugauuaugaggaacugagagagcaacucuccucugugucgucauucgaaagguuugagaucuucccaaaggagagcaguuggcccaaccauacugucacagguguguccgccucuugcagccacaaugggaaguccucauuuuaccggaacuuacuguggcuuaccggcaaaaauggauuguauccuaaccugaguaagagcuacgcaaauaacaaagaaaaggaggugcuaguucucuggggcgugcaucacccacccaacauaggggaccagcgcgcccuguaccacacggaaaaugcuuaugucucugugguguccucacauuacagccgacguuucacuccugagaucgcaaaaagaccaaaggucagggaucaggaaggacggauuaacuauuacuggacccuucuggagccgggugacacaaucauuuuugaggccaauggcaacuugaucgcuccccgcuucgccuuugcgcucaguagagggcugggaucuggcauaauuacuuccaaugcaccuauggaugaaugugacgccaagugccagaccccacaaggugcuaucaacagcucguuacccuuccagaauguucacccugugacaauuggggaguguccaaaauauguaaggucugccaagcugcggauggugaccggacuccgcaacauccccuccauccagucacgaggccuuuuuggcgcaauugcuggguucauagaaggagguuggacgggcauggucgaugggugguacggauaucaucaccagaaugagcaaggcagugguuacgccgcggaccagaaaagcacucagaacgccaucaaugggauuacaaacaagguaaauuccguuaucgaaaagaugaacacccaguuuacugcagugggcaaagaguucaauaaacuggagagaaggauggaaaacuugaacaagaaggucgaugacggauuccuagauauauggacauacaaugcugagcugcucgugcugcuugaaaacgagcggacccuggacuuucacgacucuaauguuaaaaacuuguaugaaaagguaaaaagccaacuccguaauaacgccaaggagauuggcaaugggugcuucgaguuuuaccauaaauguaacgaugaaugcauggagucagugaagaauggaacguaugacuacccgaaguauagugaagaguccaaacugaaccgcgagaagaucgauggugucaaauuagaaagcaugggcguguaccagauccuggcuauuuauucuaccgucgccucaagucuagugcuccugguuagccuuggggcaaucuccuucuggaugugcucuaauggaucguugcaguguagaauuugcauauga

SEQ ID NO: 124490 - RNA, 1698 nt, Artificial Sequence
  derived and/or modified sequence opt3 from hemagglutinin__InfluenzaA__ACI32739
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuucaucuuucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaauacucuggggcguacaucacccuccaaacaucgggaaccagcgcacucuguaccacaccgaaaaugccuauguuuccguggucucaagccauuacagucgacguuucacacccgagauuacuaaaagaccuaaggugagggaucaggaaggacggaucaacuauuacuggacccuucuggagccaggugacacaauuaucuuugaggcuaauggcaacuugauagcaccgugguaugccuucgcucucucucgcggguuuggauccggcauuaucaccagcaaugcccccauggaugaaugugacgcgaagugccagacgccucaaggugcaauuaacucgucucugccauuccagaaugugcaccccgucacuaucggggaguguccuaaauacguuagauccgccaaguuaaggauggugacaggacugcggaacaucccaucaauucagagucgcggccucuuuggcgcuauagccggguucaucgaaggagguuggaccggcaugguagaugggugguauggauaccaucaccagaaugagcaaggcagcgguuacgcagcugaccagaaauccacucagaacgccauuaaugggaucacaaacaaggugaauagcgucauagaaaagaugaacacccaguuuacggcggugggcaaagaguucaauaaacuugagcgaagaauggaaaaccugaacaagaagguugaugacggauucuuggauauuuggaccuauaaugccgagcuacuggugcuccuggaaaacgagaggacacuugacuuucacgacagcaaugucaaaaaccuguacgaaaaggugaaaucacaauugaagaauaacgcaaaagagaucggcaaugggugcuucgaguuuuaucauaaguguaacaaugaaugcauggagaguguaaagaacggaacuuacgauuaucccaaauacuccgaagagagcaagcucaaucgggagaaaaucgacgguguuaagcuggaaucuaugggcguguaucagauuuuagcuaucuacucaaccgucgccaguagccuggugcuacucgucucccugggggcuauuucuuucuggaugugcucgaacggaagccuucaguguaaaauaugcaucuga

SEQ ID NO: 124491 - RNA, 1698 nt, Artificial Sequence
  derived and/or modified sequence opt3 from hemagglutinin__InfluenzaA__ACI32740
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuucaucuuucgaaagguuugagaucuucccuaaggagaguuccuggccaaagcauacugugacaggugucucugcaagcugcucccacaaugggaaaucaaguuuuuaccggaacuuacuguggcuuaccggaaagaauggcuuguaucccaaccugagcaaaucuuacgccaauaacaaggaaaaagaggugcuaauacucuggggcguacaucacccuccaaauaucggggaucagcgcacgcuguaccacacugaaaacgcuuauguuuccguggucucaagccauuacagucgacguuucacccccgagauuacaaagagaccuaaggugagggaccaggaaggacggaucaacuauuacuggacucuucuggagccaggugauaccauuaucuuugaggcaaauggcaacuugauagccccgugguaugcuuucgcccucucucgcggguuuggauccggcauuaucacaagcaaugcgcccauggacgaaugugaugcaaaaugccagaccccucaaggugccauuaacucgucucugccauuccagaaugugcaccccgucacgaucggggaguguccuaaguacguuagauccgcuaaauuaaggauggugacuggacugcggaacaucccaucaauucagagucgcggccucuuuggcgccauagcaggguucaucgaaggagguuggacaggcaugguagacgggugguauggauaccaucaccagaaugagcaaggcagcgguuacgcugccgaucagaaguccacccagaacgcgauuaaugggaucacuaacaaagugaauagcgucauagaaaagaugaacacacaguuuaccgccgugggcaaagaguucaauaaacuugagcgaagaauggaaaaccugaauaagaaaguugacgauggauucuuggacauuuggacguauaacgcagagcuacuggugcuccuggaaaacgagaggacccuugacuuucacgauagcaaugucaagaaccuguacgaaaaagugaagucacaauugaaaaauaacgcuaaggagaucggcaaugggugcuucgaguuuuaucauaaguguaacaaugaaugcauggagaguguaaagaacggaacauacgacuaucccaaguacuccgaagagagcaaacucaaucgggagaagaucgaugguguuaaacuggacucuaugggcguguaucagauuuuagccaucuacucaacugucgcuaguagccuggugcuacucgucucccugggggccauuucuuucuggaugugcccgaacggaucgcuucaguguaccauaugcaucuga

SEQ ID NO: 124492 - RNA, 1698 nt, Artificial Sequence
  derived and/or modified sequence opt3 from hemagglutinin__InfluenzaA__ACI32741
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuucaucuuucgaaagguuugagaucuucccuaaggagaguuccuggccaaagcauacugugacaggugucucugcaagcugcucccacaaugggaaaucaaguuuuuaccggaacuuacuguggcuuaccggaaagaauggcuuguaucccaaccugagcaaaucuuacgccaauaacaaggaaaaagaggugcuaauacucuggggcguacaucacccuccaaauaucggggaucagcgcacgcuguaccacacugaaaacgcuuauguuuccguggucucaagccauuacagucgacguuucacccccgagauuacaaagagaccuaaggugagggaccaggaaggacggaucaacuauuacuggacucuucuggagccaggugauaccauuaucuuugaggcaaauggcaacuugauagccccgugguaugcuuucgcccucucucgcggguuuggauccggcauuaucacaagcaaugcgcccauggacgaaugugaugcaaaaugccagaccccucaaggugccauuaacucgucucugccauuccagaaugugcaccccgucacgaucggggaguguccuaaguacguuagauccgcuaaauuaaggauggugacuggacugcggaacaucccaucaauucagagucgcggccucuuuggcgccauagcaggguucaucgaaggagguuggacaggcaugguagacgggugguauggauaccaucaccagaaugagcaaggcagcgguuacgcugccgaucagaaguccacccagaacgcgauuaaugggaucacuaacaaagugaauagcgucauagaaaagaugaacacacaguuuaccgccgugggcaaagaguucaauaaacuugagcgaagaauggaaaaccugaauaagaaaguugacgauggauucuuggacauuuggacguauaacgcagagcuacuggugcuccuggaaaacgagaggacccuugacuuucacgauagcaaugucaagaaccuguacgaaaaagugaagucacaauugaaaaauaacgcuaaggagaucggcaaugggugcuucgaguuuuaucauaaguguaacaaugaaugcauggagaguguaaagaacggaacauacgacuaucccaaguacuccgaagagagcaaacucaaucgggagaagaucgaugguguuaaacuggacucuaugggcguguaucagauuuuagccaucuacucaacugucgcuaguagccuggugcuacucgucucccugggggccauuucuuucuggaugugcccgaacggaucgcuucaguguaagauaugcaucuga

SEQ ID NO: 124493 - RNA, 1698 nt, Artificial Sequence
  derived and/or modified sequence opt3 from hemagglutinin__InfluenzaA__ACI32742
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaauacucuggggcguacaucacccuccaaacaucggggaucagcgcacucuguaccacaccgaaaacgccuauguuuccguggucucaagccauuacagucgacguuucacacccgagauuacuaaaagaccuaaggugagggaccaggaaggacggaucaauuauuacuggacccuucuggagccaggugauacaauuaucuuugaggcuaacggcaauuugauagcaccgugguaugccuucgcucucucucgcggguuuggauccggcauuaucaccagcaacgcccccauggacgaaugugaugcgaagugccagacgccucaaggugcaauuaauucgucucugccauuccagaacgugcaccccgucacuaucggggaguguccuaaauacguuagauccgccaaguuaaggauggugacaggacugcggaauaucccaucaauucagagucgcggccucuuuggcgcuauagccggguucaucgaaggagguuggaccggcaugguagacgggugguauggauaccaucaccagaacgagcaaggcagcgguuacgcagcugaucagaaauccacucagaaugccauuaacgggaucacaaauaaggugaacucugucauagaaaagaugaauacccaguuuacggcggugggcaaagaguucaacaaacuugagcgaagaauggaaaaucugaacaagaagguugacgauggauucuuggacauuuggaccuauaacgccgagcuacuggugcuccuggaaaaugagaggacacuugacuuucacgauagcaacgucaaaaaucuguacgaaaaggugaaaucacaauugaagaacaaugcaaaagagaucggcaacgggugcuucgaguuuuaucauaaguguaauaacgaaugcauggagaguguaaagaauggaacuuacgacuaucccaaauacuccgaagagagcaagcucaaccgggagaaaaucgaugguguuaagcuggacucuaugggcguguaucagauuuuagcuaucuacucaaccgucgccaguagccuggugcuacucgucucccugggggcuauuucuuucuggaugugcucgaauggaagccuucaguguaaaauaugcaucuga

SEQ ID NO: 124494 - RNA, 1698 nt, Artificial Sequence
  derived and/or modified sequence opt3 from hemagglutinin__InfluenzaA__ACI32743
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggagcuuguuaucccggcuacuuugccgacuaugaggaacugagagagcaacucucuucgguuucaucuuucgaaagguuugagaucuucccuaagaagaguuccuggccaaaucauacugugacaggugucucugcaagcugcucccacaacgggaaaucaaguuuuuaccggaauuuacuguggcuuaccggaaagaacggcuuguaucccaaucugagcaaaucuuacgccaacaauaaggagaaagaagugcuaauacucuggggcguacaucacccuccaaacaucgggaaccagcgcacgcuguaccacacugagaaugcuuauguuuccguggucucaagccauuacagucgacguuucacccccgaaauuacaaagagaccuaaggugagggaucaggagggacggaucaacuauuacuggacucuucuggaaccaggugacaccauuaucuuugaggcaaauggcaacuugauagccccgugguaugcuuucgcccucucucgcggguuuggauccggcauuaucacaagcaaugcgcccauggaugagugugacgcaaaaugccagaccccucaaggugccauuaacucgucucugccauuccagaaugugcaccccgucacgaucggggaauguccuaaguacguuagauccgcuaaauuaaggauggugacuggacugcggaacaucccaucaauucagagucgcggccucuuuggcgccauagcaggguucaucgagggagguuggacaggcaugguagaugggugguauggauaccaucaccagaaugaacaaggcagcgguuacgcugccgaccagaaguccacccagaacgcgauuaaugggaucacuaacaaagugaauagcgucauagagaagaugaacacacaguuuaccgccgugggcaaagaguucaauaaacuugaacgaagaauggagaaccugaacaagaaaguugaugacggauucuuggauauuuggacguauaaugcagaacuacuggugcuccuggagaacgaaaggacccuugacuuucacgacagcaaugucaagaaccuguacgagaaagugaagucacaauugaaaaauaacgcuaaggaaaucggcaaugggugcuucgaguuuuaucauaaguguaacaaugagugcauggaaaguguaaagaacggaacauacgauuaucccaaguacuccgaggaaagcaaacucaaucgggagaagaucgacgguguuaaacuggauucuaugggcguguaucagauuuuagccaucuacucaacugucgcuaguagccuggugcuacucgucucccugggggccauuucuuucuggaugugcucgaacggaagccuucagugucguauaugcaucuga

SEQ ID NO: 124495 - RNA, 1701 nt, Artificial Sequence
  derived and/or modified sequence opt3 from hemagglutinin__InfluenzaA__ACJ09818
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaguggagguaacuaacgcgaccgaacuggugcagucuucaaguacaggugagaucugcgacagcccacaccagauucuagauggcgaaaauuguacccucaucgacgcucugcuuggggauccgcagugcgacggauuucaaaacaaaaagugggaucuguucgucgagagauccaaagccuauucuaauuguuaccccuaugacgugccugauuacgcaucguugaggucacucguugccagcaguggcacucuggaauuuaacaaugaguccuucaacuggacaggugugacccagaaugggacgucuagcgcuugcauacggcgcuccaacaauucauuuuucagucgacugaacuggcucacucauuuaaaguuuaaguauccagcacugaaugucaccaugcccaacaacgagaaauucgacaaguuguacaucuggggagugcaccauccuggcacagauaaugaccagauuuuucuuuaugcccaggcuagcggccguaucacuguaucuaccaaaagaucccaacagacaguuauuccaaacaucgggucaaggccccgggugcgcaauauaccuagcagaauuaguaucuacuggaccauugucaagccaggagauauccugcuaaucaacucuacggguaaucucauugccccgaggggcuacuucaaaauacgguccggaaagagcucgaucaugcgcucugacgcgcccauugggaaguguaacuccgaaugcaucacuccuaauggcucaauaccaaacgacaaacccuuucagaaugugaaccgaauuacauauggugcauguccuagauacgugaagcagaauacccugaaacuugccacugggaugaggaacgucccagagaagcaaacacggggaaucuucggcgcuaucgccggcuuuauugaaaaugggugggagggaaugguugaugguugguauggcuuccgucaccagaacagugaggggaucggacaggcagcugaccugaaaagcacccaagccgcgauugaucagauaaauggcaaguugaaccgccucaucgguaaaacgaacgaaaaguuccaccagauugagaaggaauuuuccgagguggaagggagaauccaggaccuggagaaauacguagaggauaccaagaucgacuuauggucuuauaaugccgaacugcucguggcacuugagaaccaacauacaauugaucugacugacagcgaaaugaauaaauuguucgagaagaccaaaaagcagcuaagggaaaacgcugaggauaugggcaauggaugcuuuaagauauaccacaaaugugacaacgccugcaucggcucaauucggaaugggacauaugaucaugacgucuaccgagacgaggcucugaacaaucgcuuccagaucaagggaguggaacucaaaagugguuacaaggauuggauucuguggaucuccuuugccaugagcugcuuccuucuguguguugcauugcucggcuuuauaaugugggccugccagaaagggaacaucagauguaauauuugcaucuga

SEQ ID NO: 124496 - RNA, 1683 nt, Artificial Sequence
  derived and/or modified sequence opt3 from hemagglutinin__InfluenzaA__ACJ67533
auggagaccaucagccugauuacaauacuccuuguggucacugccuccaacgcugacaagaucugcauuggccaccagucuaccaauucaaccgaaacaguugauacucugaccgagacaaacgugcccguaacccaugcaaaagaauuguuacacacugagcauaaugggaugcugugugccacaagucuaggacacccucucauccuggacacgugcacgauugaaggucuuguguacggcaacccaagcugugaucuguugcucgaggggagagagugguccuauaucgucgaaaggucuucggcggugaauggaacuugcuacccgggcaacguugagaaucuggaggaacugcggacccucuucucaagcgcuaguuccuaucaacgcauacagaucuuucccgacacaacuuggaacgugaccuacacagguaccucucgagccuguagcggguccuucuaucguucaaugagaugguuaacgcagaagaguggauuuuacccuguccaggaugcacaauauacuaauaacaggggcaaaagcauucuguucguguggggcauccaucacccacccacauacgccgagcagaccaaucuuuacauucggaacgacacuacaaccucuguaacgaccgaagauuugaaucgcacauuuaagccuguuaucgggccaagaccccuggugaacggacuacaggguaggauagacuauuacugguccguccucaaaccuggccagacucugcgggugcgcucaaaugggaaccuuauugcuccaugguauggacacgugcugagcggcgguagucaugggcgaaucuugaagaccgaucucaagucuggauccugcgucguucaaugucagacagagaaaggcggccugaacagcacuuuaccguuccacaauauuucgaaguacgcauuugggaccugccccaaauaugugagaguaaacucucugaagcucgccgugggacuuaggaaugucccugcucgguccucacguggucuguucggcgccaucgcgggguuuaucgaaggaggcuggccagguuugguggcagggugguacggcuuccagcauaguaacgaccagggaguuggcauggccgcugaucgcgacagcacacaaaaagccauugauaagauaaccuccaaggugaauaacaucgucgacaaaaugaauaagcaguaugagauuaucgaccacgaauuuucugagguggagacuagacuaaacaugauaaauaacaaaauugaugaccagauccaagauguaugggcauacaaugcugaacugcucguucugcuugagaaccagaagacgcuggacgaacacgaugccaaugugaacaauuuguacaacaaagucaagagggcgcucgggagcaacgccauggaggacggaaaagguuguuucgaacuguaucauaagugcgaugaccaguguauggagacaauccggaauggcaccuacaaccgacgcaaguauagagaggaaucaagguuagagcggcagaaaauugaaggggugaagcuggagagugaacgcacuuacaaaauccuaaccauuuauuccacagucgcaagcucucucgugcuggcuaugggauuugccgcuuuccuuuucugggccaugucaaauggcaguugcagaugcaacauauguaucuga

SEQ ID NO: 124497 - RNA, 1704 nt, Artificial Sequence
  derived and/or modified sequence opt3 from hemagglutinin__InfluenzaA__ACJ68607
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucggugauugcucaguggccggcuggcugcuugggaacccuaugugugacgaguucaucaauguuccagaauggaguuauauaguggagaaggcgaacccggcuaaugaucugugcuaccccggaaacuuuaaugacuaugaggaauugaagcaucuccugagcagaaucaaccacuucgagaaaauucagaucauuccuaaguccucuuggucggaucaugaagccucaagcggcgucaguuccgcauguccauaccaggguacacccucuuucuucaggaaugugguauggcugaucaaaaagaacaauacuuauccuaccauaaaacggagcuacaacaauacaaaccaagaggaccucuuaauucugugggggauccaccacuccaacgaugccgcugagcagaccaaacuuuaucagaauccaacuacauacauuucaguuggaaccaguacguugaaccagcgccuggugcccaagaucgcaacucgaagcaaagucaauggccaaucuggccguauggacuuuuucuggaccauccuaaagccuaacgaugccauuaauuuugaauccaacgggaauuucauagcuccagaguacgccuauaaaaucgugaagaaaggagacucagcgauuaugaaaagcgaaguggaguacgguaacugcaauacaaagugucagacuccgaucggcgcaauaaacaguucuaugcccuuucauaauauucacccucucaccaucggggaaugcccaaaguaugucaaguccaacaaacugguucuugccacaggacugagaaauagccccuugagggagcggcgcagaaagaggggccucuucggugcuaucgccggguuuauugagggaggcuggcagggcaugguggacgggugguacggauaucaucacucgaacgaacaggguucuggcuacgcagcugauaaagaguccacccaaaaggccaucgacgggguaacgaauaaagugaacucaauuauagauaagaugaacacucaguucgaagcggucggacgggaguuuaauaaccuggaacgccgaaucgagaauuuaaacaagaaaauggaggacggcuuccuggauguguggacauauaaugccgaacuccuuguucugauggagaacgaaagaaccuuggacuuccacgauaguaaugugaagaaccuauacgacaaagucaggcugcagcuccgggauaaugcaaaggagcuggguaacggguguuuugaauuuuaccauaaaugcgacaaugaguguauggagagcgugcguaacggcacuuaugauuacccucaauauuccgaagaggcucgccuuaagagagaagagauuucuggaguaaagcuggagagcaucggcacauaccagaucuugucaauuuauaguaccguugccuccagccucgcucuggccauaaugguggcaggguuaucucuguggaugugcucaaauggaagucuacagugcaggaucuguauuuga

SEQ ID NO: 124498 - RNA, 1704 nt, Artificial Sequence
  derived and/or modified sequence opt3 from hemagglutinin__InfluenzaA__ACJ68609
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcagcuacaacaauacaaaccaagaggaccucuuaauucugugggguauccaccacuccaacgaugccgcugagcagaccaaacuuuaucagaauccaacuacauacauuucaguugggaccaguacguugaaccagcgacuggugcccaagaucgcaacucguagcaaagucaauggacaaucuggcagaauggacuuuuucuggaccauccuaaagccuaacgaugccauuaauuuugaauccaacggcaauuucauagcuccagaguacgccuauaaaaucgugaagaaaggggacucagcgauuaugaagucugaaguggaguacggaaacugcaauacaaaaugucagacuccgaucggugcaauaaacaguucuaugcccuuucauaauauucacccucucaccaucggcgaaugcccaaaguaugucaaguccaacaaacugguucuugccacagggcugaggaauagccccuugcgggagcgcagaaggaagcggggacucuucggcgcuaucgccgguuuuauugaagggggauggcagggcaugguggacggcugguacggguaucaucacucgaacgaacagggaucugguuacgcagcugauaaagaguccacccaaaaggccaucgacggcguaacgaauaaagugaacucaauuauagauaagaugaacacucaguucgaagcggucgggcgcgaguuuaauaaccuggaacgaagaaucgagaauuuaaacaagaaaauggaggacggauuccuggauguguggacauauaaugccgaacuccuuguucugauggagaacgaaaggaccuuggacuuccacgauaguaaugugaagaaccuauacgacaaaguccggcugcagcuccgugauaaugcaaaggagcugggcaacgguuguuuugaguucuaccauaaaugcgacaaugaguguauggagagcgugcgcaacgggacuuaugauuacccucaauauuccgaagaggcuagacuuaggcgggaagagauuucuggcguaaagcuggagagcaucggaacauaccagaucuugucaauuuauaguaccguugccuccagccucgcucuggccauaaugguggcaggcuuaucucuguggaugugcucaaaugggagucuacagugccgaaucuguauuuga

SEQ ID NO: 124499 - RNA, 1704 nt, Artificial Sequence
  derived and/or modified sequence opt3 from hemagglutinin__InfluenzaA__ACJ68610
auggagaagaucgugcuguuccucgccauugucagccuuguuaaguccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggcuaaugaucuuugcuaccccgggaacuucaaugacuaugaggaacugaagcauuugcucagcaggaucaaccacuuugagaaaauucagaucauuccuaaguccucuuggucggaucaugaagccucaagcggagucaguuccgcauguccauaccagggcacacccucuuucuuucggaaugugguauggcugaucaaaaagaacaauacuuauccuaccauaaaacgcagcuacaacaauacaaaccaagaggaccugcucauuuuaugggguauccaccacuccaacgaugccgcugagcagaccaagcuguaucagaauccaacuacauacauuucaguugggaccaguacgcuuaaccagcgauuggugcccaagaucgcaacucguagcaaagucaauggacaaucuggcagaauggacuucuuuuggaccauccugaagccuaacgaugccauuaauuucgaauccaacggcaauuuuauagcuccagaguacgccuauaaaaucgugaagaaaggggacucagcgauuaucaagagcgaaguggaguacggaaacugcaauacaaaaugucagacuccgauaggugcaauuaacaguucuaugcccuuccauaauauccacccucuaaccaucggcgaaugcccaaaguaugucaaguccaacaaacucguucuggccacagggcuuaggaauagcccccugcgggagcgcagaaggaagcggggauuguuuggcgcuauugccgguuucaucgaagggggauggcagggcaugguggacggcugguacggguaucaucacucgaacgaacagggaucugguuacgcagcugauaaagaguccacccaaaaggccauugacggcguaacgaauaaagugaacucaauaaucgauaagaugaacacucaguuugaagcggucgggcgcgaguucaauaaccucgaacgaagaauugagaaucugaacaagaaaauggaggacggauucuuagauguguggacauauaaugccgaacugcucguucuuauggagaacgaaaggacccuggacuuucacgauaguaaugugaagaacuuguacgacaaaguccggcuacagcugcgugauaaugcaaaggagcucggcaacgguuguuucgaauuuuaccauaaaugcgacaaugaguguauggagagcgugcgcaacgggacuuaugauuacccucaauauuccgaagaggcuagacugaagagggaagagaucucuggcguaaaacuugagagcaucggaacauaccagauucugucaauauauaguaccguugccuccagcuuggcucucgccaucaugguggcaggccugucuuuauggaugugcucaaaugggagucugcagugccggauuuguaucuga

SEQ ID NO: 124500 - RNA, 1704 nt, Artificial Sequence
  derived and/or modified sequence opt3 from hemagglutinin__InfluenzaA__ACJ68611
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucacugggagucagcagugcauguccauaccagggcaugcccuccuuuuuccggaaugugguauggcucaucaaaaagaacaauacauauccuacuauaaaacgcucuuacaacaauaccaaccaagaggacuuacugauucuuugggguauccaccacagcaacgaugccgcugagcagacaaaguuguaucagaauccaaccacuuacauuuccguugggacaucaacccugaaccagcgucuagugcccaagaucgcaacgcgaaguaaagucaauggacaaagcggcagaauggacuuuuucuggacuauccucaagccuaacgaugccauuaauuuugaaucuaacggcaauuucauagcuccagaguacgccuauaaaaucgugaagaaaggggacuccgcgauuaugaagucagaagugggauacgguaacugcaauaccaaaugucagacaccgaucggcgcaauaaacagcaguaugcccuuucauaauauucacccucugacuaucggggagugcccaaaguaugucaagucuaacaaacuuguucuggccaccggauugaggaauagcccccuccgggaacgcagaaggaagcggggccuguucggugcuaucgccggguuuauugagggaggcuggcagggcaugguggacgggugguacggauaucaucacuccaacgagcaggguucgggcuacgcagcugauaaagaaucuacacaaaaggccaucgacgggguaaccaauaaagugaacuccauuauagauaagaugaacacgcaguucgaggcggucggacgcgaauuuaauaacuuagagcgaagaaucgaaaaucugaacaagaaaauggaggacggcuuccucgauguguggacuuauaaugccgagcuucugguuuugauggaaaacgagaggacacuagacuuccacgauucaaaugugaagaaccuguacgacaaaguccggcuccagcugcgugauaaugcaaaggaacuugguaacggguguuuugaguucuaccauaaaugcgacgaugaauguauggagagugugcgcaauggcaccuaugacuacccucaauauagcgaggaagcuagacugaagagggaggaaauuuccggaguaaaguuggagucuaucggcacuuaccagauccucagcauuuauucaacaguugccaguucccuggcuuuagccauaaugguggcagggcugagccuauggaugugcucuaacggaucacuccagugccggaucuguauuuga

SEQ ID NO: 124501 - RNA, 1704 nt, Artificial Sequence
  derived and/or modified sequence opt3 from hemagglutinin__InfluenzaA__ACJ68612
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggccagaucaugaagccucgucaggagucagcagugcaugucccuaccagggcacaccuuccuuuuuccggaaugugguauggcugaucaaaaagaacaauacuuauccaaccauaaaacgcucuuacaacaauacaaaccaagaggaccucuuaauucugugggguauccaccacagcaacaaugccgcugagcagaccaagcuauaucagaaccccacuacauacauuuccguugggaccucaacguugaaucugcgacuugugccuaagaucgcaacucguaguaaagucaacggacagagcggcagaauggauuucuucuggaccauccucaagccaaaugacgccauuaacuuugaaucuaauggcaacuucauagcuccggaguacgccuauaaaaucgugaagaaaggggauuccgcgauuaugaagucagaaguggaguacggaaauugcaacacaaaaugucaaacucccaucggugcaauaaauagcaguaugccuuuucauaacauucacccacugaccaucggcgaaugccccaaguaugucaagucuaauaaacuuguucuggccacaggguugaggaacuccccucuccgggagcgcagaaggaagcggggacuguucggcgcuaucgccgguuuuauugaagggggauggcagggcaugguggacggcugguacggguaucaucacagcaaugaacagggaucggguuacgcagcugacaaagagucuacccagaaggccaucgauggcguaacgaacaaagugaacuccauuauagacaagaugaauacucaauucgaagcggucgggcgcgaguuuaacaauuuagaacgaagaaucgagaaccugaauaagaaaauggaggauggauuccucgacguguggacauauaacgccgaacuucugguuuugauggagaaugaaaggacccuagauuuccacgacucaaacgugaagaaucuguacgauaaaguccggcuccagcugcgugacaacgcaaaggagcuuggcaaugguuguuuugaauuuuaccauaaaugcgauaacgaguguauggagagugugcgcaaugggacuuaugacuacccacaguauagcgaagaggcuagacugaagagggaagagauuuccggcguaaaguuggagucuaucggagccuaccaaauccucagcauuuauucaacaguugcuaguucccuggccuuagcaauaaugguggccggccugagccuauggaugugcucuaacgggucacuccagugccggaucuguauuuga

SEQ ID NO: 124502 - RNA, 1704 nt, Artificial Sequence
  derived and/or modified sequence opt3 from hemagglutinin__InfluenzaA__ACJ68613
auggagaagaucgugcuguuccucgccauugucagccacguuaaauccgaccagauaugcaucggcuaccaugcuaacaauucuaccgaacaaguggauacaauuauggagaagaacguaacugugacgcacgcacaggacauccuugagaaaacccauaaugggaagcugugugauuugggaggugucaaacccuuaauucugagagacugcucaguggccggcuggcuacucgggaacccuaugugugaugaauuuaucaauguuccagaauggaguuauauaguggagaaggcgaacccggcuaaugaccugugcuaccccggaaacuucaaugauuaugaggaacuuaagcaccuguugagcaggaucaaccauuuugagaaaauucagaucauuccuaaguccucuuggucggaccacgaagccucaagcggcgucaguuccguguguccauaccaggguacacccucuuucuuucggaauguaguuuggcucaucaaaaagaacaauacuuauccuaccauuaaaaagagcuacaacaauacaaaccaagaggaucugcugauacucugggggauccaccauuccaacgacgcagccgagcagaccaaguuauaucagaauccaacuacauacauuucagugggaaccaguacgcugaaccagcgccuuguccccaaaaucgcuacucgaagcaaggugaauggccaaucuggccguauggauuucuuuuggaccaucuugaaaccuaacgacgcaauuaauuucgaauccaacgggaauuuuauagccccagaguacgcuuauaagaucgugaaaaagggagauucagccauuaugaaaagcgaagucgaguacgguaacugcaauacaaagugucagacuccgaucggcgcgauaaacaguucuaugcccuuccacaauauucauccucugaccaucggggaaugcccaaaguauguuaaauccaacaagcuagugcucgcaacaggacugagaaauagcccccuuagggagcggcgcagaaaaaggggccuguuuggugccaucgcuggguucauugagggaggcuggcagggcaugguagacgggugguacggauaucaccacucgaacgaacaggguucuggcuacgccgcagacaaggaguccacccaaaaagcuaucgauggggugacgaauaaggucaacucaauuauagacaagaugaacacucaguuugaagccgugggacgggaguucaauaacuuggaacgccgaaucgagaaucucaacaaaaagauggaggauggcuuccuggacguuuggacauauaaugcggaauuacuggugcucauggagaacgaaagaacccuugauuuucaugacaguaaugucaaaaaccuguacgauaaggugagguugcagcuacgggacaaugccaaagagcuggguaacggguguuucgaauuuuaccacaagugcgauaaugaguguauggagagcguacguaacggcacuuaugacuacccucaauauuccgaagaggcacgccucaagagagaagagauuucuggaguuaaacuggagagcaucggcacauaccagauccuuucaauuuauaguaccguggcuuccagccuggccuuggcuauaauggucgccgggcucucucuguggaugugcucaaauggaaguuuacagugcaggaucuguauuuga

SEQ ID NO: 124503 - RNA, 1707 nt, Artificial Sequence
  derived and/or modified sequence opt3 from hemagglutinin__InfluenzaA__ACJ68614
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggucaaugauuugugcuaccccgggaacuuuaaugacuaugaggaacucaagcaucugcugagcaggaucaaccacuucgagaaaauucagaucauuccuaaguccucuuggucggaucaugaagcgucaagcggagugaguuccgcuuguccauaccagggccggucuagcuuuuuccgcaauguaguuuggcucaucaaaaagaacaauacauaucccacuauaaaacgauccuacaacaauaccaaccaagaggacuuacuggugcuuugggguauucaccacccuaacgaugccgcagagcagacacguuuguaucagaauccaaccacuuacaucucagucgggacaaguacccugaaccagaggcuagugcccaagcucgccacgagaagcaaggugaauggacaaucuggccggauggaauuuuucuggacuauucugaaaccuaacgacgcuaucaauuuugaguccaacggcaauuucaucgcaccagaaaacgccuacaagauugucaaaaagggggauucaaccauaaugaaaagcgagcuugaauauggaaauugcaacacaaagugucagacuccgaucggugcuauuaauaguucuaugcccuuucauaacauccacccucugaccauaggcgagugcccaaaauacguuaaguccaaucgcuuggugcucgccacagggcugagaaacagcccccagggagagaggcggcgcaagaaacgaggcuuauucggugcgauugcaggguuuaucgaaggaggcuggcagggcaugguagacgggugguauggauaccaucacucgaaugagagagguucuggcuaugccgcugacaaggaauccacccaaaaagccaucgauggggugacgaacaaggucaacucaauuaucgacaaaaugaauacucaguucgaggcagugggaagggaauuuaacaaucuggagcggcguauugagaaccucaauaagaagauggaagauggcuuccuugacguuuggacauacaacgcugagcuguuggugcuaauggaaaaugagcgcacccuggauuuccacgacaguaacgucaaaaaucucuaugauaaggugagacugcagcuuagggacaacgccaaagaacuggguaauggguguuuugaguucuaccaucggugcgauaacgaguguauggaaagcguacgaaauggcacuuacgacuauccucaauacuccgaggaagcgcgcuugaagagagaggagauaucuggaguuaaacucgaaagcaucggcacauaucagauucugucaaucuacaguaccguggccuccagcuuagcacuggcuaucauggucgccgggcuaucucucuggaugugcucaaacggaagucugcagugcaggauuuguauauga

SEQ ID NO: 124504 - RNA, 1698 nt, Artificial Sequence
  derived and/or modified sequence opt3 from hemagglutinin__InfluenzaA__ACK99007
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaccaccagaacgagcaaggcagcgguuacgccgcggaccagaaguccacgcagaaugccauaaacgggaucacuaauaaagugaacucuguuauugaaaagaugaauacacaguuuaccgcagugggcaaggaguucaacaaacuugagcgccgaauggaaaaccugaauaagaaagucgaugacggauucaucgauauauggacuuacaacgcugaguugcuagugcugcucgaaaaugagagaacacuggacuuucaugacagcaacguaaagaaucuuuaugaaaaaguuaagucacaacugaagaacaaugccaaagagauuggcaacgggugcuucgaguuuuaccacaaguguaaugaugaaugcauggagagugugaaaaacggaaccuaugacuaccccaaguauuccgaagagagcaaauugaauagggagaagaucgauggugucaagcucgaaucuaugggcguguaccagauccuggcuauuuauucaacggucgccaguagcuuagugcugcuaguuucccucggggcaaucucuuucuggaugugcucgaacggaagccugcagugucggauuugcauauga

SEQ ID NO: 124505 - RNA, 1698 nt, Artificial Sequence
  derived and/or modified sequence opt3 from hemagglutinin__InfluenzaA__ACK99008
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaccaccagaacgagcaaggcagcgguuacgccgcggaccagaaguccacgcagaaugccauaaacgggaucacuaauaaagugaacucuguuauugaaaagaugaauacacaguuuaccgcagugggcaaggaguucaacaaacuugagcgccgaauggaaaaccugaauaagaaagucgaugacggauucaucgauauauggacuuacaacgcugaguugcuagugcugcucgaaaaugagagaacacuggacuuucaugacagcaacguaaagaaucuuuaugaaaaaguuaagucacaacugaagaacaaugccaaagagauuggcaacgggugcuucgaguuuuaccacaaguguaaugaugaaugcauggagagugugaaaaacggaaccuaugacuaccccaaguauuccgaagagagcaaauugaauagggagaagaucgauggugucaagcucgaaucuauggagguguaccagauccuggcuauuuauucaacggucgccaguagcuuagugcugcuaguuucccucggcgcaaucucuuucuggaugugcucgaacgggagccugcagugucggauuugcauauga

SEQ ID NO: 124506 - RNA, 1698 nt, Artificial Sequence
  derived and/or modified sequence opt3 from hemagglutinin__InfluenzaA__ACK99009
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuacuuuugaagccaauggcaacuugaucgcuccgagguacgccuucgcgcucucucggggguuuggauccggcauuaucaauagcaacgcacccauggauaagugugacgccaaaugccagaccccucaaggugcuauaaauucgucucugccauuccagaacguucaucccgugacaauuggggaguguccuaaguauguacgcuccgccaaauuaagaauggugaccggacugaggaauaucccaucaauucagagucggggccucuuuggcgcaaucgcuggguucaucgaaggagguuggacgggcauggucgaugggugguacggauaucaccaccagaacgagcaaggcagcgguuacgccgcggaccagaaguccacucagaaugccauuaacgggauaacaaauaaagugaacucuguuaucgaaaagaugaauacccaguuuacugcagugggcaaggaguucaacaaacuugagcgccgaauggaaaaccugaauaagaaagucgaugacggauucauugauaucuggacauacaacgcugaguugcuagugcugcucgaaaaugagagaacccuggacuuucaugacagcaacguaaagaaucuuuaugaaaaaguuaagucacaacugaagaacaaugccaaagagauaggcaacgggugcuucgaguuuuaccacaaguguaaugaugaaugcauggagagugugaaaaacggaacguaugacuaccccaaguauuccgaagagagcaaauugaauagggagaagauugauggugucaagcucgaaucuaugggcguguaccagauccuggcuaucuauucaaccgucgccaguagcuuagugcugcuaguuucccucggggcaauuucuuucuggaugugcucgaacggaagccugcagugucggaucugcauuuga

SEQ ID NO: 124507 - RNA, 1698 nt, Artificial Sequence; identical to SEQ ID NO: 124504
  derived and/or modified sequence opt3 from hemagglutinin__InfluenzaA__ACK99011

SEQ ID NO: 124508 - RNA, 1698 nt, Artificial Sequence
  derived and/or modified sequence opt3 from hemagglutinin__InfluenzaA__ACK99012
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaccaccagaacgagcaaggcagcgguuacgccgcggaccagaaguccacgcagaaugccauaaacgggaucacuaauaaagugaacucuguuauugaaaagaugaauacacaguuuaccgcagugggcaaggaguucaacaaacuugagcgccgaauggaaaaccugaauaagaaagucgaugacggauucaucgauauauggacuuacaacgcugaguugcuagugcugcucgaaaaugagagaacacuggacuuucaugacagcaacguaaagaaucuuuaugaaaaaguuaagucacaacugaagaacaaugccaaagagauuggcaacgggugcuucgaguuuuaccacaaguguaaugaugaaugcauggagagugugaaaaacggaaccuaugacuaccccaaguauuccgaagagagcaaauugaauagggagaagaucgauggugucaagcucgaaucuaugggcguguaccagauccuggcuauuuauucaacggucgccaguagcuuagugcugcuaaucucccucggggcaauuucuuucuggaugugcucgaacggaagccugcagugucggauaugcaucuga

SEQ ID NO: 124509 - RNA, 1698 nt, Artificial Sequence; identical to SEQ ID NO: 124504
  derived and/or modified sequence opt3 from hemagglutinin__InfluenzaA__ACK99013

SEQ ID NO: 124510 - RNA, 1698 nt, Artificial Sequence
  derived and/or modified sequence opt3 from hemagglutinin__InfluenzaA__ACK99014
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucacucucucucggggguuuggauccggcaucauaaauagcaacgcgcccauggauaagugugacgcaaaaugccagaccccucaaggugccauuaauucgucucugccauuccagaacguucaucccgugacaaucggggaguguccuaaguauguacgcuccgcuaaauuaagaauggugaccggacugaggaauauuccaucaauccagagucggggccucuuuggcgccaucgcaggguucauugaaggagguuggacgggcauggucgaugggugguacggauaucaccaccagaacgagcaaggcagcgguuacgcugccgaccagaaguccacucagaaugcgauaaacgggaucacaaauaaagugaacucuguuauugaaaagaugaauacccaguuuacugccgugggcaaggaguucaacaaacuugagcgccgaauggaaaaccugaauaagaaagucgaugacggauucaucgauauauggacauacaacgcagaguugcuagugcugcucgaaaaugagagaacccuggacuuucaugacagcaacguaaagaaucuuuaugaaaaaguuaagucacaacugaagaacaaugcuaaagagauuggcaacgggugcuucgaguuuuaccacaaguguaaugaugaaugcauggagagugugaaaaacggaacguaugacuaccccaaguauuccgaagagagcaaauugaauagggagaagaucgauggugucaagcucgaaucuaugggcguguaccagauccuggccauuuauucaaccgucgcuaguagcuuagugcugcuaguuucccucggggccaucucuuucuggaugugcucgaacggaagccugcagugucggauuugcauauga

SEQ ID NO: 124511 - RNA, 1698 nt, Artificial Sequence; identical to SEQ ID NO: 124504
  derived and/or modified sequence opt3 from hemagglutinin__InfluenzaA__ACK99016

SEQ ID NO: 124512 - RNA, 1698 nt, Artificial Sequence; identical to SEQ ID NO: 124504
  derived and/or modified sequence opt3 from hemagglutinin__InfluenzaA__ACK99018

SEQ ID NO: 124513 - RNA, 1698 nt, Artificial Sequence; identical to SEQ ID NO: 124504
  derived and/or modified sequence opt3 from hemagglutinin__InfluenzaA__ACK99023

SEQ ID NO: 124514 - RNA, 1698 nt, Artificial Sequence
  derived and/or modified sequence opt3 from hemagglutinin__InfluenzaA__ACK99026
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccaucaccauuggggaguguccuaaguaugugcgcuccgccaaauuaagaaugguaacaggacugaggaauaucccaucaauccagagucggggccucuuuggcgcaauugcuggguucauagaaggagguuggaccggcaugguggaugggugguacggauaucaccaccagaacgagcaaggcagcgguuacgccgcggaccagaaguccacgcagaaugccaucaacgggauuacuaauaaagucaacucugugaucgaaaagaugaauacacaguuuaccgcaguuggcaaggaguucaacaaacuugagcgccgaauggaaaaccugaauaagaaaguggaugacggauucauagauauuuggacuuacaacgcugaguugcuaguccugcucgaaaaugagagaacacuggacuuucaugacagcaacgugaagaaucuuuaugaaaaaguaaagucacaacugaagaacaaugccaaagagaucggcaacgggugcuucgaguuuuaccacaaguguaaugaugaaugcauggagaguguuaaaaacggaaccuaugacuaccccaaguauuccgaagagagcaaauugaauagggagaagaucgauggugugaagcucgaaucuaugggcgucuaccagauucuggcuaucuauucaacgguggccaguagcuuaguccugcuagugucccucggggcaauuucuuucuggaugugcucgaacggaagccugcagugucggauaugcaucuga

SEQ ID NO: 124515 - RNA, 1698 nt, Artificial Sequence; identical to SEQ ID NO: 124188
  derived and/or modified sequence opt3 from hemagglutinin__InfluenzaA__ACK99027

SEQ ID NO: 124516 - RNA, 1698 nt, Artificial Sequence
  derived and/or modified sequence opt3 from hemagglutinin__InfluenzaA__ACK99028
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccuaagggugcuauuaauucgucucugccauuccaaaacguucaucccgugaccaucggggaguguccuaaauauguacgcuccgccaaguuaagaauggugacaggacugaggaauauuccaucaauccagagucggggccucuuuggcgcaaucgcuggguucauugaaggagguuggaccggcauggucgaugggugguacggauaucaccaccagaacgagcagggcagcgguuacgccgcggaccaaaaauccacgcagaaugccauaaacgggaucacuaauaaggugaacucuguuauugaaaagaugaauacacaguuuaccgcagugggcaaagaguucaacaaacuugagcgccgaauggaaaaccugaauaaaaaggucgaugacggauucaucgauauauggacuuacaacgcugaguugcuagugcugcucgaaaaugagagaacacuggacuuucaugacagcaacguuaaaaaucuuuaugaaaagguaaagucacagcugaaaaacaaugccaaggagauuggcaacgggugcuucgaguuuuaccacaaauguaaugaugaaugcauggagagugugaagaacggaaccuaugacuaccccaaauauuccgaagagagcaaguugaauagggagaagaucgauggugucaaacucgaaucuaugggcguguaccaaauccuggcuauuuauucaacggucgccaguagcuuagugcugcuaguuucccucggggcaaucucuuucuggaugugcucgaacggaagccugcagugucggauuugcauauga

SEQ ID NO: 124517 - RNA, 1698 nt, Artificial Sequence
  derived and/or modified sequence opt3 from hemagglutinin__InfluenzaA__ACK99029
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauaucuaagcgaccuaaaguccgugaucaggagggaagaaucaacuacuauuggacccuucuggagccaggugacacaauuaucuuugaagcaaauggcaacuugauugccccgagguacgcuuucgcccucucccggggguuuggaagcggcaucauaaauucgaacgcgcccauggauaagugugacgcaaaaugccagacuccucaaggugccauuaauucuucccugccauuccagaacguucaucccgugaccaucggggaguguccuaaguauguacgcucagcuaaauuaagaauggugacaggacugaggaauauuccaaguauccagagccggggccucuuuggcgccaucgcaggguucauugaaggagguuggaccggcauggucgaugggugguacggauaucaccaccagaacgagcaaggcuccgguuacgcugccgaccagaagucuacgcagaaugcgauaaacgggaucacuaauaaagugaacagcguuauugaaaagaugaauacacaguuuaccgccgugggcaaggaguucaacaaacuugagcgccgaauggaaaaccugaauaagaaagucgaugacggauucaucgauauauggacuuacaacgcagaguugcuagugcugcucgaaaaugagagaacacuggacuuucaugacucaaacguaaagaaucuuuaugaaaaaguuaagagucaacugaagaacaaugcuaaagagauuggcaacgggugcuucgaguuuuaccacaaguguaaugaugaaugcauggaguccgugaaaaacggaaccuaugacuaccccaaguauagcgaagagucuaaauugaauagggagaagaucgauggugucaagcucgaaucaaugggcguguaccagauccuggccauuuauaguacggucgcuagcuccuuagugcugcuaguuucucucggggccaucucguucuggaugugcagcaacggaucccugcagugucggauuugcauauga

SEQ ID NO: 124518 - RNA, 1698 nt, Artificial Sequence; identical to SEQ ID NO: 124504
  derived and/or modified sequence opt3 from hemagglutinin__InfluenzaA__ACK99030

SEQ ID NO: 124519 - RNA, 1698 nt, Artificial Sequence; identical to SEQ ID NO: 124504
  derived and/or modified sequence opt3 from hemagglutinin__InfluenzaA__ACK99031

SEQ ID NO: 124520 - RNA, 1698 nt, Artificial Sequence; identical to SEQ ID NO: 124504
  derived and/or modified sequence opt3 from hemagglutinin__InfluenzaA__ACK99032

SEQ ID NO: 124521 - RNA, 1698 nt, Artificial Sequence; identical to SEQ ID NO: 124504
  derived and/or modified sequence opt3 from hemagglutinin__InfluenzaA__ACK99033

SEQ ID NO: 124522 - RNA, 1698 nt, Artificial Sequence
  derived and/or modified sequence opt3 from hemagglutinin__InfluenzaA__ACK99034
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucgggauuuuggguccggaaucauaaauagcaacgcacccauggacaagugugaugccaaaugccagacuccucaaggcgcuauuaauucgucucugccauuccagaacguucaucccgugaccaucggugaguguccuaaguauguacgcuccgccaaauuaagaauggugacagggcugaggaauauuccaucaauccagagucggggacucuuuggcgcaaucgcuggcuucauugaagggggauggaccgguauggucgacggcugguacggguaucaccaccagaacgagcaaggaagcggcuacgccgcggaucagaaguccacgcagaaugccauaaacgguaucacuaauaaagugaacucuguuauugaaaagaugaauacacaguuuaccgcaguggggaaggaguucaacaaacuugagcgccgaauggaaaaccugaauaagaaagucgacgauggcuucaucgacauauggacuuacaacgcugaguugcuagugcugcucgaaaaugagagaacacuggacuuucaugauagcaacguaaagaaucuuuaugaaaaaguuaagucacaacugaagaacaaugccaaagagauuggaaacggcugcuucgaguuuuaccacaaguguaaugacgaaugcauggagagugugaaaaacgggaccuaugauuaccccaaguauuccgaagagagcaaauugaauagggagaagaucgacggagucaagcucgaaucuauggguguguaccagauccuggcuauuuauucaacggucgccaguagcuuagugcugcuaguuucccucggcgcaaucucuuucuggaugugcucgaacgggagccugcagugucggauuugcauauga

SEQ ID NO: 124523 - RNA, 1698 nt, Artificial Sequence
  derived and/or modified sequence opt3 from hemagglutinin__InfluenzaA__ACK99035
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugucagccuucgaaagguuugagauuuucccuaaggagagcaguuggccaaaccacacugucacagguguguccgcaucuugcagccauaauggggaauccucauuuuaucggaacuuacuguggcuuaccggcaaaaauggauuguaccccaaccugaguaagagcuaugccaauaacaaagagaaggaaguucuaguacucuggggcgugcaccacccuccaaacaucggggaccagaaagcucuguaccauacggagaaugcauacgucucugugguguccucacacuauagccgcaaguucacucccgaaauaaguaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacacucccauggauaagugugacgcaaaaugccagaccccucaaggugccauuaauucgucucugccauuccagaacguucaucccgugacaaucggggaguguccuaaguauguacgcuccgcuaaauuaagaauggugaccggacugaggaauauuccaucaauccagagucggggccucuuuggcgccaucgcaggguucauugaaggagguuggacgggcauggucgaugggugguacggauaucaccaccagaacgagcaaggcagcgguuacgcugccgaccagaaguccacucagaaugcgauaaacgggaucacaaauaaagugaacucuguuauugaaaagaugaauacccaguuuacugccgugggcaaggaguucaacaaacuugagcgccgaauggaaaaccugaauaagaaagucgaugacggauucaucgauauauggacauacaacgcagaguugcuagugcugcucgaaaaugagagaacccuggacuuucaugacagcaacguaaagaaucuuuaugaaaaaguuaagucacaacugaagaacaaugcuaaagagauuggcaacgggugcuucgaguuuuaccacaaguguaaugaugaaugcauggagagugugaaaaacggaacguaugacuaccccaaguauuccgaagagagcaaauugaauagggagaagaucgauggugucaagcucgaaucuaugggcguguaccagauccuggccauuuauucaaccgucgcuaguagcuuagugcugcuaguuucccucggggccaucucuuucuggaugugcucgaacggaagccugcagugucggauuugcauauga

SEQ ID NO: 124524 - RNA, 1701 nt, Artificial Sequence; identical to SEQ ID NO: 124354
  derived and/or modified sequence opt3 from hemagglutinin__InfluenzaA__ACK99421

SEQ ID NO: 124525 - RNA, 1689 nt, Artificial Sequence
  derived and/or modified sequence opt3 from hemagglutinin__InfluenzaA__ACK99432
auggccaucauuuaccugauacuccuuuucaccgcugugagaggcgaccagaucugcauuggguaucacgcaaacaauagcacagagaagaucgauacuauucuggaaaggaacgucacgguuacccaugccaaagacaucuuggagaagacacacaauggaaaauuauguaagcugaacgguauacccccucuagaacucggcgauugcuccaucgcgggguggcugcuuggaaauccagagugugaccggcuguugcgcgugccggaauggucuuacauuauggagaaagagaacccccgauauucacucugcuacccuggcaguuuuaaugauuaugaagaacugaagcaucugcucagcuccguaaagcacuucgaaaaagugaagaucuuaccaaaagaccguuggacucaacauaccacaaccggugggucuauggcuugugccgucucgggaaagcccucauuuuucagaaacaugguguggcugacuacaaaaggcccuaauuacccaguugcacagggcagcuauaacaauaccaguggggagcagaugcuuauuaucuggggagugcaccaccccaacgaugaggccgaacagagggcuuuguaccaaaaggucgguacguacguguccgcaucuacuagcacccuguauaagcgguccauaccugagauugccgcucgcccaaaaguaaauggccuagggucaagaauggaauuuaguuggacacuccuggacaugugggauacuaucaacuucgagagcaccggaaaucuuguugccccggaauacggcuuuaagauuucuaaaagggguuccucagggaucaugaagacagagggaacccuggagaacugcgaaacgaaaugucagacucccuugggcgcgaucaacacaacccucccuuuccauaaugugcacccacugacuauuggcgagugccccaaguaugucaaaagcgaaaaguuagugcuggcaacagggcuccggaacgugccucagauagagagucgcggacuuuuuggugccaucgcuggcuucauugaagggggauggcagggcauggucgacgguugguacggguaucaucacucuaaugaucaaggcuccggauacgccgcagacaaggagagcacccagaaggcuuuugauggcaucacgaacaaaguuaauucggugauagagaaaaugaacacccaguucgaagccguagggaaggaguuuucuaaucuggaaaaacgauuggagaaccuaaauaagaagauggaagacggauuccuggacguguggacauauaacgcggagcuccugguccuuauggagaaugaaagaacucuggauuuccacgacuccaacgugaaaaauuuguacgauaagguuaggaugcagcuccgggacaacgugaaagagcuggguaauggcuguuuugaguucuaccauaagugcgauaacgaguguauggacucagucaaaaacgggaccuaugauuacccaaaguaugaggaagagaguaaguuaaaucguaacgaaauuaaaggagugaagcugagcuccaugggcguauaccaaauccuagccaucuaugcaacaguugcugguucucucagccuggccauuaugauggcugggaucucauuuuggaugugcaguaauggcucccuucagugccgcauuuguauauga

SEQ ID NO: 124526 - RNA, 1701 nt, Artificial Sequence
  derived and/or modified sequence opt3 from hemagglutinin__InfluenzaA__ACK99443
augaaggccaaacugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucaaucgccggcuggauucuggggaacccugagugcgaaaguuuguuuagcaaagaguccuggucuuauaucgcagaaacaccaaauucggagaacggaaccuguuacccgggcuauuucgccgauuacgaggaacucagggagcaacugucaagcgucaguuccuuugaacgguucgagauuuuucccaaggagucuagcuggccuaaucauacugugacaaaggguguuaccgcugcaugcucccacaacgggaaaucaaguuucuaucgcaaucugcucugguuaacggaaaagaacggacuguacccaaaucuuagcaaaucuuaugugaacaauaaggagaaagaagucuuggugcuguggggcguacaucaccccuccaacaucggcgaccagcgagccauauaccacacugagaacgcuuacguuucaguggucagcagucauuauucucguagauuuaccccugaaaucgccaagaggccaaaggugcgggggcaggagggacgcauuaauuacuauuggacacuacucgagcccggugauacuaucauuuucgaagcgaacggcaaucugaucgcaccuugguacgccuuugcucuuuccagaggguucggaagcggcauaauuaccucgaacgccucuauggacgagugugaugcaaaaugccagacaccacaaggugcuaucaauuccucacugccguuucagaacgugcaccccgucaccauuggggaauguccuaaguauguuaggaguacgaaauugcggauggugacuggacuccgcaauaucccaagcguacagucccgaggccuguucggcgccaucgcgggguuuauugagggagguuggacaggcaugauagacgggugguacggauaucaucaccagaacgaacaaggcucugguuacgccgcagaucagaaaagcacccagaaugcuaucaacgggauuacuaauaaagugaacucagucaucgagaagaugaauacacaguucaccgccgugggcaaagaguucaacaaguuagaaagaaggauggagaaucugaacaagaaaguugacgauggauuucucgacauauggacguacaacgcugaacuucugguguugcuagagaaugaacggacccuggacuuccacgauaguaacgucaagaaucucuaugagaaagugaagucccaacugaaaaacaaugccaaggagauuggcaacgggugcuuugaguucuaccauaaguguaauaacgaaugcauggaaagcguaaagaauggaacauaugacuaccccaaguauucugaggagucaaaacuuaaccgugaaaagaucgaugguguuaaacuggagaguaugggcguguaccagaucuuggcaauuuauagcacugucgccuccucucucgugcuguuagucucgcugggggcuaucagcuuuuggaugugcuccaauggaucacuacagugucgcauuugcauauga

SEQ ID NO: 124527 - RNA, 1701 nt, Artificial Sequence
  derived and/or modified sequence opt3 from hemagglutinin__InfluenzaA__ACK99465
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaagccaaauccggagaacggaaccuguuaucccggcuacuucgccgacuaugaggaacucagggagcaacugucgucagugagcaguuuugaacgguucgagauuuuuccuaaggaguccucuuggccaaaucauacuguuacaaaaggugugaccgcuagcugcucccacaacgggaagucaaguuucuacaaaaaucugcucugguuaacgaagaaaaacggacuguaucccaaucuuagcaagucuuacgucaacaauaaggaaaaagagguguugguacuguggggcguucaucacccuuccaacaucggcgaucagcgcgcaauuuaccacacugaaaacgccuaugugucagucgugagcagucauuacucucgacguuuuaccccagagaucgcuaagagacccaaagugagggaccaggaagggcggauaaauuauuacuggacacuacucgagccuggagauacuaucauuuucgaggccaacgguaaucugaucgcgccaugguaugcauuugcccuuucccgcggcuucgggagcggaauuaucaccucgaacgcuucuaugggcgaaugugacgccaagugccagacaccgcaaggugcaauaaauuccucacugcccuuucagaacguccacccuguuaccauuggggaguguccaaaauacgugagaaguacgaaguugaggaugguaacuggacuccggaauauccccagcauucagucccgcggccuguucggcgcuaucgccggguuuaucgaaggagguuggacaggcaugauugaugggugguauggauaccaucaccagaacgagcaaggcucugguuacgcggccgacaaaaagagcacccagaaugcaauagaugggaucacuaacaagguaaauucagucauugaaaagaugaacacacaguucaccgcugugggcaaggaguucaauaaauuagagcgaagaauggaaaaccugaauaagaaaguugacgauggauuucucgacaucuggacguauaacgccgagcuucugguguugcuagaaaacgagaggacccuggacuuccacgauaguaaugucaagaaccucuacgaaaaggugaaaaaucagcugaagaacaaugcuaaagagauaggcaacgggugcuuugaguucuaucauaaguguaauaacgaaugcauggaguccgugaaaaauggaacauacgacuauccuaaguacagcgaagagucuaaacuuaaacgggagaagauugaugguguuaaacuggaaucaaugggcguguaucaaaucuuggccaucuacaguacugucgcaagcucccucgugcuguuagucucucugggggccauuucguuuuggaugugcagcaacggaucccuacagugucguaucugcauuuga

SEQ ID NO: 124528 - RNA, 1701 nt, Artificial Sequence
  derived and/or modified sequence opt3 from hemagglutinin__InfluenzaA__ACK99476
augaagaccaucauugcccugagcuacauacucugcaugguguucgcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacgauuuucagaacaaggagugggaccuguucguggaacgguccaaagccuauucuaauuguuaccccuaugaugucccugacuacgcaucguugcgcucacucguggccagcaguggaacucuggaguuuaacaaugaauccuucaacuggacaggcguugcucagaaugguaccucuuaugcaugcaagcgacguagcgugaaguccuuuuucucaagacugaacuggcuccacaaauuagaguacaaguauccagcccugaaugucacgaugcccaacaaugauaaauuugacaagcuguacauauggggagugcaucacccuaggacugauagugaccaaaccagcuuguacguacaggcuucugggcggguuacaguguccacuaaacgcucacagcagaccgucaucccaaacauuggcagcagucccugggugagaggcgugucuuccaggaucagcauuuauuggacaaucgucaagccuggggacauacugcuaauuaacucgaccggaaaucucaucgccccacgggguuacuucaagauucgcucuggcaaauccucaaucaugcgaagugaugcgccgaucgggaacuguaauagcgagugcauuacgcccaacggauccauaccuaaugacaagccauuucaaaacguuaauagaaucacuuauggcgcaugucccagguacgugaaacagaacacacugaaacuugccaccgguaugcggaauguaccugaaaagcagacucgugggauuuucggagcuaucgccggcuuuauagagaacggcugggaagggaugguggauggaugguaugguuuccgccaccaaaauucugagggcacagggcaggcagcugaccuuaagagcacccaggccgcgauuaaccagaucaauggaaaauugaacagacucaucgagaagacgaaugaaaaguuucaucaaauugagaaagaguucucagaagucgaaggcaggauccaggaucuggagaaguacguggaggacaccaaaauugauuuauggaguuauaacgccgaacugcucguugcacuugagaaccagcacacaauagaccugacugauuccgaaaugaauaaguuguucgagcggacccgaaaacagcuacgcgaaaacgcugaggacauggguaaugggugcuuuaagaucuaccauaagugugauaacgccugcauuggcagcaucagaaauggaacauacgaccacgacguguauagggaugaggcucugaacaaucgguuccaaaucaaaggcgucgaacucaagucuggguacaaagacuggauucuguggauaucauuugccaucaguugcuuccuucugugugugguauugcucggauuuauuaugugggcaugccagaaggguaacauccgcuguaauauuugcaucuga

SEQ ID NO: 124529 - RNA, 1698 nt, Artificial Sequence; identical to SEQ ID NO: 123930
  derived and/or modified sequence opt3 from hemagglutinin__InfluenzaA__ACL12063

SEQ ID NO: 124530 - RNA, 1701 nt, Artificial Sequence
  derived and/or modified sequence opt3 from hemagglutinin__InfluenzaA__ACL12129
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcggcagcccacacaggauucucgacgggaaaaauuguacccugaucgaugcucuacugggagacccgcauugcgauggcuuucagaacaaggagugggacuuguucguggaacgguccaaagccuauucuaauuguuaccccuaugaugucccugacuacgcaucgcuccgcucacugguggccagcagugguacucuggaguuuauaaacgaagauuucaauuggacagggguugcucaggacggaggcuccuaugcaugcaagcgaggcucugugaacagcuuuuucucccgucucaauugguuacacaagcuggaguacaaauauccagcccuuaacgucaccaugcccaauaacgggaaguuugauaaauuguacaucuggggagugcaucacccuucaacggacagugaucaaacuagccuguacguaagagcuucugguaggguuaccguguccacaaagcggucacagcagacugucaccccaaauauuggcagccgccccugggugagagggcagaguucuaggaucuccauuuauuggacaaucgugaaaccuggagacauacuacucauugacagcaccggcaaccugaucgccccacgggguuacuucaagauucgcaacgggaagucgucuaucaugcgauccgaugcgccgaucggaaauuguucaagugagugcauuacgcccaacggcagcauaccuaaugacaaaccauuucaaaacgucaauagaaucacuuauggcgcaugucccagguacguuaagcagaacacacuuaaacuggccaccgggaugcggaaugugccugaaaagcagacucguggaauuuucggugcuaucgccggcuuuauagagaacgggugggaaggaaugguagauggcugguaugguuuccgccaccagaauagcgaggggacaggccaagcagcugacuugaaaucuacccaggccgcgauugaucagaucaacggaaagcucaauagacugaucgagaaaacgaacgaaaaguuucaacagauugagaaggaguucagcgaaguggaaggcaggauccaggacuuagagaaauacgucgaggauaccaagauugaccuguggucauauaaugccgaacuccuuguggcacuggagaaccagcauacaauagauuugacugacagugaaaugaauaaacuauucgagaagacccggaaacaacugcgagaaaacgcugaggauauggggaacggaugcuuuaagaucuaccacaagugugacaaugccugcauugguuccauccgcaacggcacauacgaccaugauguuuauagagacgaggcucucaauaacagguuccagaucaaagggguggaacugaaguccggauacaaagauuggauucuuuggauaucuuuugccaucucaugcuuccuguugugugucgugcuccugggcuuuauuaugugggcaugccagaaggguaauauccgguguaacauuugcaucuga

SEQ ID NO: 124531 - RNA, 1701 nt, Artificial Sequence; identical to SEQ ID NO: 124372
  derived and/or modified sequence opt3 from hemagglutinin__InfluenzaA__ACL12140

SEQ ID NO: 124532 - RNA, 1698 nt, Artificial Sequence; identical to SEQ ID NO: 124456
  derived and/or modified sequence opt3 from hemagglutinin__InfluenzaA__ACL12151

SEQ ID NO: 124533 - RNA, 1701 nt, Artificial Sequence; identical to SEQ ID NO: 124450
  derived and/or modified sequence opt3 from hemagglutinin__InfluenzaA__ACL12162

SEQ ID NO: 124534 - RNA, 1701 nt, Artificial Sequence
  derived and/or modified sequence opt3 from hemagglutinin__InfluenzaA__ACL12173
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauuaaucagauaaacggcaaauugaacagacucaucgguaagacgaaugaaaaauuccaccagauugagaaggaauuuuccgagguugaagggaggauccaagaucuggagaaguacguggaggacaccaaaaucgauuuauggucuuauaacgccgaacugcucguagcacuugagaaucagcauacaauugaccugacugauagcgaaaugaacaaguuguucgagaaaaccaagaaacagcuacgggaaaaugcugaggacaugggcaacggaugcuuuaagauauaccacaagugugauaaugccugcaucggcucaauucgaaacgggacauaugaccaugauguguaccgcgacgaggcucugaauaacagauuccagaucaaaggagucgaacucaagagugguuacaaagacuggauucuguggaucuccuuugccauaagcugcuuccuucuguguguggcauugcucggcuuuaucaugugggccugccaaaaggggaauauuagguguaacaucugcauuuga

SEQ ID NO: 124535 - RNA, 1701 nt, Artificial Sequence
  derived and/or modified sequence opt3 from hemagglutinin__InfluenzaA__ACL12184
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauauaaccaugauguguaccgcgacgaggcucugaauaacagauuccagaucaaaggagucgaacucaagagugguuacaaagacuggauucuguggaucuccuuugccauaagcugcuuccuucuguguguggcauugcucggcuuuaucaugugggccugccaaaaggggaauauuagguguaacaucugcauuuga

SEQ ID NO: 124536 - RNA, 1701 nt, Artificial Sequence; identical to SEQ ID NO: 124450
  derived and/or modified sequence opt3 from hemagglutinin__InfluenzaA__ACL12195

SEQ ID NO: 124537 - RNA, 1701 nt, Artificial Sequence
  derived and/or modified sequence opt3 from hemagglutinin__InfluenzaA__ACL12217
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauguccugcuaaucaacucuacggguaaucucauugccccgaggggcuacuucaagauacgguccgggaaaagcucgaucaugcgcucugacgcgcccauuggaaaguguaacuccgaaugcaucacuccuaauggcucaauaccaaacgacaagcccuuucagaaugugaaccgaauuacauauggugcauguccuagauacgugaaacaaaauacccugaagcuggccacugggaugaggaacgucccagagaaacagacacggggaaucuucggcgcuaucgccggcuuuauugaaaaugggugggagggaaugguugaugguugguauggcuuccgucaccagaacagugaggggcgcggacaagcagcugaccuuaagagcacccaggccgcgaucgaucagauuaauggcaaauugaacagacucauagguaagacgaacgaaaaauuccaccagaucgagaaggaauuuuccgagguggaagggaggauucaagaccuggagaaguacguagaggauaccaaaaucgacuuauggucuuauaaugccgaacugcucguggcacuugagaaccagcauacaaucgaucugacugacagcgaaaugaauaaguuguucgagaaaaccaagaaacagcuacgggaaaacgcugaggauaugggcaauggaugcuuuaagauuuaccacaagugugacaacgccugcauaggcucaauccgaaaugggacauaugaucaugacgucuaccgcgacgaggcucugaacaauagauuccagauuaaaggaguggaacucaagagugguuacaaagauuggauccuguggauuuccuuugccaucagcugcuuccuucuguguguugcauugcucggcuuuauaaugugggccugccaaaaggggaacaucagguguaauauuugcaucuga

SEQ ID NO: 124538 - RNA, 1701 nt, Artificial Sequence; identical to SEQ ID NO: 124450
  derived and/or modified sequence opt3 from hemagglutinin__InfluenzaA__ACL12228

SEQ ID NO: 124539 - RNA, 1701 nt, Artificial Sequence; identical to SEQ ID NO: 124450
  derived and/or modified sequence opt3 from hemagglutinin__InfluenzaA__ACL12239

SEQ ID NO: 124540 - RNA, 1701 nt, Artificial Sequence
  derived and/or modified sequence opt3 from hemagglutinin__InfluenzaA__ACL12250
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgugucgcugaggucauugguugcaagcaguggcacucucgaguucaauaacgaauccuuuaauuggacaggugugacccagaacgggacgucuagcgccugcauccggcgcuccaauaacucauucuuuagucgacugaauuggcugacucauagcaaauucaaguauccagcucucaacgucaccaugcccaacaaugagaacuuugacaaguuauacauuuggggagugcaccauccuggcacagauaaugaccagaucuuccuguaugcacaggccucuggccguauuacuguauccaccaaaagaucacaacagacaguuaucccaaacauagggagcaggccccgggugcgcaauauuccuaguagaaucucuauuuacuggaccaucgucaagccaggagauauccuuuugauuaacuccacggguaaucugauagcuccgaggggcuacuuuaaaauccggagcgggaagucgucuauuaugcgcuccgacgcccccaucggaaaauguaacucagaaugcauaacuccuaauggcaguauuccaaacgacaagcccuuccagaaugugaaccgaaucacauauggugcguguccuagauacgugaagcagaauacccuaaaacucgcaacugggaugaggaacgucccagagaagcaaacacggggaaucuuuggcgccauugcuggcuucaucgaaaaugggugggagggaaugguugaugguugguauggcuuccgucaccagaacagcgaggggauuggacaggccgcagaccugaaauccacccaagcugccauagaucagaucaacggcaaacuuaaucgccugauugguaagacgaacgaaaaguuucaccagaucgagaaagaguucucugaaguggaagggagaauccaggacuuggagaaguacguagaggauaccaagauugaccucuggagcuauaaugcggaacuguuaguggcccuggagaaccaacauacaauagaucucacugacucagaaaugaauaaacuuuuugagaagaccaaaaagcagcugagggaaaacgcagaggauaugggcaauggaugcuucaaaaucuaccacaagugugacaacgcuugcauuggcaguauccggaaugggacauaugaucaugacgucuaccgagacgaggccuugaacaaucgcuuucagauuaagggaguggaacuaaaauccgguuacaaggauuggauccuguggaucagcuucgcuauaucuugcuuucuccuguguauugcccuucugggcuucaucaugugggcaugccagaaagggaacauuagauguaauaucugcauauga

SEQ ID NO: 124541 - RNA, 1701 nt, Artificial Sequence
  derived and/or modified sequence opt3 from hemagglutinin__InfluenzaA__ACL12261
augaaggccaaacugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucaaucgccggcuggauucuggggaacccugagugcgaaaguuuguuuagcaaaaaguccuggucuuauaucgcagagacaccaaauucggaaaacggaaccuguuacccgggcuauuucgccgauuacgaggagcucagggaacaacugucaagcgucaguuccuuugagcgguucgaaauuuuucccaaggagucuagcuggccuaaucauacugugacaaaagguguuaccgcugcaugcucccacaaggggcgcucaaguuucuaucgaaaccugcucugguuaacggagaaaaauggacuguacccaaaccuuagcaagucuuaugugaauaacaaagaaaaggaggucuuggugcuguggggcguacaucaccccuccaauaucggcgaccagcgugccauauaccacacugaaaacgcuuacguuucaguggucagcagucauuauaacagaagguuuaccccugagaucgccaagcggccaaaagugcgcgggcaggaaggaagaauuaauuacuauuggacacuacucgagcccggugauacuaucauuuucgaggcgaacggcaaucugaucgcaccuugguacgccuuugcucuuucuaggggguucggauccggcauaauuaccagcaacgccucgauggacgaaugugaugcaaagugccagacaccacaaggugcuaucaauucuucccugccguuucagaacgugcaccccgucaccauuggggaguguccuaaauauguucggucaacgaaguugcgcauggugacuggacuccgaaauaucccaaguauccagagcagaggccuguucggcgccauugcgggguuuauagaaggagguuggacaggcaugaucgacgggugguacggauaucaucaccagaacgagcaaggcuccgguuacgccgcagaucagaaaucuacccagaaugcuauuaacgggaucacuaauaagguaaacagcgugauagaaaagaugaauacacaguucaccgccgucggcaaagaguucaacaaguuagagaaaaggauggaaaaucugaacaagaaaguggacgauggauuucucgacauuuggacguacaacgcugagcuucugguuuugcuagaaaaugagcggacccuggacuuccacgauucaaacgugaagaaucucuaugaaaaagucaagaaccaacugaagaauaacgccaaagagaucggcaaugggugcuuugaguucuaccauaaguguaacaaugaaugcauggagagugugaaaaacggaacauaugacuaccccaaguauuccgaagagagcaaacuuaaucgugagaagaucgaugguguaaagcuggaaucuaugggcguuuaccagauuuuggcaaucuauucaacuguggccaguagccucguccuguuagugucccugggggcuauuucuuuuuggaugugcucgaacggaagccuacagugucgcauaugcaucuga

SEQ ID NO: 124542 - RNA, 1689 nt, Artificial Sequence
  derived and/or modified sequence opt3 from hemagglutinin__InfluenzaA__ACN32272
auggccaucauuuaccugauacuccuuuucaccgcugugagaggcgaccagaucugcauuggguaucacgcaaacaauagcacagagaagaucgauacuauucuggaaaggaacgucacgguuacccaugccaaagacaucuuggagaagacacacaauggaaaauuauguaagcugaacgguauacccccucuagaacucggcgauugcuccaucgcgggguggcugcuuggaaauccagagugugaccggcuguugcgcgugccggaauggucuuacauuauggagaaagagaacccccgauauucacucugcuacccuggcaguuuuaaugauuaugaagaacugaagcaucugcucagcuccguaaagcacuucgaaaaagugaagaucuuaccaaaagaccguuggacucaacauaccacaaccggugggucuauggcuugugccgucucgggaaagcccucauuuuucagaaacaugguguggcugacuacaaaaggcccuaauuacccaguugcacagggcagcuauaacaauaccaguggggagcagaugcuuauuaucuggggagugcaccaccccaacgaugaggccgaacagagggcuuuguaccaaaaugucgguacguacguguccgcaucuacuagcacccuguauaagcgguccauaccugagauugccgcucgcccaaagguaaacggccuagggucaagaauggaauuuaguuggacacuccuggacaugugggauacuaucaauuucgagagcaccggaaaccuuguugccccggaauacggcuuuaaaauuucuaagagggguuccucagggaucaugaaaacagagggaacccuggagaacugcgaaacgaagugucagacucccuugggcgcgaucaauacaacccucccuuuccauaacgugcacccacugacuauuggcgagugccccaaauaugucaagagcgaaaaauuagugcuggcaacagggcuccggaaugugccucagauagagagucgcggacuuuuuggugccaucgcuggcuucauugaagggggauggcagggcauggucgacgguugguacggguaucaucacucuaacgaucaaggcuccggauacgccgcagacaaggagagcacccagaaggcuuuugauggcaucacgaauaaaguuaacucggugauagagaagaugaauacccaguucgaagccguagggaaagaguuuucuaaccuggaaaagcgauuggagaaucuaaacaaaaagauggaagacggauuccuggacguguggacauauaaugcggagcuccugguccuuauggagaacgaaagaacucuggauuuccacgacuccaaugugaagaacuuguacgauaaaguuaggaugcagcuccgggacaaugugaaggagcuggguaacggcuguuuugaguucuaccauaaaugcgauaacgaguguauggacucagucaagaaugggaccuaugauuacccaaaauaugaggaagagaguaaguuaaaccguaaugaaauuaagggagugaaacugagcuccaugggcguauaccaaauccuagccaucuaugcaacaguugcugguucucucagccuggccauuaugauggcugggaucucauuuuggaugugcaguaacggcucccuucagugccgcauuuguauauga

SEQ ID NO: 124543 - RNA, 1701 nt, Artificial Sequence
  derived and/or modified sequence opt3 from hemagglutinin__InfluenzaA__ACN32283
augaagaccaucauugcccugagcuacauacucugccuuguguccgcucagaaauuccccggcaacgacaauucuacagcaacucuguguuuggggcaccaugccgucccuaacggaacgaucguuaagaccauuacaaaugaucaaaucgaggugacuaacgcgaccgaauuaguacagucaaguagcacaggugagauuugcgacuccccacaccagauccuggauggcgaaaauuguacccuaauagacgcucuccugggggauccgcagugcgacggauuucaaaacaaaaagugggaucuuuucguggagagaucuaaagccuauucgaauuguuaccccuaugacgucccugauuacgcaucacugaggagcuugguggccaguuccggcacucucgaauuuaacaaugagucuuucaacuggacagguguuacccagaaugggacgagcuccgcuugcauccggcgcucaaacaauagcuuuuucagccgacugaacuggcugacucaucucaaguuuaaguauccagcauuaaaugugaccaugcccaacaacgaggaguucgacaaacuguacauuuggggaguccaccauccuggcacagauaaugaccagaucuuucuuuaugcccaggcuucuggccguauuacuguguccaccaagagaucacaacagacaguaaucccaaacauagggagcaggccccggguucgcaauauuccuaguagaaucucuauuuacuggaccaucgugaaaccaggagauaucuugcugauuaacuccacggguaaucuaauagccccgaggggcuacuucaagauccggagcgggaaaucgucuauuaugcgcuccgacgcgcccaucggaaaguguaacucagaaugcauaacuccuaauggcaguauuccaaacgacaagcccuuucagaaugucaaccgaaucacauauggugcauguccuagauacgugaaacagaauacccucaagcuggccacugggaugaggaacgugccagaaaaacaaacacggggaaucuucggcgcuauugccggcuuuaucgagaaugggugggagggaauggucgaugguugguauggcuuccgucaccagaacagcgaagggauuggacaggcagcugaccuuaaguccacccaagccgcgauagaucagaucaauggcaaacugaaccgcuugauugguaagacgaacgagaaauuccaccagaucgaaaaggaguuuucugaaguugaggggagaauccaggaccucgagaaguacguggaagauaccaaaauugaccuguggagcuauaaugccgaguuacugguagcacucgaaaaccaacauacaauagaucuuacugacucagagaugaauaagcuguucgagaaaaccaagaaacaguugagggaaaacgcugaggauaugggcaauggaugcuuuaagaucuaccacaagugugacaacgccugcauuggcaguauccggaaugggacauaugaucaugacguguaccgagacgaagcucuaaacaaucgcuuccagauuaaaggagucgagcugaaguccgguuacaaagauuggauccucuggauaaguuuugccaucucuugcuuccugcuuuguguggcacuguugggcuuuauuaugugggccugccagaaggggaacaucagauguaauauuugcaucuga

SEQ ID NO: 124544 - RNA, 1701 nt, Artificial Sequence
  derived and/or modified sequence opt3 from hemagglutinin__InfluenzaA__ACN32474
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacaggugagauuugcgacuccccacaccaggugcuagauggcgaaaauuguacccucaucgacgcucugcuuggggauccgcagugcgacggauuccaaaacaaaaagugggaucuguuugucgagagaucuaaagccuauucgaauuguuaccccuaugacgugccugauuacacuucauugaggagccucguugcaaguuccggcacacuggaguucaacaaugaaucuuuuaacuggaccggugugacgcagaaugggacuagcuccgccugcauacggcgcucaaacaauaguuucuuuagccgacugaacuggcucacccauuuaaaguucaaguauccagcucugaauaugacaaugcccaacaacgaggaauuugacaaacuuuacaucuggggaguccaccauccuggcacugauaaugaccagauuuucuuguaugcacaggccucuggccguaucaccguguccacaaagagaucacaacagaccguaauuccaaacaucgggagcaggccccggguucgcaauauaccuaguagaauuucuaucuacuggacgauugugaaaccaggagauauccugcuaaucaacuccacugguaaucucauugcuccgaggggcuacuuuaagauacggagcgggaaaucgucuaucaugcgcuccgacgcccccauuggaaaguguaacucagagugcaucacaccuaauggcaguauaccaaacgacaagcccuuccagaaugucaaccgaauuaccuauggugcguguccuagauacgugaaacagaauacucugaaacuugcaacagggaugaggaacgugccagaaaaacaaacccggggaaucuuuggcgccaucgcuggcuucauugagaaugggugggagggaauggucgaugguugguauggcuuucgucaccagaacagcgaagggaucggacaggccgcagaccugaaguccacgcaagcugccauugaucagauaaauggcaaauugaaccgccucaucgguaagaccaacgagaaauuccaccagauugaaaaggaguucucugaaguugaggggagaauccaggaccuggagaaguacguggaagauacaaaaaucgacuuauggagcuauaaugcggagcugcucguagcccuugaaaaccaacauacuauugaucugaccgacucagagaugaauaaguuguuugaaaagacaaagaaacagcuaagggagaacgcagaggauaugggcaauggaugcuucaagauauaccacaagugugacaacgcuugcaucggcaguauucggaaugggacuuaugaucaugaaguguaccgagacgaggcccugaacaaucgcuuucagaucaaaggagucgaacucaaguccgguuacaaagacuggauucuguggaucagcuucgcuauaucuugcuuucuucuguguguggccuugcucggcuucaucaugugggcaugccagaaggggaacauuagauguaauaucugcauuuga

SEQ ID NO: 124545 - RNA, 1698 nt, Artificial Sequence; identical to SEQ ID NO: 124504
  derived and/or modified sequence opt3 from hemagglutinin__InfluenzaA__ACN32501

SEQ ID NO: 124546 - RNA, 1701 nt, Artificial Sequence
  derived and/or modified sequence opt3 from hemagglutinin__InfluenzaA__ACN32534
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccaggcuuccggcagaguaaccguuucaacaaagaggagccaacagacugugauuccaaacaucgggaguggacccuggguccggggugugucuucccgcauuagcaucuacuggaccauagugaaaccuggcgacauucuacucaucaacucgacagggaaucugauugccccaagaggauauuucaagaucaggucuggcaaguccucaaucaugcggagugacgcgccgauugguaaauguaacagcgaaugcauaacccccaauggguccaucccuaacggaaagccauuucagaaugucaaccgcauuacguacggcgcauguccccgauauguuaaacagaauacucuuaagcuggccacaggcaugagaaacgugccugagaaacaaaccagggggaucuucggagcuauagccgguuuuauugaaaauggcugggaggggaugauggauggaugguacggcuuccggcaccagaacucugaggguacugggcaggcagcugaccuaaagagcacacaagccgcgaucaaucagaucaacggcaaacucaaucgucugauugaaaagaccaacgagaaguuucaucagaucgaaaaagaguucucagaaguagagggacgcauucaggauuuagagaaguauguggaagacacgaaaauagaucuguggaguuacaaugccgagcuccuugucgcacuggaaaaccaacacaccaucgacuugacagauuccgagaugaacaagcuauucgaaagaacuaaaaagcagcugagggagaaugcugaggacaugggcaacgggugcuuuaagauuuaucauaaaugugauaaugccugcaucggaagcauccggaacgguaccuacgaccacgauguguaccgagacgaagcucucaauaaccgcuuccagauuaagggcguugagcugaaaucuggguauaaggacuggauacuuuggaucucauuugccauuaguugcuuccuguuguguaucgugcuccugggauuuauuaugugggcaugccagaaaggcaauaucagauguaacauaugcaucuga

SEQ ID NO: 124547 - RNA, 1701 nt, Artificial Sequence
  derived and/or modified sequence opt3 from hemagglutinin__InfluenzaA__ACN32545
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcauugcgacggauuucagaacaaaaagugggaucuguucguggagagauccaaagccuauucuaauuguuaccccuaugacgucccugauuacgcaucguugaggucacucaucgccagcaguggcacucuggaauuuaacaaugaguccuucaacuggacaggugugacccaaaaugggacgucuagcgcuugcauucggcgcuccaacaauucauuuuucagucgacugaacuggcucacucacuuaaaguuuaaguauccagcacugaauguuaccaugcccaacaacgagaaauucgacaaguuguacaucuggggagugcaucacccuggcacagauaaugaccagauuuuucuuuaugcccaggcuagcggccguaucacugucucuaccaaaagaucccagcaaacagugauaccaaacauugggucaaggccccggguacgcaauaucccuagcagaauuaguaucuacuggaccaucguuaagccaggagauauucugcuaauaaacucuacggguaaucucaucgccccgaggggcuacuucaaaauucgguccggaaagagcucgaucaugcgcucugacgcgcccauagggaaguguaacuccgaaugcauuacuccuaauggcucaaucccaaacgacaaacccuuucagaaugugaaccgaaucacauauggugcauguccuagauacgucaagcagaauacccugaaacuugccacugggaugaggaacgugccagagaagcagacacggggaauuuucggcgcuaucgccggcuuuauugaaaaugggugggagggaaugguggaugguugguauggcuuccgucaccaaaacagugaggggauaggacaggcagcugaccugaaaagcacccaggccgcgaucgaucaaauuaauggcaaguugaaccgccucaucgguaaaacgaacgaaaaguuccaucagaucgagaaggaauuuuccgaggucgaagggaggauucaggaccuggagaaauacguugaggauaccaagauagacuuauggucuuauaaugccgaacugcucguggcacuugagaaccagcacacaaucgaucugacugacagcgaaaugaauaaauuguucgagaagaccaaaaagcaacuaagagaaaacgcugaggauaugggcaauggaugcuuuaagauuuaccauaaaugugacaacgccugcaucggcucaauucggaaugggacauaugaucacgacguauaccgagacgaggcucugaacaaucgcuuccagaucaagggaguggaacucaaaagugguuacaaggauuggauacuguggaucuccuuugccauuagcugcuuccuucugugugucgcauugcucggcuuuaucaugugggccugccagaaagggaacauuagauguaauaucugcauauga

SEQ ID NO: 124548 - RNA, 1698 nt, Artificial Sequence
  derived and/or modified sequence opt3 from hemagglutinin__InfluenzaA__ACN32793
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcgaaucuuacgcaaacaauaaggagaaagaaguucuaguacucuggggcgugcaucacccuccaaacaucggggaucagcgcgcccuguaccacacugagaacgcuuaugucuccguggugucaagccauuacagucgacguuucacccccgaaauagcaaagagaccuaaagucagggaccaggagggacggaucaauuauuacuggacacuucuggagccaggugauacuauuaucuuugaagccaacggcaauuugauugcuccgcgcuucgccuuugcgcucucuagaggguucggauccggcaucauaaccagcaacgcacccauggacgagugugaugccaagugccagacaccucaaggugcuauuaauucgucucugccauuucagaacguucaccccgugaccaucggggaauguccuaaguauguaagguccacgaaauuacggauggugacuggacugcgcaauauuccaucaauccagagucgaggccucuucggcgccaucgcaggguuuauugagggagguuggacaggcauggucgacgggugguacggauaucaucaccagaacgaacaaggcagcgguuacgcugccgaucagaaguccacccagaaugcgauaaacgggaucacuaauaaagugaacucuguuauugagaagaugaauacacaguucaccgccgugggcaaagaguucaacaaacuugaaagaaggauggagaaucugaacaaaaaggucgacgauggauuuuuggacaucuggacguacaacgcagaacuacuggugcuccuggagaaugaacggacccuugacuuccacgauagcaacguaaagaaucuguaugagaaaguuaagucacaauugaaaaacaaugcuaaggagauaggcaacgggugcuuugaguucuaccauaaauguaaugacgaaugcauggaaagugugaagaacggaacauaugauuaccccaaguauuccgaggagagcaaacucaaucgugaaaagauugacggugucaaacuggagucuaugggcguguaccagaucuuagccaucuauucaacugucgcuaguagccuggugcuacucguuucccugggggccauuucuuuuuggaugugcucgaacggaagccuucagugucgcaucugcauuuga

SEQ ID NO: 124549 - RNA, 1698 nt, Artificial Sequence; identical to SEQ ID NO: 123973
  derived and/or modified sequence opt3 from hemagglutinin__InfluenzaA__ACN32804

SEQ ID NO: 124550 - RNA, 1698 nt, Artificial Sequence; identical to SEQ ID NO: 123961
  derived and/or modified sequence opt3 from hemagglutinin__InfluenzaA__ACN32815

SEQ ID NO: 124551 - RNA, 1698 nt, Artificial Sequence; identical to SEQ ID NO: 123971
  derived and/or modified sequence opt3 from hemagglutinin__InfluenzaA__ACN32826

SEQ ID NO: 124552 - RNA, 1701 nt, Artificial Sequence; identical to SEQ ID NO: 124450
  derived and/or modified sequence opt3 from hemagglutinin__InfluenzaA__ACN32848

SEQ ID NO: 124553 - RNA, 1701 nt, Artificial Sequence
  derived and/or modified sequence opt3 from hemagglutinin__InfluenzaA__ACN32870
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauccggcgcuccaauaacucauucuuuagucgacugaauuggcugacucauagcaaauucaaguauccagcacucaacgugaccaugcccaacaaugagaacuuugacaaguuauacauuuggggaguccaccauccuggcacagauaaugaccagaucuuccuguaugcccaggcuucuggccguauuacuguguccaccaaaagaucacaacagacaguaaucccaaacauagggagcaggccccggguucgcaauauuccuaguagaaucucuauuuacuggaccaucgugaagccaggagauauccuuuugauuaacuccacggguaaucugauagccccgaggggcuacuuuaaaauccggagcgggaagucgucuauuaugcgcuccgacgcgcccaucggaaaauguaacucagaaugcauaacuccuaauggcaguauuccaaacgacaagcccuuccagaaugucaaccgaaucacauauggugcauguccuagauacgugaagcagaauacccuaaaacucgccacugggaugaggaacgugccagagaagcaaacacggggaaucuuuggcgcuauugccggcuucaucgaaaaugggugggagggaauggucgaugguugguauggcuuccgucaccagaacagcgaggggauuggacaggcagcugaccugaaauccacccaagccgcgauagaucagaucaacggcaaacuuaaucgccugauugguaagacgaacgaaaaguuucaccagaucgagaaagaguucucugaaguugaagggagaauccaggacuuggagaaguacguggaggauaccaagauugaccucuggagcuauaaugccgaacuguuaguagcacuggagaaccaacauacaauagaucucacugacucagaaaugaauaaacuuuuugagaagaccaaaaagcagcugagggaaaacgcugaggauaugggcaauggaugcuucaaaaucuaccacaagugugacaacgccugcauuggcaguauccggaaugggacauaugaucaugacguguaccgagacgaggcuuugaacaaucgcuuucagauuaagggagucgaacuaaaauccgguuacaaggauuggauccuguggaucagcuucgccauaucuugcuuucuccuguguauugcacuucugggcuucaucaugugggccugccagaaagggaacauuagauguaauaucugcauauga

SEQ ID NO: 124554 - RNA, 1701 nt, Artificial Sequence; identical to SEQ ID NO: 124553
  derived and/or modified sequence opt3 from hemagglutinin__InfluenzaA__ACN32892

SEQ ID NO: 124555 - RNA, 1701 nt, Artificial Sequence; identical to SEQ ID NO: 124450
  derived and/or modified sequence opt3 from hemagglutinin__InfluenzaA__ACN32903

SEQ ID NO: 124556 - RNA, 1701 nt, Artificial Sequence
  derived and/or modified sequence opt3 from hemagglutinin__InfluenzaA__ACN32914
augaagaccaucauugcccugagcuacauacucugccuugcuuucgcacagaaacugcccggcaacgacaauuccacagccacuuuguguuuagggcaccaugcggugccuaacggaacgaucgucaagaccauuacaaaugaucaaaucgagguuacuaacgcuaccgaacuggugcagucuucaaguacaggugagauuugcgacagcccacaccagauccuagauggcgaaaauuguacccucauagacgcccugcuuggggauccgcagugcgacggauuucaaaacaaaaagugggaucuguucguagagagauccaaagcauauucuaauuguuaccccuaugacgugccugauuacgccucguugaggucacucgucgcuagcaguggcacucuggaauuuaacaaugaguccuucaacuggacaggugugacccagaaugggacgucuagcgcaugcauccggcgcuccaacaauucauuuuucagucgacugaacuggcucacucauuuaaaguuuaaguauccagcccugaauguuaccaugcccaacaacgagcaguucgacaaacuuuacauuuggggagugcaccauccuggcacagauaaugaccagaucuuuuuguaugcucaagccagcggccguauuacugucucuaccaagagaucccagcagacagugaucccaaacauagggucaaggccccggguacgcaauauuccuagcagaaucaguauuuacuggaccaucguuaaaccaggagauauccugcuaauuaacucuacggguaaucucauagcgccgaggggcuacuucaagauccgguccgggaaaagcucgauuaugcgcucugacgcacccaucggaaaguguaacuccgaaugcauaacuccuaauggcucaauuccaaacgacaagcccuuucagaaugugaaccgaaucacauauggugccuguccuagauacgucaaacaaaauacccugaagcuggcuacugggaugaggaacgugccagagaaacagacacggggaaucuucggcgccauugcaggcuuuaucgaaaaugggugggagggaaugguggaugguugguauggcuuccgucaccagaacagugaggggcgcggacaagcugccgaccuuaagagcacccaggcggccauugaucagauaaauggcaaauugaacagacucaucgguaagacgaacgaaaaauuccaccagauugagaaggaauuuuccgaggucgaagggaggauccaagaccuggagaaguacguugaggauaccaaaaucgacuuauggucuuauaaugcagaacugcucguggcucuugagaaccagcauacaauugaucugacugacagcgaaaugaauaaguuguucgagaaaaccaagaaacagcuacgggaaaacgccgaggauaugggcaauggaugcuuuaagauauaccacaagugugacaacgcuugcaucggcucaauucgaaaugggacauaugaucaugacguauaccgcgacgaggcccugaacaauagauuccagaucaaaggaguggaacucaagagugguuacaaagauuggauucuguggaucuccuuugcaauaagcugcuuccuucugugugucgccuugcucggcuuuaucaugugggcuugccaaaaggggaacauuagguguaauaucugcauuuga

SEQ ID NO: 124557 - RNA, 1701 nt, Artificial Sequence; identical to SEQ ID NO: 124450
  derived and/or modified sequence opt3 from hemagglutinin__InfluenzaA__ACN32925

SEQ ID NO: 124558 - RNA, 1701 nt, Artificial Sequence
  derived and/or modified sequence opt3 from hemagglutinin__InfluenzaA__ACN32936
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauccggcgcuccaauaacucauucuuuagucgacugaauuggcugacucauagcaaauucaaguauccagcacucaacgugaccaugcccaacaaugagaacuuugacaaguuauacauuuggggaguccaccauccuggcacagauaaugaccagaucuuccuguaugcccaggcuucuggccguauuacuguguccaccaaaagaucacaacagacaguaaucccaaacauagggagcaggccccggauuaagaauaucccuagucgcauuucuaucuacuggaccaucguuaaaccaggagauauucuuuugauaaacuccacggguaaucugaucgccccgagaggcuacuuuaagauuaggagcgggaaaucgucuaucaugcgguccgacgcgcccauaggaaaguguaacucagaaugcauuacuccuaauggcaguaucccaaacgacaagcccuuccagaaugugaaccgcaucacauauggugcauguccucgauacgucaaacagaauacccuaaagcucgccacugggaugagaaacgugccagagaaacaaacaaggggaauuuuuggcgcuaucgccggcuucauugaaaaugggugggagggaaugguggaugguugguauggcuuccggcaccagaacagcgaggggauaggacaggcagcugaccugaaguccacccaagccgcgaucgaucagauuaacggcaaacuuaaucgucugaucgguaagacgaacgaaaaauuucaccagaucgagaaggaguucucugaagucgaagggcgcauucaggacuuggagaaguacguugaggauaccaaaauagaccucuggagcuauaaugccgaacuguuaguggcacuggagaaccaacauacaaucgaucucacugacucagaaaugaauaaacuuuuugagaagaccaagaaacagcugagagaaaacgcugaggauaugggcaauggaugcuucaagauuuaccacaagugugacaacgccugcaucggcaguauuaggaaugggacauaugaucaugacguauaccgggacgaggcuuugaacaaucgauuucagaucaaaggaguggaacuaaaguccgguuacaaagauuggauacuguggaucagcuucgccauuucuugcuuucuccuguguaucgcacuucugggcuucauuaugugggccugccagaaggggaacauccgcuguaauauaugcauuuga

SEQ ID NO: 124559 - RNA, 1701 nt, Artificial Sequence; identical to SEQ ID NO: 124450
  derived and/or modified sequence opt3 from hemagglutinin__InfluenzaA__ACN32947

SEQ ID NO: 124560 - RNA, 1701 nt, Artificial Sequence
  derived and/or modified sequence opt3 from hemagglutinin__InfluenzaA__ACN32958
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagaaauaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaaguuuaaguauccagcacugaacgugaccaugcccaacaaugagcaguucgacaaacuuuacauuuggggaguccaccauccuggcacagauaacgaccagaucuuuuuguaugcccaagcuaguggccguauuacugugagcaccaagagaucucagcagacaguaaucccaaauauaggguccaggccccggguucgcaacauuccuucaagaaucagcauuuacuggaccaucgugaaaccaggagauauccugcuaauuaauaguacggguaaccucauagccccgaggggcuacuucaagauccggucugggaaauccagcauuaugcgcucggacgcgcccaucggaaaguguaauucugaaugcauaacuccuaacggcuccauuccaaaugacaagcccuuucagaacgucaaucgaaucacauauggugcauguccuagauacgugaaacaaaacacccugaaacuugccacugggaugaggaaugugccagagaagcagacacggggaaucuucggcgcuauugccggcuuuaucgaaaacgggugggagggaauggucgaugguugguauggcuuccgucaccaaaauucagaggggcgcggacaggcagcugaccugaagaguacccaggccgcgauugaucagauaaacggcaaauugaacagacucaucgguaagacgaaugaaaaauuccaccagauugagaaggaauuuagcgagguugaagggaggauccaagaccuggagaaguacguggaggauaccaaaaucgacuuaugguccuauaacgccgaacugcucguagcacuugagaaucagcauacaauugaucugacugacucugaaaugaacaaguuguucgagaaaaccaagaaacagcuacgggaaaaugcugaggauaugggcaacggaugcuuuaagauauaccacaagugugacaaugccugcaucggcagcauucgaaacgggacauaugaucaugacguguaccgcgacgaggcucugaauaacagauuccagaucaaaggagucgaacucaagucagguuacaaagauuggauucuguggaucaguuuugccauauccugcuuccuucuguguguggcauugcucggcuuuaucaugugggccugccaaaaggggaauauuagguguaacaucugcauuuga

SEQ ID NO: 124561 - RNA, 1701 nt, Artificial Sequence
  derived and/or modified sequence opt3 from hemagglutinin__InfluenzaA__ACN32969
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacaggugagauuugcgacuccccacaccaggugcuagauggcgaaaauuguacccucaucgacgcucugcuuggggauccgcagugcgacggauuccaaaacaaaaagugggaucuguuugucgagagaucuaaagccuauucgaauuguuaccccuaugacgugccugauuacgcaucauugaggagccucguugccaguuccggcacucuggaguucaacaaugaaucuuuuaacuggacaggugugacccagaaugggacgagcuccgcuugcauacggcgcucaaacaauaguuucuuuagccgacugaacuggcucacucauucuaaguucaaguauccagcauuaaaugucaccaugcccaacaacgaggaauuugacaaacuguacaucuggggagugcaccauccuggcacagauaaugaccagauuuuccuuuaugcccaggcuuccggccguaucacuguaucaaccaagagaagccaacagacaguuauuccaaacaucgggaguaggccccgggugcgcaauauaccuucuagaauuuccaucuacuggaccauugucaaaccaggagauaucuugcugaucaacagcacggguaaucuaauugccccgaggggcuacuuuaagcuccggucggggaaaucuuccauaaugcgcucagacgcgcccaucggaaaguguaacagugagugcauuacuccuaauggcagcaucccaaacgacaagcccuuccagaaugugaaccgaauaacauauggugcauguccuagauacgugaaacagaauacccugaaacuugccacugggaugaggaacgucccagaaaaacaaacacggggaauuuuuggcgcuaucgccggcuucaucgagaaugggugggagggaaugguugaugguugguauggcuuucgucaccagaacuccgaagggauuggacaggcagcugaccugaagucuacccaagccgcgaucgaucagauuaauggcaaauugaaccgccucauagguaagacgaacgagaaauuccaccagaucgaaaaggaguucagcgaaguggaggggaggauucaggaccuggagaaguacguagaagauaccaaaaucgacuuauggucauauaaugccgagcugcucguggcacuugaaaaccaacauacaaucgaucugacugacagugagaugaauaaguuguuugaaaagaccaagaaacagcuaagagagaacgcugaggauaugggcaauggaugcuucaagauuuaccacaagugugacaacgccugcauaggcuccauccggaaugggacauaugaucaugaagucuaccgagacgaggcucugaacaaucgcuuucagauuaaaggaguggaacucaagagcgguuacaaagacuggauccuguggauuucuuucgccaucucaugcuuucuucuguguguugcauugcucggcuucauaaugugggccugccagaaggggaacaucagauguaauauuugcaucuga

SEQ ID NO: 124562 - RNA, 1701 nt, Artificial Sequence
  derived and/or modified sequence opt3 from hemagglutinin__InfluenzaA__ACN32980
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagcccauucuaauuguuaucccuacgacgucccugauuaugcaucguugaggucacucguggccagcaguggcacucuggaauuuaacaaugaguccuucaacuggacagguguuacccagaaugggacgucuagcgcuugcauccggcgcuccaagaacucauuuuucagucgacugaauuggcucacucacuuaaaguuuaaauacccagcacugaacgugaccaugcccaaugacgagaaguucgauaaacuuuauauuuggggaguccaucacccuggcacagacaacgaucagaucuuuuuguacgcccaggcuagcggccguauuacugugucuaccaagagaucccaacagacaguaaucccaaacauagggucaaggccccggguucgcaauauuccuagcagaaucaguauuuauuggaccaucgugaaaccaggagacauccugcuaauuaacucuacggguaaucucauagccccgaggggcuacuucaagauccgguccggaaagagcucgauuaugcgcucugacgcgcccaucgggaaauguaacuccgaaugcauaacuccuaauggcucaauuccaaacgauaagcccuuucagaaugucaaccgaaucacauacggugcauguccuagauaugugaaacagaauacccugaagcuggccacugggaugaggaacgugccagagaaacaaacacggggaaucuucggcgcuauugccggcuuuaucgaaaaugggugggagggaauggucgacgguugguacggcuuccgucaccagaacagugaggggauuggacaggcagcugaucuuaagagcacccaagccgcgauagaccagaucaauggcaaauugaaccgccucauugguaagacgaaugaaaaguuccaucagaucgagaaagaauuuuccgagguugaagggagaauccaggaucuggagaaguauguggaggacaccaaaauugauuuauggucuuacaacgccgaacugcucguagcacuugagaaccaacacacaauagaccugacugauagcgaaaugaauaaguuguucgagaaaaccaagaagcagcuaagggaaaacgcugaggacaugggcaauggaugcuuuaaaaucuaucauaagugugauaacgccugcgugggcucaauucggaaugggacauacgaccacgacgucuaucgagaugaggcucugaacaaucgcuuccagaucaaaggaguggaacucaagagugguuacaaagacuggauucuguggaucuccuuugccauaagcugcuuccuucuguguguugcauugcucggcuuuaucaugugggccugccagaaggggaacauuagauguaauaucugcauuuga

SEQ ID NO: 124563 - RNA, 1701 nt, Artificial Sequence; identical to SEQ ID NO: 124450
  derived and/or modified sequence opt3 from hemagglutinin__InfluenzaA__ACN32991

SEQ ID NO: 124564 - RNA, 1701 nt, Artificial Sequence; identical to SEQ ID NO: 124450
  derived and/or modified sequence opt3 from hemagglutinin__InfluenzaA__ACN33002

SEQ ID NO: 124565 - RNA, 1701 nt, Artificial Sequence; identical to SEQ ID NO: 124450
  derived and/or modified sequence opt3 from hemagglutinin__InfluenzaA__ACN33013

SEQ ID NO: 124566 - RNA, 1701 nt, Artificial Sequence
  derived and/or modified sequence opt3 from hemagglutinin__InfluenzaA__ACN33035
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacgucuggggagugcaccauccuggcacagauaaugaccagaucuuuuuguaugcccaagcuagcggccguauuacuguaucuaccaagagaucccagcagacaguuauuccaaacaucgggucaaggccccgggugcgcaauauaccuagcagaauuaguaucuacuggaccauugucaaaccaggagauauccugcuaaucaacucuacggguaaucucauugccccgaggggcuacuucaagauacgguccgggaaaagcucgaucaugcgcucugacgcgcccauuggaaaguguaacuccgaaugcaucacuccuaauggcucaauaccaaacgacaagcccuuucagaaugugaaccgaauuacauauggugcauguccuagauacgugaaacaaaauacccugaagcuggccacugggaugaggaacgucccagagaaacagacacggggaaucuucggcgcuaucgccggcuuuauugaaaaugggugggagggaaugguugaugguugguauggcuuccgucaccagaacagugaggggcgcggacaagcagcugaccuuaagagcacccaggccgcgaucgaucagauuaauggcaaauugaacagacucauagguaagacgaacgaaaaauuccaccagaucgagaaggaauuuuccgagguggaagggaggauucaagaccuggagaaguacguagaggauaccaaaaucgacuuauggucuuauaaugccgaacugcucguggcacuugagaaccagcauacaaucgaucugacugacagcgaaaugaauaaguuguucgagaaaaccaagaaacagcuacgggaaaacgcugaggauaugggcaauggaugcuuuaagauuuaccacaagugugacaacgccugcauaggcucaauccgaaaugggacauaugaucaugacgucuaccgcgacgaggcucugaacaauagauuccagauuaaaggaguggaacucaagagugguuacaaagauuggauccuguggauuuccuuugccaucagcugcuuccuucuguguguugcauugcucggcuuuauaaugugggccugccaaaaggggaacaucagguguaauauuugcaucuga

SEQ ID NO: 124567 - RNA, 1701 nt, Artificial Sequence; identical to SEQ ID NO: 124450
  derived and/or modified sequence opt3 from hemagglutinin__InfluenzaA__ACN33046

SEQ ID NO: 124568 - RNA, 1701 nt, Artificial Sequence; identical to SEQ ID NO: 124450
  derived and/or modified sequence opt3 from hemagglutinin__InfluenzaA__ACN33057

SEQ ID NO: 124569 - RNA, 1701 nt, Artificial Sequence; identical to SEQ ID NO: 124450
  derived and/or modified sequence opt3 from hemagglutinin__InfluenzaA__ACN33068

SEQ ID NO: 124570 - RNA, 1701 nt, Artificial Sequence; identical to SEQ ID NO: 124553
  derived and/or modified sequence opt3 from hemagglutinin__InfluenzaA__ACN33079

SEQ ID NO: 124571 - RNA, 1698 nt, Artificial Sequence
  derived and/or modified sequence opt3 from hemagglutinin__InfluenzaA__ACN33090
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaagauucucacaacgggaaacuaugccuccugaagggaaucgcgccccuucagcuggguaauuguucagucgccggcuggauuuuggggaacccugagugcgaacuccugaucaguaaagagagcugguccuacauuguggaaaccccaaauccggagaacggaacuuguuaucccggcuacuuugcugacuaugaggaacugagagagcaacucucuucgguuagcucauucgaaagguuugagaucuucccuaaggagaguuccuggccaaaucauacagugaccggugucucugccagcugcucccacaacgggaagucaaguuuuuaccggaauuuacuguggcuuacgggcaaaaacggauuguaucccaaucugagcaagucuuacgcaaacaauaaagaaaaggaggugcuaguacucuggggcguucaucacccuuccaacauaggggaucagcgcgcccuguaccacacugaaaacgcuuaugugucagucgugagcagucauuacucucgacguuucaccccagagaucgcaaaaagacccaaggugagggaccaggaaggacggauuaauuauuacuggacacuucuggagccuggugauacuaucauuuuugaggccaacggcaauuugaucgcuccacgcuucgccuuugcgcucuccagaggguucggaagcggcauaauuaccucgaacgcaccgauggacgaaugugaugccaagugccagacaccccaaggugcuaucaauucuucccugccuuuucagaacguccacccaguuaccauuggggagugucccaaauaugugaggucaacgaaguuacggaugguaacuggacugcgcaauaucccuaguauccagagccgaggccucuucggcgccauugcaggguuuauagaaggagguuggacaggcaugguggacgggugguacggauaucaucaccagaacgagcaaggcuccgguuacgcugccgaucagaaaucuacccagaaugcgaucaacgggauuacuaauaaggucaacagcgugaucgaaaagaugaauacacaguucaccgccguuggcaaagaguucaacaaacuugagagaaggauggaaaaucugaacaagaagguggacgauggauuuuuggacauauggacguacaacgcagagcuacugguccuccuggaaaaugagcggacccuugacuuccacgauucaaacgugaaaaaucuguaugaaaagguaaaaagucaauugaagaacaaugcuaaagagauuggcaacgggugcuuugaguucuaccauaaguguaaugacgaaugcauggaguccguuaagaacggaacauaugauuacccaaaauauagcgaagagucuaagcucaaucgugagaaaaucgacggugugaagcuggaaucaaugggcgucuaccagaucuuagccauuuauaguacuguggcuagcucccugguccuacucgugucucugggggccaucucguuuuggaugugcagcaacggaucccuucagugucgcauuugcauauga

SEQ ID NO: 124572 - RNA, 1698 nt, Artificial Sequence; identical to SEQ ID NO: 123930
  derived and/or modified sequence opt3 from hemagglutinin__InfluenzaA__ACN33101

SEQ ID NO: 124573 - RNA, 1701 nt, Artificial Sequence; identical to SEQ ID NO: 124553
  derived and/or modified sequence opt3 from hemagglutinin__InfluenzaA__ACN33112

SEQ ID NO: 124574 - RNA, 1698 nt, Artificial Sequence; identical to SEQ ID NO: 124504
  derived and/or modified sequence opt3 from hemagglutinin__InfluenzaA__ACN33123

SEQ ID NO: 124575 - RNA, 1698 nt, Artificial Sequence; identical to SEQ ID NO: 124504
  derived and/or modified sequence opt3 from hemagglutinin__InfluenzaA__ACN33145

SEQ ID NO: 124576 - RNA, 1701 nt, Artificial Sequence; identical to SEQ ID NO: 124450
  derived and/or modified sequence opt3 from hemagglutinin__InfluenzaA__ACN33156

SEQ ID NO: 124577 - RNA, 1701 nt, Artificial Sequence
  derived and/or modified sequence opt3 from hemagglutinin__InfluenzaA__ACN33178
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauccggcgcuccaauaacucauucuuuagucgacugaauuggcugacucauagcaaauucaaguauccagcacucaacgugaccaugcccaacaaugagaacuuugacaaguuauacauuuggggaguccaccauccuggcacagauaaugaccagaucuuccuguaugcccaggcuucuggccguauuacuguguccaccaaaagaucacaacagacaguaaucccaaacauagggagcaggccccggguucgcaauauuccuaguagaaucucuauuuacuggaccaucgugaagccaggagauauccuuuugauuaacuccacggguaaucugauagccccgaggggcuacuuuaaaauccggagcgggaagucgucuauuaugcgcuccgacgcgcccaucggaaaauguaacucagaaugcauaacuccuaauggcaguauuccaaacgacaagcccuuccagaaugucaaccgaaucacauauggugcauguccuagauacgugaagcagaauacccuaaaacucgccacugggaugaggaacgugccagagaagcaaacacggggaaucuuuggcgcuauugccggcuucaucgaaaaugggugggagggaauggucgaugguugguauggcuuccgucaccagaacagcgaggggauuggacaggcagcugaccugaaauccacccaagccgcgauagaucagaucaacggcaaacuuaaucgccugauugguaagacgaacgaaaaguuucaccagaucgagaaagaguucucugaaguugaagggagaauccaggacuuggagaaguacguggaggauaccaagauugaccucuggagcuauaaugccgaacuguuaguagcacuggagaaccaacauacaauagaucucacugacucagaaaugaauaaacuuuuugagaagaccaaaaagcagcugagggaaaacgcugaggauaugggcaauggaugcuucaaaaucuaccacaagugugacaacgccugcauuggcaguauccggaaugggacauaugaucaugacguguaccgagacgaggcuuugaacaaucgcuuucacauuaagggagucgaacuaaaauccgguuacaaggauuggauccuguggaucagcuucgccauaucuugcuuucuccuguguauugcacuucugggcuucaucaugugggccugccagaaagggaacauuagauguaauaucugcauauga

SEQ ID NO: 124578 - RNA, 1701 nt, Artificial Sequence; identical to SEQ ID NO: 124450
  derived and/or modified sequence opt3 from hemagglutinin__InfluenzaA__ACN33189

SEQ ID NO: 124579 - RNA, 1701 nt, Artificial Sequence
  derived and/or modified sequence opt3 from hemagglutinin__InfluenzaA__ACN33200
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauccggcgcuccaauaacucauucuuuagucgacugaauuggcugacucauagcaaauucaaguauccagcacucaacgugaccaugcccaacaaugagaacuuugacaaguuauacauuuggggaguccaccauccuggcacagauaaugaccagaucuuccuguaugcccaggcuucuggccguauuacuguguccaccaaaagaucacaacagacaguaaucccaaacauagggagcaggccccggguucgcaauauuccuaguagaaucucuauuuacuggaccaucguggaaccaggagauauccuuuugauuaacuccacggguaaucugauagccccgaggggcuacuuuaagauccggagcgggaaaucgucuauuaugcgcuccgacgcgcccaucggaaaguguaacucagagugcauaacuccuaauggcaguauuccaaacgacaaacccuuccagaaugucaaccgaaucacauauggugcauguccuagauacgugaagcagaauacccuaaagcucgccacugggaugaggaacgugccagaaaaacaaacacggggaaucuuuggcgcuauugccggcuucaucgagaaugggugggagggaauggucgaugguugguauggcuuccgucaccagaacagcgaagggauuggacaggcagcugaccugaaguccacccaagccgcgauagaucagaucaacggcaaacuuaaucgccugauugguaagacgaacgagaaauuucaccagaucgaaaaggaguucucugaaguugaggggagaauccaggacuuggagaaauacguggaagauaccaagauugaccucuggagcuauaaugccgagcuguuaguagcacuggaaaaccaacauacaauagaucucacugacucagagaugaauaaacuuuuugaaaagaccaagaaacagcugagggagaacgcugaggauaugggcaauggaugcuucaagaucuaccacaaaugugacaacgccugcauuggcaguauccggaaugggacauaugaucaugacguguaccgagacgaggcuuugaacaaucgcuuucagauuaagggagucgaacuaaaguccgguuacaaagauuggauccuguggaucagcuucgccauaucuugcuuucuccuguguauugcacuucugggcuucaucaugugggccugccagaaggggaacauuagauguaauaucugcauauga

SEQ ID NO: 124580 - RNA, 1701 nt, Artificial Sequence
  derived and/or modified sequence opt3 from hemagglutinin__InfluenzaA__ACN33211
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucaugacguguaccgcgacgaggcucugaguaacagauuccagaucaaaggagucgaacucaaguccgguuacaaagauuggauucuguggaucagcuuugccauaucuugcuuccuucuguguguggcauugcucggcuuuaucaugugggccugccaaaaggggaauauuagguguaacaucugcauuuga

SEQ ID NO: 124581 - RNA, 1698 nt, Artificial Sequence; identical to SEQ ID NO: 123972
  derived and/or modified sequence opt3 from hemagglutinin__InfluenzaA__ACN42981

SEQ ID NO: 124582 - RNA, 1698 nt, Artificial Sequence; identical to SEQ ID NO: 124206
  derived and/or modified sequence opt3 from hemagglutinin__InfluenzaA__ACN42992

SEQ ID NO: 124583 - RNA, 1701 nt, Artificial Sequence; identical to SEQ ID NO: 124450
  derived and/or modified sequence opt3 from hemagglutinin__InfluenzaA__ACN43003

SEQ ID NO: 124584 - RNA, 1701 nt, Artificial Sequence
  derived and/or modified sequence opt3 from hemagglutinin__InfluenzaA__ACN43014
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggaucgguguuacacagaacgggaccucuagcgcuugcauucggcgcuccaauaacucauucuuuagucgacugaauuggcugacgcauagcaaauucaaguauccagcacucaacgugacuaugcccaacaaugagaacuuugacaaguuauacaucuggggaguccaccauccuggcaccgauaaugaccagauuuuccuguaugcccaggcuucuggccguaucacaguguccacuaaaagaucacaacagaccguaauaccaaacauugggagcaggccccggguucgcaauaucccuaguagaauuucuaucuacuggacaaucgugaagccaggagauauucuuuugauaaacuccaccgguaaucugaucgccccgaggggcuacuuuaaaauucggagcgggaagucgucuaucaugcgcuccgacgcgcccauaggaaacuguaauucagaaugcauuacgccuaacggcaguaucccaaaugacaaacccuuccagaacgucaaucgaaucacuuaugguagcuguccuagauacgugaagcagaacacacuaaagcucgcaaccgggaugaggaaugugccagagaaacaaacucggggaauuuuuggcgccaucgcuggcuucauugaaaacgggugggagggaauggucgaugguugguauggcuuccgucaccagaacuccgaggggauaggacaggccgcagaccugaagucuacacaagcugccaucgaucagauuaauggcaaacuuaaccgccugaucgguaagaccaaugaaaaauuucaccagaucgagaaggaguucagcgaaguugaagggaggauucaggacuuggagaaauacguggaggauacgaagauagaccucuggucauauaacgcggaacuguuaguagcccuggagaaucaacauaccaucgaucucacagacagugaaaugaacaaacuuuuugagaagacuaagaaacagcugagagaaaaugcagaggauaugggcaacggaugcuucaagauuuaccacaaaugugacaaugcuugcaucggcuccauucggaacgggaccuaugaucaugacguguaccgagacgaggccuugaauaaccgcuuucagaucaagggagucgaacuaaagagcgguuacaaagauuggauacuguggaucucuuucgcuauuucaugcuuucuccuguguaucgcccuucugggcuucauuaugugggcaugccagaaggggaauaucagauguaacauaugcauuuga

SEQ ID NO: 124585 - RNA, 1701 nt, Artificial Sequence; identical to SEQ ID NO: 124450
  derived and/or modified sequence opt3 from hemagglutinin__InfluenzaA__ACN43025

SEQ ID NO: 124586 - RNA, 1701 nt, Artificial Sequence; identical to SEQ ID NO: 124450
  derived and/or modified sequence opt3 from hemagglutinin__InfluenzaA__ACN43036

SEQ ID NO: 124587 - RNA, 1701 nt, Artificial Sequence; identical to SEQ ID NO: 124450
  derived and/or modified sequence opt3 from hemagglutinin__InfluenzaA__ACN43047

SEQ ID NO: 124588 - RNA, 1701 nt, Artificial Sequence
  derived and/or modified sequence opt3 from hemagglutinin__InfluenzaA__ACN43058
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcggcagcccacaccagauccuagacggggaaaauuguacccucauagaugcucugcuuggagacccgcagugcgauggcuuucaaaacaaaaagugggaccuguucguggagagauccaaagccuauucuaauuguuaccccuaugaugucccugacuacgcaucguugaggucacucguggccagcagugguacucuggaauuuaacaaugaguccuucaacuggacagggguuacccagaauggaacgucuagcgcuugcauccggcgcuccaacaauucauuuuucagucgacugaacuggcucacucauuuaaaguuuaaguauccagcacugaaugugaccaugcccaacaacgagcaguucgauaaacuuuacauuuggggcguccaccauccuggcacagacaaugaucagaucuuuuuguaugcccaagcuagcgggcguauuacugugucuaccaagagaucccagcagacaguaaucccaaacauaggaucaaggccccggguucgcaauauuccuagcagaaucaguauuuacuggaccaucgugaaaccaggugacauccugcuaauuaacucuacgggcaaucucauagccccgaggggguacuucaagauccgguccggaaaaagcucgauuaugcgcucugaugcgcccaucggcaaguguaacuccgaaugcauaacuccuaaugguucaauuccaaacgacaagcccuuucagaaugucaaccgaaucacauauggggcauguccuagauacgugaaacaaaauacccugaagcuggccacuggaaugaggaacgugccagagaaacagacacggggcaucuucggcgcuauugccggguuuaucgaaaauggaugggaggguauggucgacggcugguauggguuccgucaccagaacagugagggacgcggccaagcagcugaucuuaagagcacccaggccgcgauugaccagauaaaugguaaauugaacagacucaucgggaagacgaacgaaaaauuccaccagauugagaaggaauuuuccgagguugaaggcaggauccaagaucuggagaaguacguggaggacaccaaaaucgauuuauggucuuauaaugccgaacugcucguagcacuugagaaccagcauacaauugaccugacugauagcgaaaugaauaaguuguucgagaaaaccaagaaacagcuacgggaaaacgcugaggacaugggaaauggcugcuuuaagauauaccacaagugugauaacgccugcaucgggucaauucgaaauggaacauaugaccaugauguguaccgcgacgaggcucugaacaauagauuccagaucaaaggugucgaacucaagaguggcuacaaagacuggauucuguggaucuccuuugccauaagcugcuuccuucuguguguggcauugcucggguuuaucaugugggccugccaaaagggaaacauuagguguaauaucugcauuuga

SEQ ID NO: 124589 - RNA, 1701 nt, Artificial Sequence; identical to SEQ ID NO: 124450
  derived and/or modified sequence opt3 from hemagglutinin__InfluenzaA__ACN43069

SEQ ID NO: 124590 - RNA, 1701 nt, Artificial Sequence; identical to SEQ ID NO: 124553
  derived and/or modified sequence opt3 from hemagglutinin__InfluenzaA__ACN43080

SEQ ID NO: 124591 - RNA, 1701 nt, Artificial Sequence
  derived and/or modified sequence opt3 from hemagglutinin__InfluenzaA__ACN72617
auggaggccaagcuguucgugcucuuuugcgcuuucaccgcacuuaaagccgacacaaucugugucggcuaccacgcgaacaauagcacugauacgguugacaccauucuggaaaagaacgugacaguaacucauuccgugaauuuguuagagaacucucacaaugggaaacugugcucacuaaacggaaaggcuccccuccagcuggguaauuguaacgucgccggcuggauacuugggaauccugaaugcgaucuguugcucaccgcaaacaguuggagcuauaucauugagacauccgacucuaaaaauggagccuguuacccaggcgaauuugcugauuaugaggagcugagagaacaacugucgaccgugaguagcuucgagagguuugaaaucuucccgaaggcaacuucauggcccaaccaugagacaaccaaggguacgacuguugccugcucccacucuggggcuaauagcuuuuaccggaaccucuuauggauugugaaaaagggaaauuccuauccuaaacugucaaagaguuacaccaacaacaaaggcaaggagguccuugugaucuggggcguacaucacccacccacagacagcgaucagcagacuuuguaucagaauaagcacaccuacguuucugugggguccucaaaauacuaucaacgcuucacaccugaaauagucacccgaccaaaggugcgugagcaggccggaagaaugaacuacuauuggacgcugcuagaccagggugauacuaucacauuugaagcgaccggcaaucucauugcacccuggcaugccuucgcucugaacaaagggagcaauaguggaaucaugaugucugacgcccacgugcauaacuguacuacaaagugccagaccccucacggcgcacuuaaagguaaucugccauuucaaaacguccacccgauuacgaucggggagugucccaaguacguuaaauccacccaguugaggauggcuacaggacuccggaauauaccuagcauucagucgcgcggccuguucggcgccaucgcgggguuuauugaaggagguuggacuggcaugaucgaugggugguauggauaccaucaccagaacgagcaaggcucugguuaugccgcagacagaaaguccacccagaucgcuauugaugggauaucaaauaaggugaacaguguaaucgagaaaaugaauauucaguucacaagcgugggcaaggaauuuaacaauuuagagaaaaggaucgaaaaccugaacaagaaagucgacgacggauuccucgauguguggacuuacaaugccgagcuucugauauugcuagaaaacgagcggacccuggacuuccaugauuuuaauguuaagaaccucuacgagaaggugaaaucccaacugcgcaauaacgcuaaggaaauuggcaaugggugcuucgaguuuuaucacaaaugugacaacgaaugcauggagucugucaagaauggaacauacaacuauccacgauacagcgaagagucaaaacuuaauagagaggaaaucgauggugugaagcuggagaguguaggcguucaucagaucuuggccauuuauuccaccguggcaagcucucucguccuguuagugucacugggggccaucaguuucuggaugugcagcaacggaucccuacaguguaggauuugcauauga

SEQ ID NO: 124592 - RNA, 1701 nt, Artificial Sequence
  derived and/or modified sequence opt3 from hemagglutinin__InfluenzaA__ACN72632
augaagaccgugaucgcccugagcuacgucuucugccucguuuuuggccaggaccuucccgggaaaggaaacaauacagcuacucuguguuugggucaccaugcagugccuaacggcacguuaguaaagaccauuacagaugaccaaauagaggugacuaaugccaccgaacugguccagaacuucuccaucgggaaaauuugcaagaauccacacagaauccuagauggagcgaacuguacacucauugacucucugcuuggcgauccgcauugcgacgguuuucagaaugagaaaugggaucuguucaucgaaaggucaaaggcuuuuaguaacuguuaucccuacgacgugccugaguauaccagcuugcggucccucauagccucuucggggacucuggaguucacaaaugaagauuuuaacuggaccggaguuacgcagaauggcggcucaagcgcaugcaagcgcgggccaaacaauaguuucuuuucccgacugaacuggcucuacaaaucuggaaauacuuaucccauguuaaacgugaccaugccuaacagcgacgauuucgacaagcuguacaucugggguguccaccauccauccacagaucgugagcaaacuaaucuuuauauucaggccucaggcaaaaucauugugaguaccaagagaagccagcagacaaucauacccaacauugggucuaggccuuggguacggggauuguccucacgcaucagcauuuacuggaccaucguuaaaccaggcgacauccugauuauaaauaguaacgguaaucuaaucgcuccgagaggguacuuuaagauucaaacgggaaagucuuccgugaugaggagcgacgcacccaucggcacuuguaacuaugaaugcauaacaccuaauggcucgauuccaaacgauaaacccuuccagaaugucaaccggaucaccuacggggccuguccucacuauaucaagcagaauacucucaaacuggcuacaggaaugcgcaacauuccagagcgacagaccagagguaucuuuggcgccauugcgggguucauagaaaauggaugggagggcauggugaacgguugguacggguucaggcaccaaaauucugagggcaucggacaggcagccgaccuuaaguccacgcaggcugccauuaaccaaaucaacggcaaacugaaucgggugaucgaaaagaccaacgagaaauuucaucagauugaaaaggaguucucagaagucgaggggcguauacaggauuuggagcgcuauguugaagacacaaagaucgaucucuggaguuacaaugcagagcuguuaguggcucuggaaaaccagcacacuauugaccucaccgauagcgagaugaauaaacuuuuugaaaagacaagaaaacaacugagggagaacgccgaggacaugggaaaugguugcuucaagaucuaucauaaaugugauaacuccugcauggaaucuauucggaauggcacuuacgaccacaacgaguaccgagaugaagcgguaaauaaccgcuuucagaucaagagcguggaguugaagucaggguauaaagacuggauacuauggaucaguuucgccauuuccugcuuucugcucugugcagucuggcugggauucaucauuugggcuugccagaagggcaauaucagauguaacauaugcauuuga

SEQ ID NO: 124593 - RNA, 1701 nt, Artificial Sequence; identical to SEQ ID NO: 124450
  derived and/or modified sequence opt3 from hemagglutinin__InfluenzaA__ACN76478

SEQ ID NO: 124594 - RNA, 1701 nt, Artificial Sequence
  derived and/or modified sequence opt3 from hemagglutinin__InfluenzaA__ACN76489
augaagaccaucauugcccugggcuacauacucugccuugugagcgcucagaaacugcccgggaacgacaauuccacagcaacuuuguguuuaggacaccaugccgucccuaacgguacgaucguuaagaccauuacaaaugaucaaaucgaggugacuaacgcgaccgaacugguacagucuucaaguacaggcgagauuugcgacagcccacaccaggugcuagauggggaaaauuguacccucaucgacgcucugcuuggagauccgcagugcgacggcuuccaaaacaaaaagugggaucuguuugucgagagauccaaagccuauucuaauuguuaccccuaugacgugccugauuacgcaucguugaggucacucguugccagcagugguacucuggaguucaacaaugaauccuuuaacuggacaggggugacccagaauggaacgucuagcgcuugcauacggcgcuccaacaauucauucuuuagucgacugaacuggcucacucauuuaaaguucaaguauccagcacugaaugucaccaugcccaacaacgaggaauuugacaaacuuuacaucuggggcgugcaccauccuggcacagauaaugaccagauuuucuuguaugcccaggcuagcgggcguaucacuguaucuaccaagagaucccaacagacaguuauuccaaacaucggaucaaggccccgggugcgcaauauaccuagcagaauuaguaucuacuggaccauugucaaaccaggugauauccugcuaaucaacucuacgggcaaucucauugccccgaggggguacuuuaagauacgguccggaaaaagcucgaucaugcgcucugacgcgcccauuggcaaguguaacuccgagugcaucacuccuaaugguucaauaccaaacgacaagcccuuccagaaugugaaccgaauuacauauggggcauguccuagauacgugaaacagaauacccugaagcuggccacuggaaugaggaacgucccagaaaaacaaacacggggcaucuuuggcgcuaucgccggguucauugagaauggaugggaggguaugguugauggcugguauggguuucgucaccagaacagugaaggaaucggccaggcagcugaccuuaagagcacccaagccgcgauugaucagauaaaugguaaauugaaccgccucaucgggaagacgaacgagaaauuccaccagauugaaaaggaguucuccgaaguggagggcagaauccaggaccuggagaaguacguagaagauaccaaaaucgacuuauggucuuauaaugccgagcugcucguggcacuugaaaaccaacauacaauugaucugacugacagcgagaugaauaaguuguuugagaaaaccaagaaacagcuaagggaaaacgcugaggauaugggaaauggcugcuucaagauauaccacaagugugacaacgccugcaucgggucaauucggaauggaacauaugaucaugaagucuaccgagacgaggcucugaacaaucgcuuucagaucaaagguguggaacucaagaguggcuacaaagacuggauucuguggaucuccuucgccauaagcugcuuucuucuguguguugcauugcucggguucaucaugugggccugccagaagggaaacauuagauguaauaucugcauuuga

SEQ ID NO: 124595 - RNA, 1701 nt, Artificial Sequence; identical to SEQ ID NO: 124450
  derived and/or modified sequence opt3 from hemagglutinin__InfluenzaA__ACN76500

SEQ ID NO: 124596 - RNA, 1701 nt, Artificial Sequence; identical to SEQ ID NO: 124450
  derived and/or modified sequence opt3 from hemagglutinin__InfluenzaA__ACN76511

SEQ ID NO: 124597 - RNA, 1701 nt, Artificial Sequence; identical to SEQ ID NO: 124450
  derived and/or modified sequence opt3 from hemagglutinin__InfluenzaA__ACN76522

SEQ ID NO: 124598 - RNA, 1701 nt, Artificial Sequence; identical to SEQ ID NO: 124450
  derived and/or modified sequence opt3 from hemagglutinin__InfluenzaA__ACO36331

SEQ ID NO: 124599 - RNA, 1701 nt, Artificial Sequence
  derived and/or modified sequence opt3 from hemagglutinin__InfluenzaA__ACO36342
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauccggcgcuccaauaacucauucuuuagucgacugaauuggcugacucauagcaaauucaaguauccagcacucaacgugaccaugcccaacaaugagaacuuugacaaguuauacauuuggggaguccaccauccuggcacagauaaugaccagaucuuccuguaugcccaggcuucuggccguauuacuguguccaccaaaagaucacaacagacaguaaucccaaacauagggagcaggccccggguucgcaauauuccuaguagaaucucuauuuacuggaccaucgugaagccaggagauauccuuuugauuaacuccacggguaaucugauagccccgaggggcuacuuuaaaauccggagcgggaagucgucuauuaugcgcuccgacgcgcccaucggaaaauguaacucagaaugcauaacuccuaauggcaguauuccaaacgacaagcccuuccagaaugucaaccgaaucacauauggugcauguccuagauacgugaagcagaauacccuaaaacucgccacugggaugaggaacgugccagagaagcaaacacggggaaucuuuggcgcuauugccggcuucaucgaaaaugggugggagggaauggucgaugguugguauggcuuccgucaccagaacagcgaggggauuggacaggcagcugaccugaaauccacccaagccgcgauagaucagaucaacggcaaacuuaaucgccugauugguaagacgaacgaaaaguuucaccagaucgagaaagaguucucugaaaucgaagggaggauucaggacuuggagaaguacguugaggauaccaagauagaccucuggagcuauaaugccgaacuguuaguggcacuggagaaccaacauacaaucgaucucacugacucagaaaugaauaaacuuuuugagaagaccaaaaagcagcugagagaaaacgcugaggauaugggcaauggaugcuucaaaauuuaccacaagugugacaacgccugcaucggcaguauucggaaugggacauaugaucaugacguauaccgagacgaggcuuugaacaaucgcuuucagaucaagggaguggaacuaaaauccgguuacaaggauuggauacuguggaucagcuucgccauuucuugcuuucuccuguguaucgcacuucugggcuucauuaugugggccugccagaaagggaacaucagauguaauauaugcauuuga

SEQ ID NO: 124600 - RNA, 1701 nt, Artificial Sequence
  derived and/or modified sequence opt3 from hemagglutinin__InfluenzaA__ACO36364
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaaaagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggaccggacaggcagcugaccugaaaagcacgcaagccgcgauugaucagauaaauggcaaguugaaccgccucaucgguaaaaccaacgaaaaguuccaccagauugagaaggaauuuuccgagguugaagggagaauccaggaccuggagaaauacguggaggauacaaagaucgacuuauggucuuauaaugccgaacugcucguagcacuugagaaccaacauacuauugaucugaccgacagcgaaaugaauaaauuguucgagaagacaaagaagcagcuaagggaaaacgcugaggauaugggcaauggaugcuuuaagauauaccacaaaugugacaacgccugcaucggcucaauucggaaugggacuuaugaucaugacguguaccgagacgaggcucugaacaaucgcuuccagaucaagggagucgaacucaaaagugguuacaaggauuggauucuguggaucuccuuugccauaagcugcuuccuucuguguguggcauugcucggcuuuaucaugugggccugccagaaagggaacauuagauguaauaucugcauuuga

SEQ ID NO: 124601 - RNA, 1701 nt, Artificial Sequence; identical to SEQ ID NO: 124317
  derived and/or modified sequence opt3 from hemagglutinin__InfluenzaA__ACO36375

SEQ ID NO: 124602 - RNA, 1698 nt, Artificial Sequence; identical to SEQ ID NO: 124504
  derived and/or modified sequence opt3 from hemagglutinin__InfluenzaA__ACO36397

SEQ ID NO: 124603 - RNA, 1701 nt, Artificial Sequence; identical to SEQ ID NO: 124317
  derived and/or modified sequence opt3 from hemagglutinin__InfluenzaA__ACO36408

SEQ ID NO: 124604 - RNA, 1701 nt, Artificial Sequence; identical to SEQ ID NO: 123944
  derived and/or modified sequence opt3 from hemagglutinin__InfluenzaA__ACO36419

SEQ ID NO: 124605 - RNA, 1701 nt, Artificial Sequence; identical to SEQ ID NO: 123944
  derived and/or modified sequence opt3 from hemagglutinin__InfluenzaA__ACO36430

SEQ ID NO: 124606 - RNA, 1701 nt, Artificial Sequence
  derived and/or modified sequence opt3 from hemagglutinin__InfluenzaA__ACO36441
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugauggcugguacggguuccgucaccagaacucugagggaaccggccaggcagcugaccugaaaagcacgcaagccgcgauuaaucagaucaacgguaaguugaaucgccucauugggaagaccaacgagaaauuucaccagauagaaaaggaguucucagaaguggagggcagaauccaggaucuggaaaaauauguagaggacacaaagauugauuuauggaguuacaaugccgagcugcucguggcacuugaaaaccaacauacuaucgaccugaccgauuccgagaugaacaaauuguucgaaaggacaaagaagcagcuacgggagaaugcugaagacaugggaaacggcugcuuuaaaaucuaucacaagugugauaaugccugcauugggagcauacgaaacggaacuuacgaccaugacgucuaccgcgaugaggcucugaauaacagauuccagaucaaagguguggagcucaagucuggcuauaaagacuggauucuguggaucucauuugccauuaguugcuuccuucuguguguugcauugcucggguuuaucaugugggccugccagaagggaaauauaaggugugauaucugcauuuga

SEQ ID NO: 124607 - RNA, 1701 nt, Artificial Sequence
  derived and/or modified sequence opt3 from hemagglutinin__InfluenzaA__ACO36452
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcuccugcaagcggcgcucaaauaacagcuuuuucagucgacugaauuggcucacucauuuaaaguauaaauacccagcucugaacgugaccaugcccaauaacgagaaguuugauaaacuuuauaucuggggcguccaccauccuggcacagacucugaucagauuuccuuguacgcacaggccucagggcguaucacuauuagcaccaagagaagucaacagacagugaucccaaacauaggaucuaggccccggguacgcgacguuuccagcagaauuucgaucuacuggaccauugugaaaccuggugacauccugcuaaucaauucuacgggcaaccucauugcuccaaggggguauuucaagauacgguccggaaagucaaguaucaugcgcagcgaugccccgauuggcaaauguaauuccgagugcaucacucccaacgguucuauaccuaaugacaagccauuucagaacgucaaucgaauuacauacggggcgugucccagauaugugaaacagaacacccugaaacuugcaacuggaaugaggaaugugccugaaaaacaaacacggggcaucuucggcgccaucgcuggguuuauugagaacggaugggaagguauggucgauggcugguacggguuccgucaccagaauagcgagggaaccggccaggccgcagaccugaagucaacgcaagcugccaucaaccagauuaaugguaaauugaaccgccucauagggaagaccaaugagaaguuucaccagaucgaaaaagaguucagugaaguugagggcaggauucaggaucuggaaaaguauguggaggacacaaaaaucgauuuaugguccuacaacgcggagcugcucguagcccuugaaaaccaacauacuaucgaccugaccgauagcgagaugaauaaguuguucgaaagaacaaagaagcagcuacgggagaacgcagaagacaugggaaauggcugcuuuaagauuuaucacaaaugugauaacgcuugcauagggucuauccgaaauggaacuuacgaccaugacguguaccgcgaugaggcccugaacaauagauuccagauuaagggugucgagcucaaaucaggcuauaaggacuggauccuguggauuaguuuugcuaucagcugcuuccuucuguguguggccuugcucggguuuauaaugugggcaugccagaaaggaaacaucagguguaauauuugcaucuga

SEQ ID NO: 124608 - RNA, 1701 nt, Artificial Sequence
  derived and/or modified sequence opt3 from hemagglutinin__InfluenzaA__ACO36463
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucaucgaaagauccaaagccuauucuaauuguuaccccuaugacgugccugauuacgcaucguugaggucacucgucgccagcagugguacucuggaguuuaacaaugaauccuucaacuggacaggggugacccagaauggaacgucuagcgcuugccagcggcgcuccaacaagucauuuuucagucgacugaauuggcucacucauuuaaaguuuaaauauccagcacugaacguuaccaugcccaauaacgagaaguucgacaaacuuuacauuuggggcgugcaccauccuggcacagauaacgaccagaucagcuuguaugcccaaacuucugggcguauuaccgucuccacaaagagaucacagcagaccgugaucccaaauauaggaagcaggccccggguacgcgauguuccuaguagaauuucuaucuacuggacgauugugaaaccaggugacauccugcuaaucaacuccacuggcaaucucauugcuccgaggggguacuuuaagauacggagcggaaagucgucuaucaugcgcuccgacgcccccauuggcaaauguaacucagagugcaucacaccuaaugguaguauaccaaacgauaagcccuuccagaaugucaaccgaauuaccuauggggcguguccuagauacgugaaacaaaauacucugaaacuugcaacaggaaugaggaacgugccagaacggcagacccguggcaucuuuggcgccaucgcuggguucauugagaauggaugggaagguauggucgacggcugguauggguuucgccaccagaacagcgagggaacgggccaagccgcagaucugaaguccacccaggcugccaucaaucagauuaacgguaaguugaauagacucauagggaaaacaaacgagaaguuccaccagaucgaaaaggaguucucugaaguugagggcaggauucaagaccuggaaaaauacguggaggauacuaagaucgacuuauggagcuauaacgcggagcugcucguagcccuugaaaaucagcauaccaucgaucugacagacucagagaugaacaaauuguuugaacggacuaagaaacagcuacgagagaaugcagaagauaugggaaacggcugcuucaagauuuaccacaagugugacaaugcuugcauagggaguauccgcaacggaaccuaugaucaugacguguacagagacgaggcccugaauaacagguuucagauuaaaggugucgagcucaaguccggcuacaaagauuggauccuguggauuagcuucgcuaucucuugcuuugugcuuuguguugcccuguugggguucauaaugugggcaugccaaaagggaaauauccgguguaacauuugcaucuga

SEQ ID NO: 124609 - RNA, 1701 nt, Artificial Sequence
  derived and/or modified sequence opt3 from hemagglutinin__InfluenzaA__ACO36474
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcuccugcaagcggcgcucaaauaacagcuuuuucagucgacugaauuggcucacucauuuacguuauaaguacccagcucugaacgugaccaugcccaauaacgagaaauuugauaaacuuuauaucuggggcguccaccauccuggcacagacucugaucagauuuccuuguacgcacaggccucagggagaaucacugugagcaccaagaggagucaacagacaguaauuccaaacaucggaucucggccccgcguuagagacguguccagcaggauaucgauuuacuggaccaucgucaagccuggugacauucugcuaaucaauucuacgggcaaccucaucgcuccacggggguauuucaaaauucgcuccggaaagucaaguauaaugcgaagcgaugccccgaucggcaaguguaauuccgagugcauuacucccaacgguucuaucccuaaugacaaaccauuucagaacgugaauagaauaacauacggggauugucccagguaugugaagcagaacacccugaaacuugcgacuggaaugcggaaugucccugaaaagcaaacacguggcauuuucggcgcaaucgccggguuuaucgagaacggaugggaagguaugguugacggcugguacggguuccgccaccagaauagcgagggaaccggccaggcugccgaucugaaaucaacgcaagcagcuauuaaccagaucaaugguaaguugaacagacucauugggaaaaccaaugagaaguuucaccagauagaaaaggaguucagugaaguggagggcaggauccaggaccuggaaaaauauguagaggauacaaagauugacuuaugguccuacaacgccgagcugcucguggcgcuugaaaaccaacauacuaucgaucugaccgacagcgagaugaauaaauuguucgaacggacaaagaaacagcuacgagagaacgccgaagauaugggaaauggcugcuuuaagaucuaucacaagugugacaacgcaugcauugggucuauacgcaauggaacuuacgaccaugaugucuacagagacgaggcucugaacaauagguuccagaucaaagguguggagcucaagucaggcuauaaagauuggauucuguggaucaguuuugccauuagcugcuuccuucuguguguugcuuugcucggguuuaucaugugggccugccagaagggaaacauacgguguaauaucugcauuuga

SEQ ID NO: 124610 - RNA, 1701 nt, Artificial Sequence
  derived and/or modified sequence opt3 from hemagglutinin__InfluenzaA__ACO36496
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauggcuuuuucucacgacugaacuggcucacucauuuaaaguuuaaauauccagcacugaaugugaccaugcccaacaacgagaaguucgacaaacuuuacaucuggggcguccaccauccugggacagauaaugaccagauuaguuuguaugcccaggcuagcggacguaucacugugucuaccaagagaucccaacagacaguaauuccaaacaucgguucaaggccccggguucgcgauauaagcaguagaauuucuaucuacuggaccauugugaaaccuggcgacauccugcuaaucaauuccacggggaaccucauugccccaaggggauacuuuaagauacggagcggcaagucgucuaucaugcgcuccgacgcgccgauugguaaauguaauucagagugcaucacucccaacgggaguauaccuaaugauaagccauuccagaacgucaaucgaauuacauauggagcaugucccagauacgugaaacagaacacccugaaacuugccacuggcaugaggaaugugccugaaacacaaacccggggcaucuuuggggcuaucgccggauucauugagaacgguugggaaggcauggucgacgggugguauggauuucgucaccagaauagcgagggcacgggucaggcagcugaucugaaguccacccaagccgcgaucaaccagauuaaugggaaguugaaccgccucauaggcaaaacaaacgagaaguuccaccagaucgaaaaggaguucucugaaguugagggaaggauucaggaccuggaaaaauacguggaggauacuaagaucgacuuauggagcuauaaugccgagcugcucguagcacuugaaaaccaacauaccaucgaucugacagacucagagaugaauaaauuguuugaaagaacuaagaaacagcuacgggagaacgcugaagauaugggcaaugggugcuucaagauuuaccacaagugugacaacgccugcauaggaaguauccgaaaugguaccuaugaucaugacguguaccgcgacgaggcucugaacaauagauuucagauuaaaggcgucgagcucaaguccggguacaaagauuggauccuguggauuagcuucgccaucucuugcuuucuucuguguguggcauugcucggauucauaaugugggccugccagaagggcaacaucagguguaauauuugcaucuga

SEQ ID NO: 124611 - RNA, 1701 nt, Artificial Sequence
  derived and/or modified sequence opt3 from hemagglutinin__InfluenzaA__ACO36518
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuagcuuguaugcccaggcuucugggcguaucacuguguccaccaagagaucacaacagacaguaauuccaaauaucggaagcaggccccggguucgcgaugugccuaguagaauaucuauuuacuggaccaucgucaagccaggugacauucugcuaaucaacuccacgggcaaucucaucgccccgaggggguacuuuaagauucggagcggaaaaucgucuauaaugcgcuccgacgcgcccaucggcaaguguaacucagagugcauuacuccuaaugguaguaucccaaacgauaaacccuuccagaaugugaaccgaauaacauaugggaccuguccuagauacgugaagcagaauacucugaaacuugcaacaggaaugaggaacgucccagaaaagcaaacccggggcauuuuuggcgccaucgcuggguucaucgagaauggaugggaagguaugguugacggcugguauggguuucgucaccagaacagcgagggaacgggccaggccgcagaucugaaauccacccaagcugccauuaaucagaucaacgguaaguugaaucgccucauugggaagacaaacgagaaauuccaccagauagaaaaggaguucucugaaguggagggcagaauccaggaccuggaaaaauacguagaggauacuaagauugacuuauggagcuauaacgcggagcugcucguggcccuugaaaaucaacauaccaucgaucugacagacucagagaugaacaaauuguuugaaaggacuaagaagcagcuacgggagaaugcagaagauaugggaaacggcugcuucaaaaucuaccacaagugugacaaugcuugcauugggaguauacgaaacggaaccuaugaucaugacgucuaccgcgacgaggcccugaauaacagauuucagaucaaagguguggagcucaagcugggcuacaaagauuggauucuuuggaucuccuucgcuauuagcugcuuucuguuguguguugcccuccugggguucaucaugugggcaugccagaagggaaauauaagguguaacaucugcauuuga

SEQ ID NO: 124612 - RNA, 1701 nt, Artificial Sequence
  derived and/or modified sequence opt3 from hemagglutinin__InfluenzaA__ACO36551
augaagaccaucauugcccugagccacauacucugccuuguguucgcucagaaacccccuggcaacgacaauuccacagcaacucuguguuuggggcaucacgccgucccaaacggaacgaucguuaagaccauuacaaaugaucaaaucgaggugacuaacgcgaccgaauuaguacagucuucaaguacagguggcauuugcgacagcccgcaucagauccuggauggggagaauuguacccuaauagacgcucuccugggagauccccagugcgacggcuuucaaaacaaaaagugggaucuuuucguggaaagauccaaagccuacucuaauuguuauccuuacgacgucccagauuaugcaucgcugaggucauugguggccagcagugguacucucgaguuuaacaaugaauccuucaacuggacagggguuacccagaauggaacgucuagcgcuugcaagcggcgcuccaacaauucauuuuucagucgacugaacuggcugacucaccucaaguuuaaauaccccgcauuaaaugugaccaugccuaacaacgagaaguucgacaaacuguauaucuggggcguccaucacccaggcacagauaaugaccagauuagccuuuacgcccaggcuucugggcguaucacuguguccaccaagagaucacaacagacaguaauucccaacaucggaagcaggccucggguucgcgauauaaguucuagaauuuccaucuauuggaccauugugaaaccaggugacaucuugcugaucaauagcacgggcaaccuaauugccccgaggggguacuuuaagauacggucgggaaagucuuccaucaugcgcucagacgcgcccauuggcaaauguaauagugagugcaucacuccuaacgguagcauaccaaaugauaagcccuuccagaacgucaaucgaauuacauacggggcauguccuagauaugugaaacagaacacccucaagcuggccacuggaaugaggaaugugccagaaacacaaacccggggcaucuuuggcgcuaucgccggguucauugagaacggaugggaagguauggucgacggcugguacggguuucgucaccagaauagcgagggaacgggccaggcagcugaucuuaaaucuacccaagccgcgaucaaccagauuaaugguaagcugaaccgcuugauagggaaaacaaacgagaaguuccaucagaucgaaaaggaguucagcgaaguugagggcaggauucaggaccucgaaaaauauguggaggauacuaagaucgaccuguggucauacaaugccgaguuacugguagcacucgaaaaccaacacaccaucgaucuuacagacagugagaugaauaaacuguuugaaagaacuaagaaacaguugcgggagaacgcugaagauaugggaaauggcugcuucaagauuuaucauaagugugacaacgccugcauaggguccauccgaaaugagaccuacgaucacgacguguaucgcgacgaggcucuaaacaauagauuucagauuaaaggagucgaacugaaguccgguuacaaagauuggauccucuggauuucuuucgccaucucaugcuuucugcuuuguguggcacuguugggcuucauaaugugggccugccagaaggggaacaucagguguaauauuugcaucuga

SEQ ID NO: 124613 - RNA, 1701 nt, Artificial Sequence
  derived and/or modified sequence opt3 from hemagglutinin__InfluenzaA__ACO36562
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaacacaaacccggggcaucuuuggcgcuaucgccggguucauugagaacggaugggaagguauggucgacggcugguauggguuucgucaccagaauagcgagggaacgggccaggcagcugaucugaaguccacccaagccgcgaucaaccagauuaaugguaaguugaaccgccucauagggaaaacaaacgagaaguuccaccagaucgaaaaggaguucucugaaguugagggcaggauucaggaccuggaaaaauacguggaggauacuaagaucgacuuauggagcuauaaugccgagcugcucguagcacuugaaaaccaacauaccaucgaucugacagacucagagaugaauaaauuguuugaaagaacuaagaaacagcuacgggagaacgcugaagauaugggaaauggcugcuucaagauuuaccacaagugugacaacgccugcauagggaguauccgaaaugagaccuaugaucaugacguguaccgcgacgaggcucugaacaauagauuucagauuaaaggagucgaacucaaguccgguuacaaagauuggauccuguggauuagcuucgccaucucuugcuuucuucuguguguggcauugcucggcuucauaaugugggccugccagaaggggaacaucagguguaauauuugcaucuga

SEQ ID NO: 124614 - RNA, 1701 nt, Artificial Sequence
  derived and/or modified sequence opt3 from hemagglutinin__InfluenzaA__ACO36573
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaaguucuagaauuuccaucuacuggaccauugugaaaccuggugacauccugcuaaucaauagcacgggcaaccucauugccccaaggggguacuuuaagauacggucgggaaagucuuccaucaugcgcucagacgcgccgauuggcaaauguaauagugagugcaucacucccaacgguagcauaccuaaugauaagccauuccagaacgucaaucgaauuacauauggggcaugucccagauacgugaaacagaacacccugaaacuugccacuggaaugaggaaugugccugaaacacaaacccggggcaucuuuggcgcuaucgccggguucauugagaacggaugggaagguauggucgacggcugguauggguuucgucaccaaaauuccgagggaacgggccaggcagcugaucugaagucuacccaggccgcgaucaaccagauuaaugguaaguugaaccgccucauagggaaaacaaacgagaaguuccaccagaucgaaaaggaguucagcgaaguugagggcaggauucaggaccuggaaaaauacguggaggauacuaagaucgacuuauggucauauaaugccgagcugcucguagcacuugaaaaccaacauaccaucgaucugacagacagugagaugaauaaauuguuugaaagaacuaagaaacagcuacgggagaacgcugaagauaugggaaauggcugcuucaagauuuaccacaagugugacaacgccugcauaggguccauccgaaaugagaccuaugaucaugacguguaccgcgacgaggcucugaacaauagauuucagauuaaaggagucgaacucaagagcgguuacaaagauuggauccuguggauuucuuucgccaucucaugcuuucuucuguguguggcauugcucggcuucauaaugugggccugccagaaggggaacaucagguguaauauuugcaucuga

SEQ ID NO: 124615 - RNA, 1701 nt, Artificial Sequence
  derived and/or modified sequence opt3 from hemagglutinin__InfluenzaA__ACO36584
augaagaccaucauugcccugagcuacauacucugccuuguguucucccagaaacugcccggcaacgacaauucuacagcuacuuuguguuuagggcaccaugcagucccuaacggaacgaucguuaagaccauuacaaaugaucaaaucgaggugacuaacgccaccgaacugguacagucaaguagcacagguggcauuugcgacuccccacaccagauccuagauggggagaauuguacccucauagacgcgcugcuuggagauccgcagugcgacggcuuucaaaacaaaaagugggaucuguucguggaaagaucuaaggcuuauucgaauuguuaccccuaugacgucccugauuacgccucauugaggagccucguggcaaguuccgguacucuggaguuuaacaaugaaucuuucaacuggacagggguuacccagaauggaacgagcuccgccugcaagcggcgcucaaacaauagcuuuuucagucgacugaacuggcucacucauuuaaaguuuaaauauccagcucugaaugugaccaugcccaacaacgagaaguucgacaaacuuuacaucuggggcguccaccauccuggcacagauaaugaccagauuucuuuguaugcacaggccuccgggcguaucacugugucaaccaagaaaagccaacagacaguaauuccaaacaucggaaguagacccaggguucgggauauaucuucccgcauuagcaucuacuggaccauugugaagccuggugacauccugcuaaucaauucgacgggcaaccucauugcuccaagaggguacuuuaagauaaggucuggaaaauccucaaucaugcggagugacgccccgauuggcaaguguaauagcgagugcaucacucccaacgguuccauaccuaaugauaaaccauuccagaacgucaaucgcauuacauauggggcguguccccgauacgugaagcagaacacccugaaacuugcaacuggaaugagaaaugugccugaaacacaaaccaggggcaucuuuggcgccaucgcuggguucauugagaacggaugggaagguauggucgacggcugguauggguuucggcaccaaaauucugagggaacgggccaggccgcagaucugaaaagcacccaggcugccaucaaccagauuaaugguaaauugaaccgucucauagggaagacaaacgagaaguuccaccagaucgaaaaagaguucucagaaguugagggccgcauucaggaccuggaaaaguacguggaggauacuaaaaucgacuuauggaguuauaaugcggagcugcucguagcccuugaaaaccaacauaccaucgaucugacagacuccgagaugaauaaguuguuugaaagaacuaaaaagcagcuaagggagaacgcagaagauaugggaaauggcugcuucaagauuuaccacaaaugugacaacgcuugcauagggagcauccggaaugagaccuaugaucaugacguguaccgagacgaggcccugaacaaucgcuuucagauuaagggagucgaacucaaaucugguuacaaggauuggauccuguggauuucauucgcuaucaguugcuuucuucuguguguggccuugcucggcuucauaaugugggcaugccagaaagggaacaucagauguaauauuugcaucuga

SEQ ID NO: 124616 - RNA, 1701 nt, Artificial Sequence; identical to SEQ ID NO: 122646
  derived and/or modified sequence opt3 from hemagglutinin__InfluenzaA__ACO36595

SEQ ID NO: 124617 - RNA, 1701 nt, Artificial Sequence
  derived and/or modified sequence opt3 from hemagglutinin__InfluenzaA__ACO36606
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaagaacgaauccuucaauuggacagggguuacccagaacggaacgucuagcgcuugcaagcggcgcuccaauaacucauuuuucagucgacugaauuggcucacucauuuaaaauuuaaguauccagcacugaacgugaccaugcccaauaacgagaaauucgacaagcuguacaucuggggcguccaccauccuggcacagauaacgaccagauuuuucuuuaugcccaggcuagcgggcguaucacugugucuacccaaagaucccagcagacaguaauuccaaauaucggaucaaggccccggguucgcaacauaccuagcagaauuaguaucuacuggaccauugugaaaccaggugauauccugcuaaucaauucuacgggcaaccucauugccccgaggggguacuucaagauacgguccggaaagagcucgaucaugcgcucugacgcgcccauuggcaaauguaauuccgagugcaucacuccuaacgguucaauaccaaaugacaagcccuuucagaacgucaaucgaauuacauauggggcauguccuagauacgugaaacaaaacacccugaaguuggccacuggaaugaggaaugugccagaaaaacagacacggggcaucuucggcgcuaucgccggguuuauugagaacggaugggaagguauggucgauggcugguauggguuccgucaccagaauagugagggaaucggccaagcagcugaccuuaagagcacccaggccgcgauuaaccagauaaaugguaaauugaaccgccucaucgggaagacgaacgagaaguuccaccagauugaaaaagaguuuuccgaaguugagggcagaauccaagaucuggaaaaguacguggaggacaccaaaaucgauuuauggucuuauaaugccgagcugcucguagcacuugaaaaccagcauacaauugaccugacugauagcgagaugaauaaguuguucgaaaggaccaaaaagcagcuacgggagaacgcugaagacaugggaaauggcugcuuuaagauauaccacaaaugugauaacgccugcaucgggucaauucgaaauggaacauaugaccaugauguguaccgcgacgaggcucugaacaauagauuccagaucaagggugucgagcucaaaaguggcuacaaggacuggauucuguggaucuccuuugccauaagcugcuuccuucuguguguggcauugcucggguuuaucaugugggccugccaaaaaggaaacauuagguguaauaucugcauuuga

SEQ ID NO: 124618 - RNA, 1701 nt, Artificial Sequence; identical to SEQ ID NO: 122646
  derived and/or modified sequence opt3 from hemagglutinin__InfluenzaA__ACO36617

SEQ ID NO: 124619 - RNA, 1701 nt, Artificial Sequence; identical to SEQ ID NO: 122646
  derived and/or modified sequence opt3 from hemagglutinin__InfluenzaA__ACO36628

SEQ ID NO: 124620 - RNA, 1701 nt, Artificial Sequence
  derived and/or modified sequence opt3 from hemagglutinin__InfluenzaA__ACO36639
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguacguggaggacaccaaaaucgauuuauggucuuauaacgccgagcugcucguagcacuugaaaaucaacauacaauugaccugacugauagcgagaugaacaaguuguucgaaaggaccaaaaagcagcuacgggagaaugcugaagacaugggaaacggcugcuuuaagauauaccacaaaugugauaaugccugcaucgggucaauucgaaacggaacauaugaccaugauguguaccgcgacgaggcucugaauaacagauuccagaucaagggugucgagcucaaaaguggcuacaaggacuggauucuguggaucuccuuugccauaagcugcuuccuucuguguuuugcauugcucggguucaucaugugggccugccagaaaggaaauauuagguguaacaucugcauuuga

SEQ ID NO: 124621 - RNA, 1701 nt, Artificial Sequence
  derived and/or modified sequence opt3 from hemagglutinin__InfluenzaA__ACO36661
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguacguggaggacaucaaaauugauuuauggucuuauaacgccgagcugcucguagcacuugaaaaucaacauaccauagaccugacagauagcgagaugaacaaguuguucgaaaggacuaaaaagcagcuacgggagaaugcugaagacaugggaaacggcugcuuuaagaucuaccacaaaugugauaaugccugcauugggucaauccgaaacggaaccuaugaccaugauguguaccgcgacgaggcucugaauaacagauuccagauuaagggugucgagcucaaaaguggcuacaaggacuggauccuguggauauccuuugccaucagcugcuuccuucuguguguggcauugcucggguuuauuaugugggccugccagaaaggaaauaucagguguaacauuugcaucuga

SEQ ID NO: 124622 - RNA, 1701 nt, Artificial Sequence; identical to SEQ ID NO: 122646
  derived and/or modified sequence opt3 from hemagglutinin__InfluenzaA__ACO36683

SEQ ID NO: 124623 - RNA, 1701 nt, Artificial Sequence; identical to SEQ ID NO: 124613
  derived and/or modified sequence opt3 from hemagglutinin__InfluenzaA__ACO37122

SEQ ID NO: 124624 - RNA, 1701 nt, Artificial Sequence
  derived and/or modified sequence opt3 from hemagglutinin__InfluenzaA__ACO94514
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggaaguccaacaauucauuuuucagucgccugaacuggcucacucauuuaaaguuuaaauauccagcacugaaugugaccaugcccaacaacgagcaguucgacaaacuuuacauuuggggaguccaccauccuggcacagauaaugaccagaucuuuuuguaugcccaagcuagcggccgaauuacugugucuaccaagcguucccagcagacaguaaucccaaacauagggucaagacccaggguucggaauauuccuagccgcaucaguauuuacuggaccaucgugaagccaggagauauccugcuaauuaacucuacggguaaucucauagccccgagaggcuacuucaaaaucagguccggaaagagcucgauuaugcggucugacgcgcccaucgggaaguguaacuccgaaugcauaacuccuaauggcucaauuccaaacgacaaacccuuucagaaugucaaccgcaucacauauggugcauguccucgauacgugaagcaaaauacccugaaacuugccacugggaugagaaacgugccagagaagcagacaaggggaaucuucggcgcuauugccggcuuuaucgaaaaugggugggagggaauggucgaugguugguauggcuuccggcaccagaacagugaggggcguggacaagcagcugaccugaaaagcacccaggccgcgauugaucagauaaauggcaaguugaaccgccucaucgguaaaacgaacgaaaaguuccaccagauugagaaggaauuuuccgagguugaagggagaauccaagaccuggagaaauacguggaggauaccaagaucgacuuauggucuuauaaugccgaacugcucguagcacuugagaaccagcauacaauugaucugacugacagcgaaaugaauaaauuguucgagaagaccaaaaagcagcuaagggaaaacgcugaggauaugggcaauggaugcuuuaagauauaccacaaaugugacaacgccugcaucggcucaauucggaaugggacauaugaucaugacguguaccgagacgaggcucugaacaaucgcuuccagaucaagggagucgaacucaaaagugguuacaaggauuggauucuguggaucuccuuugccauaagcugcuuccuucuguguguggcauugcucggcuuuaucaugugggccugccaaaaagggaacauuagauguaauaucugcauuuga

SEQ ID NO: 124625 - RNA, 1701 nt, Artificial Sequence
  derived and/or modified sequence opt3 from hemagglutinin__InfluenzaA__ACO94515
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggaaguccaacaauucauuuuucagucgccugaacuggcucacucauuuaaaguuuaaauauccagcacugaaugugaccaugcccaacaacgagcaguucgacaaacuuuacauuuggggaguccaccauccuggcacagauaaugaccagaucuuuuuguaugcccaagcuagcggccgaauuacugugucuaccaagcguucccagcagacaguaaucccaaacauagggucaagacccaggguucggaauauuccuagccgcaucaguauuuacuggaccaucgugaagccaggagauauccugcuaauuaacucuacggguaaucucauagccccgagaggcuacuucaaaaucagguccggaaagagcucgauuaugcggucugacgcgcccaucgggaaguguaacuccgaaugcauaacuccuaauggcucaauuccaaacgacaaacccuuucagaaugucaaccgcaucacauauggugcauguccucgauacgugaagcaaaauacccugaaacuugccacugggaugagaaacgugccagagaagcagacaaggggaaucuucggcgcuauugccggcuuuaucgaaaaugggugggagggaaugauggaugguugguauggcuuccggcaccagaacagugaggggcguggacaagcagcugaccugaaaagcacccaggccgcgauugaucagauaaauggcaaguugaaccgccucaucgguaaaacgaacgaaaaguuccaccagauugagaaggaauuuuccgaggucgaagggagaauccaagaccuggagaaauacguugaggauaccaagaucgacuuauggucuuauaaugccgaacugcucguggcacuugagaaccagcauacaauugaucugacugacagcgaaaugaauaaauuguucgagaagaccaaaaagcagcuaagggaaaacgcugaggauaugggcaauggaugcuuuaagauauaccacaaaugugacaacgccugcaucggcucaauucggaaugggacauaugaucaugacguauaccgagacgaggcucugaacaaucgcuuccagaucaagggaguggaacucaaaagugguuacaaggauuggauucuguggaucuccuuugccauaagcugcuuccuucugugugucgcauugcucggcuuuaucaugugggccugccaaaaagggaacauuagauguaauaucugcauuuga

SEQ ID NO: 124626 - RNA, 1701 nt, Artificial Sequence; identical to SEQ ID NO: 124450
  derived and/or modified sequence opt3 from hemagglutinin__InfluenzaA__ACO94516

SEQ ID NO: 124627 - RNA, 1701 nt, Artificial Sequence; identical to SEQ ID NO: 124450
  derived and/or modified sequence opt3 from hemagglutinin__InfluenzaA__ACO94672

SEQ ID NO: 124628 - RNA, 1701 nt, Artificial Sequence
  derived and/or modified sequence opt3 from hemagglutinin__InfluenzaA__ACO94683
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacaggugagauuugcgacuccccacaccaggugcuagauggcgaaaauuguacccucaucgacgcucugcuuggggauccgcagugcgacggauuccaaaacaaaaagugggaucuguuugucgagagaucuaaagccuauucgaauuguuaccccuaugacgugccugauuacgcaucauugaggagccucguugccaguuccggcacucuggaguucaacaaugaaucuuuuaacuggacaggugugacccagaaugggacgagcuccgcuugcauacggcgcucaaacaauaguuucuuuagccgacugaacuggcucacucauucuaaguucaaguauccagcauuaaaugucaccaugcccaacaacgaggaauuugacaaacuguacaucuggggagugcaccauccuggcacagauaaugaccagauuuuccuuuaugcccaggcuuccggccguaucacuguaucaaccaagagaagccaacagacaguuauuccaaacaucgggaguaggccccgggugcgcaauauaccuucuagaauuuccaucuacuggaccauugucaaaccaggagauaucuugcugaucaacagcacggguaaucuaauugccccgaggggcuacuuuaagauacggucggggaaaucuuccaucaugcgcucagacgcgcccauuggaaaguguaacagugagugcaucacuccuaauggcagcauaccaaacgacaagcccuuccagaaugugaaccgaauuacauauggugcauguccuagauacgugaaacagaauacccucaagcuggccacugggaugaggaacgucccagaaaaacaaacacggggaaucuuuggcgcuaucgccggcuucauugagaaugggugggagggaaugguugaugguugguauggcuuucgucaccagaacuccgaagggaucggacaggcagcugaccuuaagucuacccaagccgcgauugaucagauaaauggcaaacugaaccgcuugaucgguaagacgaacgagaaauuccaccagauugaaaaggaguucaccgaaguggaggggagaauccaggaccucgagaaguacguagaagauacaaaaaucgaccuguggagcuauaaugccgaguuacugguggcacucgaaaaccaacauacuauugaucuuaccgacucagagaugaauaagcuguuugagaaaacaaagaaacaguugagggaaaacgcugaggauaugggcaauggaugcuucaagauauaccacaagugugacaacgccugcaucggcaguauucggaaugggacuuaugaucaugaagucuaccgagacgaggcucuaaacaaucgcuuucagaucaaaggaguggaacugaaguccgguuacaaagacuggauucucuggaucagcuucgccauaucuugcuuucugcuuuguguugcacuguugggcuucaucaugugggccugccagaaggggaacauuagauguaauaucugcauuuga

SEQ ID NO: 124629 - RNA, 1701 nt, Artificial Sequence; identical to SEQ ID NO: 124450
  derived and/or modified sequence opt3 from hemagglutinin__InfluenzaA__ACO94694

SEQ ID NO: 124630 - RNA, 1698 nt, Artificial Sequence; identical to SEQ ID NO: 124504
  derived and/or modified sequence opt3 from hemagglutinin__InfluenzaA__ACO94705

SEQ ID NO: 124631 - RNA, 1701 nt, Artificial Sequence
  derived and/or modified sequence opt3 from hemagglutinin__InfluenzaA__ACO94727
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugaagucugacgcgcccaucggaaaguguaacuccgaaugcauaacuccuaauggcucaauuccaaacgacaaacccuuucagaaugucaaccgcaucacauauggugcauguccucgauacgugaagcaaaauacccugaaacuugccacugggaugagaaacgugccagagaagcagacaaggggaaucuucggcgcuauugccggcuuuaucgaaaaugggugggagggaauggucgaugguugguauggcuuccggcaccagaacagugaggggcguggacaagcagcugaccugaaaagcacccaggccgcgauugaucagauaaauggcaaguugaaccgccucaucgguaaaacgaacgaaaaguuccaccagauugagaaggaauuuuccgagguugaagggagaauccaagaccuggagaaauacguggaggauaccaagaucgacuuauggucuuauaaugccgaacugcucguagcacuugagaaccagcauacaauugaucugacugacagcgaaaugaauaaauuguucgagaagaccaaaaagcagcuaagggaaaacgcugaggauaugggcaauggaugcuuuaagauauaccacaaaugugacaacgccugcaucggcucaauucggaaugggacauaugaucaugacguguaccgagacgaggcucugaacaaucgcuuccagaucaagggagucgaacucaaaagugguuacaaggauuggauucuguggaucuccuuugccauaagcugccuucuguuguguguggcacuccugggcuucaucaugugggccugccaaaaagggaacauuagauguaauaucugcauuuga

SEQ ID NO: 124632 - RNA, 1701 nt, Artificial Sequence
  derived and/or modified sequence opt3 from hemagglutinin__InfluenzaA__ACO94738
augaagaccaucauugcccugagcuacauacagugccucguguucgcucaaaaauuucccggcaacgacaauuccacagcaacucuuugucuggggcaccaugccgucccuaacggaacgguugugaagaccaucacaaaugaucagauugagguaacuaacgcgaccgaauuggugcagucuucaaguacaggugagaucugcgacagcccacaccagauuuuagauggcgaaaauuguacccugaucgacgcucuacucggggauccgcaaugcgacggauuccagaacaaaaauugggaucuguuugucgagagauccaaggccuauucuaacuguuaccccuaugacgugccugauuacgcaucgcuuaggucacugguugccagcaguggcacuuuggaguucaauaacgaauccuuuaauuggacaggugugacccagaacgggacgucuagcgcuugcauacggcgcuccaauaacucauucuuuagucgacucaauuggcugacucauagcaaauucaaguauccagcacugaacgucaccaugcccaacaaugagaacuuugacaagcucuacaucuggggagugcaccauccuggcacagauaaugaccagauuuucuuauaugcccgugcuucuggcagaaucacuguauccaccaaaaggucacaacagacaguuauuccaaacaucgggagccggccccgcgugagaaauauaccuaguaggauuucuaucuacuggaccauugucaagccaggagauauccugcuuaucaacuccacggguaauuugauugccccgcggggcuacuuuaaaauacgcagcgggaagucgucuaucaugcgauccgacgcgcccauuggaaaauguaacucagaaugcaucacuccuaauggcaguauaccaaacgacaagcccuuccagaaugugaacagaauuacauauggugcauguccuagguacgugaagcagaauacccugaaacuagccacugggaugcggaacgucccagagaagcaaacacguggaaucuuuggcgcuaucgccggcuucauugaaaaugggugggagggaaugguugaugguugguauggcuuccgccaccagaacagcgaggggaucggacaggcagcugaccucaaauccacccaagccgcgauugaucagauaaacggcaagcugaauagacuuaucgguaaaacgaacgaaaaguuucaccagauugagaaagaguucucugaaguggaagggaggauccaggaccuggagaaguacguagaggauaccaagaucgacuuguggagcuauaaugccgaacuccugguggcauuagagaaccaacauacaauugaucugacugacucagaaaugaauaaacucuuugagaagaccaaaaagcagcuucgggaaaacgcugaggauaugggcaauggaugcuucaaaauauaccacaagugugacaacgccugcaucggcaguauucgaaaugggacauaugaucaugacgucuaccgcgacgaggcucugaacaauagauuucagaucaagggaguggaauugaaauccgguuacaaggauuggauucuauggaucagcuucgccauaucuugcuuucugcucuguaucgcacugcuuggcuucauuaugugggccugccagaaagggaacaucagguguaauauuugcaucuga

SEQ ID NO: 124633 - RNA, 1701 nt, Artificial Sequence; identical to SEQ ID NO: 124553
  derived and/or modified sequence opt3 from hemagglutinin__InfluenzaA__ACO94760

SEQ ID NO: 124634 - RNA, 1701 nt, Artificial Sequence
  derived and/or modified sequence opt3 from hemagglutinin__InfluenzaA__ACO94771
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucaugacguguaccgcgacgaggcucugaacaauagauuccagaucaaaggagucgaacucaagagugguuacaaagauuggauucuguggaucuccuuugccauaagcugccuucuguuguguguggcacuccugggcuucaucaugugggccugccaaaaggggaacauuagguguaauaucugcauuuga

SEQ ID NO: 124635 - RNA, 1701 nt, Artificial Sequence; identical to SEQ ID NO: 124450
  derived and/or modified sequence opt3 from hemagglutinin__InfluenzaA__ACO94782

SEQ ID NO: 124636 - RNA, 1701 nt, Artificial Sequence; identical to SEQ ID NO: 124450
  derived and/or modified sequence opt3 from hemagglutinin__InfluenzaA__ACO94793

SEQ ID NO: 124637 - RNA, 1698 nt, Artificial Sequence
  derived and/or modified sequence opt3 from hemagglutinin__InfluenzaA__ACO94804
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacuacaaccggugucucugccagcugcucccauaacggggaaucaaguuuuuauaagaauuuacuguggcuuacgggaaagaacggcuuguaccccaaucugagcaagucuuaugcaaacaauaaagagaaggaagugcuaguacucuggggcguucaccacccuccaaacaucgggaaccagcgcgcccuguaccauacugagaaugcuuacguguccgucgugucaagccacuauagucgaaaauucacccccgaaauagcaaagcguccuaaggugagagaucaggagggaaggaucaacuacuauuggacacuucuggagccaggugacacuauuaucuuugaagccaauggcaacuugauugcuccgcgguacgccuucgcgcucucucgcggguuuggauccggcaucauaaauagcaacgcacccauggaugguugugacgccaaaugccagaccccucaaggggcuauuaauucgucucugccauuccagaacguccaucccguuacaaucggagaguguccuaaguaugugagauccgccaaauuaaggaugguaaccggccugcggaauauuccaucaauccagagucgcggccucuuuggggcaaucgcuggauucauugaagguggcuggacggggaugguggauggaugguacggcuaucaccaccagaacgagcaagguagcggguacgccgcggaccagaaguccacucagaaugccauaaacggcaucacaaauaaagucaacucugugauugaaaagaugaauacccaguuuacugcaguuggaaaagaguucaacaaacuugagcgaagaauggaaaaccugaauaagaaaguggaugacggcuucaucgauauauggacauacaacgcugaguugcuaguccugcucgaaaaugagaggacccuggacuuucaugacagcuaugugaagaaccuuuacgaaaaaguaaagucacaacugaaaaauaacgccaaggagauugggaauggaugcuucgaguuuuaucacaaguguaacgaugaaugcauggagaguguuaaaaaugguacguacgacuaucccaaguacuccgaagagagcaaauugaaccgggagaagaucgauggcgugaaacucgaaucuaugggggucuaucagauccuggcuauuuacucaaccguggccaguagcuuaguccugcuagugucccucggagcaaucucuuucuggaugugcucgaauggcagccugcagugucguauuugcauauga

SEQ ID NO: 124638 - RNA, 1701 nt, Artificial Sequence; identical to SEQ ID NO: 124317
  derived and/or modified sequence opt3 from hemagglutinin__InfluenzaA__ACO94815

SEQ ID NO: 124639 - RNA, 1701 nt, Artificial Sequence; identical to SEQ ID NO: 124324
  derived and/or modified sequence opt3 from hemagglutinin__InfluenzaA__ACO94848

SEQ ID NO: 124640 - RNA, 1698 nt, Artificial Sequence; identical to SEQ ID NO: 124504
  derived and/or modified sequence opt3 from hemagglutinin__InfluenzaA__ACO94859

SEQ ID NO: 124641 - RNA, 1698 nt, Artificial Sequence
  derived and/or modified sequence opt3 from hemagglutinin__InfluenzaA__ACO94870
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccgggaaaaauggcuuguaccccaaccugagcaagucuuaugcaaauaacaaaggcaaggagguucuaguacucuggggagugcaccacccuccaaacaucggagaccagaauacgcuguaccauacugaaaacgccuacgucuccguggugucaagccacuauagucgcaaauucacccccgagauagcuaagcgaccuaagguccgugaucaggaagguagaaucaauuacuauuggacacuucuggagccaggcgacacuauuaucuuugaggcaaacgggaauuugauugccccgagguacgcuuucgcccucaaccggggauuuggcucugguaucauaaauuccaacgcgcccauggauaaaugugacgcaaagugccagaccccucaaggggccauuaauagcucgcugccauuccagaacguucaucccgugacaaucggagaauguccuaaauauguacgcucugcuaaguuaagaauggugaccggccugaggaauauuccauccauccagucacggggccucuuuggggccaucgcaggauucauugaggguggcuggacggggauggucgauggaugguacggcuaucaccaccagaacgaacaagguaguggguacgcugccgaccagaaaagcacucagaaugcgauaaacggcaucacaaauaaggugaacuccguuauugagaaaaugaacacccaguuuacugccgugggaaaggaguucaauaaacuugaacgccgaauggagaaccugaauaaaaaggucgaugacggcuucaucgauauauggacauacaacgcagaauugcuagugcugcucgagaaugaaagaacccuggacuuucaugacucuaacguaaagaaucuuuaugagaagguuaaaagccaacugaagaacaaugcuaaggaaauugggaacggaugcuucgaguuuuaccacaaauguaaugaugagugcauggaaucagugaagaacgguacguaugacuaccccaaauauagugaggaauccaaguugaauagggagaaaaucgauggcgucaagcucgagagcauggggguguaccagauccuggccauuuauucuaccgucgcuucaaguuuagugcugcuaguuagccucggagccaucuccuucuggaugugcucuaacggcucgcugcagugucggauuugcauauga

SEQ ID NO: 124642 - RNA, 1701 nt, Artificial Sequence
  derived and/or modified sequence opt3 from hemagglutinin__InfluenzaA__ACO94881
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcuccugcaagcggcgcucaaauaacagcuuuuucagucgacugaauuggcucacucauuuaaaguauaaauacccagcucugaacgugaccaugcccaauaacgagaaguuugauaaacuuuauaucuggggcguccaccauccuggcacagacucugaucagauuuccuuguacgcacaggccucagggcguaucacugugagcaccaagagaagucaacagacaguaauuccaaacaucggaucuaggccccggguucgcgacguguccagcagaauaucgauuuacuggaccaucgucaaaccuggugacauucugcuaaucaauucuacgggcaaccucaucgcuccaaggggguauuucaagauucgguccggaaagucaaguauaaugcgcagcgaugccccgaucggcaaauguaauuccgagugcauuacucccaacgguucuaucccuaaugacaagccauuucagaacgugaaucgaauaacauacggggcgugucccagauaugugaaacagaacacccugaaacuugcaacuggaaugaggaaugucccugaaaaacaaacacggggcauuuucggcgccaucgcuggguuuaucgagaacggaugggaagguaugguugauggcugguacggguuccgucaccagaauagcgagggaaccggccaggccgcagaccugaagucaacgcaagcugccauuaaccagaucaaugguaaauugaaccgccucauugggaagaccaaugagaaguuucaccagauagaaaaagaguucagugaaguggagggcagaauccaggaucuggaaaaguauguagaggacacaaaaauugauuuaugguccuacaacgcggagcugcucguggcccuugaaaaccaacauacuaucgaccugaccgauagcgagaugaauaaguuguucgaaaggacaaagaagcagcuacgggagaacgcagaagacaugggaaauggcugcuuuaagaucuaucaccgaugugauaacgcuugcauugggucuauacgcaauggaacuuacgaccaugacgucuacagagaugaggcccugaacaauagguuccagaucaaagguguggagcucaagucaggcuauaaagacuggauucuguggaucaguuuugcuauuagcugcuuccuucuguguguugccuugcucggguuuaucaugugggcaugccagaagggaaacauacgguguaauaucugcauuuga

SEQ ID NO: 124643 - RNA, 1701 nt, Artificial Sequence
  derived and/or modified sequence opt3 from hemagglutinin__InfluenzaA__ACO94892
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugccagcggcgcuccaacaagucauuuuucagucgacugaauuggcucacucauuuaaaguuuaaauauccagcacugaacgugaccaugcccaauaacgagaaguucgacaaacuuuacaucuggggcguccaccauccuggcacagauaacgaccagauuagcuuguaugcccaaacuucugggcguaucaccauuuccacaaagagaucacagcagaccgugaucccaaauauaggaagcaggccccggguacgcgauguuccuaguagaauuucuaucuacuggacgauugugaaaccaggugacauccugcuaaucaacuccacuggcaaucucauugcuccgaggggguacuuuaagauacggagcggaaagucgucuaucaugcgcuccgacgcccccauugucaaauguaacucagagugcaucacaccuaauggcaguauaccaaacgauaagcccuuccagaaugugaaccgaauuaccuauggugcguguccuagauacgugaaacaaaauacucugaaacuugcaacagggaugaggaacgucccagaacggcagacccguggaaucuuuggcgccaucgcuggcuucauugagaaugggugggaaggaaugguugacgguugguauggcuuucgccaccagaacagcgaggggacgggacaagccgcagaucugaaguccacccaggcugccaucaaucagauuaacggcaaguugaauagacucauagguaaaacaaacgagaaguuccaccagaucgaaaaggaguucucugaaguggaggggaggauucaagaccuggaaaaauacguagaggauacuaagaucgacuuauggagcuauaacgcggagcugcucguggcccuugaaaaucagcauaccaucgaucugacagacucagagaugaacaaauuguuugaacggacuaagaaacagcuacgagagaaugcagaagauaugggcaacggaugcuucaagauuuaccacaagugugacaaugcuugcauaggcaguauccgcaacgggaccuaugaucaugacgucuacagagacgaggcccugaauaacagguuucagauuaaaggaguggagcucaaguccgguuacaaagauuggauccuguggauuagcuucgcuaucucuugcuuucuucuguguguugccuugcucggcuucauaaugugggcaugccaaaaggggaauauccgguguaacauuugcaucuga

SEQ ID NO: 124644 - RNA, 1701 nt, Artificial Sequence
  derived and/or modified sequence opt3 from hemagglutinin__InfluenzaA__ACO94903
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccgaggccuauucuaauuguuaccccuaugacgucccugauuacgcaucguugaggucacucguggccagcagugguacucuggaauuuaacaaugaguccuucaacuggacagggguuacccagaauggaacgucuagcgcuugcaaacggcgcuccaacaagucauuuuucagucgacugaauuggcucacucauuuaaaguuuaaauauccagcacugaacgugaccaugcccaauaacgagaaguucgacaaacuuuacaucuggggcguccaccauccuggcacagauaacgaccagauuagcuuguaugcccaggcuucugggcguaucacuguguccaccaagagaucacaacagacaguaauuccaaauaucggaagcaggccccggguucgcgaugugccuaguagaauaucuauuuacuggaccaucgucaaaccaggugacauucugcuaaucaacuccacgggcaaucucaucgccccgaggggguacuuuaagauucggagcggaaagucgucuauaaugcgcuccgacgcgcccaucggcaaauguaacucagaaugcauuacuccuaaugguaguaucccaaacgauaagcccuuccagaaugugaaccgaauaacauauggggcauguccuagauacgugaaacagaauacccugaaacuugccacuggaaugaggaacgucccagagaaacaaacacggggcauuuuuggcgcuaucgccggguucaucgaaaauggaugggaggguaugguugacggcugguauggguuucgucaccagaacagcgagggaaccggccaggcagcugaucugaaguccacgcaagccgcgauuaaucagaucaacgguaaauugaaucgccucauugggaagaccaacgaaaaguuccaccagauagagaaagaguucucugaaguggaaggcagaauccaggaccuggagaaguacguagaggauacaaaaauugacuuauggagcuauaacgccgaacugcucguggcacuugagaaucaacauacuaucgaucugaccgacucagaaaugaacaaguuguuugagaggacaaagaagcagcuacgggaaaaugcugaggauaugggaaacggcugcuucaagaucuaccacaaaugugacaaugccugcauugggaguauacgaaacggaacuuaugaucaugacgucuaccgcgacgaggcucugaauaacagauuucagaucaaggguguggaacucaaauccggcuacaaggauuggauucuguggaucagcuucgccauuucuugcuuucuucuguguguugcauugcucggguucaucaugugggccugccagaaaggaaauauaagguguaacaucugcauuuga

SEQ ID NO: 124645 - RNA, 1701 nt, Artificial Sequence
  derived and/or modified sequence opt3 from hemagglutinin__InfluenzaA__ACO94925
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcagucuucaaguacagguggcaucugcgacagcccacaccagauucuagauggggagaauuguacccucaucgacgcucugcuuggagauccgcagugcgacggcuuucaaaacaaaaagugggaucuguucgucgaaagauccaaagccuauucuaauuguuaccccuaugacgugccugauuacgcaucguugaggucacucguugccagcagugguacucuggaguuuaacaaugaauccuucaacuggacaggggugacccagaauggaacgucuagcgcuugcaagcggcgcuccaacaagucauuuuucagucgacugaauuggcucacucauuuaaaauuuaaguauccagcacugaacgucaccaugcccaauaacgagaaauucgacaaacuuuacauauggggcgugcaccauccuggcacagauaacgaccagaucagcuuguaugcccaggcuucugggcguauuacuguauccaccaagagaucacaacagacaguuaucccaaauauuggaagcaggccccgggugcgcgaugucccuaguagaaucucuauauacuggaccauugugaagccaggugacauccugcuaauuaacuccacgggcaaucucaucgccccgaggggguacuuuaagauccggagcggaaaaucgucuauuaugcgcuccgacgcgcccauaggcaaguguaacucagagugcaucacuccuaaugguaguauuccaaacgauaaacccuuccagaaugugaaccgaaucacauauggggcauguccuagauacgucaagcagaauacccugaaacuugccacuggaaugaggaacguuccagaaaagcaaacacggggcauauuuggcgcuauugccggguucaucgagaauggaugggaagguaugguggacggcugguauggguuucgucaccagaacagcgagggaaccggccaggcagcugaucugaaauccacgcaagccgcgaucaaucagauuaacgguaaguugaaucgccucaucgggaagaccaacgagaaauuccaccagauugaaaaggaguucucugaaguagagggcagaauacaggaccuggaaaaauacguggaggauacaaagaucgacuuauggagcuauaacgccgagcugcucgucgcacuugaaaaucaacauacuauugaucugaccgacucagagaugaacaaauuguuugaaaggacaaagaagcagcuacgggagaaugcugaagauaugggaaacggcugcuucaaaaucuaccacaagugugacaaugccugcaucgggaguauucgaaacggaacuuaugaucaugacguguaccgcgacgaggcucugaauaacagauuucagauaaaagguguugagcucaaguccggcuacaaagauuggauccuguggauuagcuucgccaucucuugcuuucuucuguguguggcauugcucggguucauuaugugggccugccagaagggaaauaucagguguaacauaugcaucuga

SEQ ID NO: 124646 - RNA, 1701 nt, Artificial Sequence
  derived and/or modified sequence opt3 from hemagglutinin__InfluenzaA__ACO94936
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggaggacuguacccucauagaugcucugcuuggagacccgcagugcgauggcuuucaaaauaaaaagugggaccuguucguggaaagauccaaagccuauucuaacuguuaccccuaugaugucccugacuacgcaucguugaggucacucguggccagcagugguacucuggaguuuaauaacgaauccuucgauuggacagggguuacccagaauggaacgucuagcuccugcaagcggcgcucaaacaauagcuuuuucagucgacugaacuggcucacucauuuaaaguauaaauacccagcucugaaugugaccaugcccaacaaugagaaguuugacaaacuuuauaucuggggcguccaccauccuggcacagauucugaccagauuuccuuguacgcacaggccucagggcguaucacugugagcaccaagagaagucaacagacaguaauuccaaacaucggaucuaggccccggguucgcgacguguccagcagaauaucgauuuacuggaccaucgucaaaccuggugauauucugcuaaucaacucuacgggcaaucucaucgcuccaaggggguauuucaagauucgguccggaaagucaaguauaaugcgcagcgacgccccgaucggcaaauguaacuccgagugcauuacucccaaugguucuaucccuaacgauaagccauuucagaaugugaaccgaauaacauacggggcgugucccagauaugugaaacagaauacccugaaacuugcaacuggaaugaggaacgucccugaaaaacaaacacggggcauuuucggcgccaucgcuggguuuaucgagaauggaugggaagguaugguugacggcugguacggguuccgucaccagaacagcgagggaaccggccaggccgcagaucugaagucaacgcaagcugccauuaaucagaucaacgguaaauugaaucgccucauugggaagaccaacgagaaguuucaccagauagaaaaagaguucagugaaguggagggcagaauccaggaccuggaaaaguauguagaggauacaaaaauugacuuaugguccuacaaugcggagcugcucguggcccuugaaaaccaacauacuaucgaucugaccgacagcgagaugaacaaguuguucgaaaggacaaagaagcagcuacgggagaaugcagaagauaugggaaacggcugcuuuaagaucuaucacaaaugugacaaugcuugcauugggucuauacgaaacggaacuuacgaccaugaugucuaccgcgacgaggcccugaauaacagauuccagaucaaggguguggagcucaaaucaggcuauaaggauuggauucuguggaucaguuuugcuauuagcugcuuccuucuguguguugccuugcucggguuuaucaugugggcaugccagaaaggaaauauaagguguaacaucugcauuuga

SEQ ID NO: 124647 - RNA, 1701 nt, Artificial Sequence
  derived and/or modified sequence opt3 from hemagglutinin__InfluenzaA__ACO94947
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuagcuuguaugcccaggcuucugggcguaucacuguguccaccaaaagaucacaacagacaguaauuccaaauaucggaagcaggccccggguucgcgaugugccuaguagaauaucuauuuacuggaccaucgucaagccaggugacauucugcuaaucaacuccacgggcaaucucaucgccccgaggggguacuuucggauucgcagcggaaagucgucuauaaugcgauccgacgcgcccaucggcaaauguaacucagagugcauuacuccuaaugguaguaucccaaacgauaagcccuuccagaaugugaacagaauaacauauggggcauguccuagguacgugaaacagaauacccugaaacuugccacuggaaugcggaacgucccagaaaagcaaacacguggcauuuuuggcgcuaucgccggguucaucgagaauggaugggaagguaugguugacggcugguauggguuucgccaccagaacagcgagggaaccggccaggcagcugaucugaaguccacgcaagccgcgauuaaucagaucaacgguaaauugaauagacucauugggaagaccaacgagaaguuccaccagauagaaaaagaguucucugaaguggagggcaggauccaggaccuggaaaaguacguagaggauacaaaaauugacuuauggagcuauaacgccgagcugcucguggcacuugaaaaucaacauacuaucgaucugaccgacucagagaugaacaaguuguuugaacggacaaagaagcagcuacgagagaaugcugaagauaugggaaacggcugcuucaagaucuaccacaaaugugacaaugccugcauugggaguauacgcaacggaacuuaugaucaugacgucuacagagacgaggcucugaauaacagguuucagaucaaggguguggagcucaaauccggcuacaaggauuggauucuguggaucagcuucgccauuucuugcuuucuucuguguguugcauugcucggguucaucaugugggccugccagaaaggaaauauacgguguaacaucugcauuuga

SEQ ID NO: 124648 - RNA, 1701 nt, Artificial Sequence
  derived and/or modified sequence opt3 from hemagglutinin__InfluenzaA__ACO95153
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaauuucgacaaacuuuacaucuggggcguccaccauccuggcacagauaacgaccagauuagcuuguaugcccaggcuucugggcguaucacuguguccaccaagagaucacaacagacaguaauuccaaauaucggaagcaggccccggguucgcgauauaaguucuagaauuuccaucuacuggaccauugugaagccuggugacauccugcuaaucaacagcacgggcaaucucauugccccaaggggguacuuuaaaauacggucgggaaagucuuccaucaugcgcucagacgcgccgauuggcaaguguaacagugagugcaucacucccaaugguagcauaccuaacgauaaaccauuccagaaugucaaccgaauuacauauggggcaugucccagauacgugaagcagaauacccugaaacuugccacuggaaugaggaacgugccugaaacacaaacccggggcaucuuuggcgcuaucgccggguucauugagaauggaugggaagguauggucgacggcugguauggguuucgucaccagaacuccgagggaacgggccaggcagcugaucugaagucuacccaagccgcgaucaaucagauuaacgguaaauugaaccgccucauagggaagacaaaugagaaauuccaccagaucgaaaaggaguucagcgaaguugagggcaggauucaggaccuggaaaaguacguggaggauacuaaaaucgacuuauggucauauaacgccgagcugcucguagcacuugaaaaucaacauaccaucgaucugacagacagugagaugaacaaguuguuugaaagaacuaaaaagcagcuacgggagaaugcugaagauaugggaaacggcugcuucaaaauuuaccacaagugugacaaugccugcauaggguccauccgaaacggaaccuaugaucaugacguguaccgcgacgaggcucugaauaacagauuucagauuaagggugucgagcucaaaagcggcuacaaggauuggauccuguggauuucuuucgccaucucaugcuuucuucuguguguggcauugcucggguucauaaugugggccugccagaaaggaaauaucagguguaacauuugcaucuga

SEQ ID NO: 124649 - RNA, 1701 nt, Artificial Sequence; identical to SEQ ID NO: 124614
  derived and/or modified sequence opt3 from hemagglutinin__InfluenzaA__ACO95171

SEQ ID NO: 124650 - RNA, 1701 nt, Artificial Sequence
  derived and/or modified sequence opt3 from hemagglutinin__InfluenzaA__ACO95193
augaagaccaucauugcccugagcuacauacucugccuuguguucgcucagaaacugcccggcaacgacaaguccacagcaacuuuguguuuagggcaccaugccgucccuaauggaacgaucguuaaaaccauuacaaacgaucaaaucgaggugacuaaugcgaccgaacugguacagucuucaaguacagguggcauuugcgacagcccacaccagauccuagauggggagaacuguacccucauagacgcucugcuuggagauccgcagugcgacggcuuucaaaauaagaaaugggaucuguucguggaaagauccaaggccuauucuaacuguuaccccuaugacgucccugauuacgcaucguugaggucacucguggccagcagugguacucuggaguuuaauaacgaaaauuucaacuggacagggguuacccagaauggaacguccucugcuugcaagcggcgcagcaacaauuccuuuuucucacgacugaacuggcucacucauuuaaaauuuaaguauccagcacugaaugugaccaugcccaacaacgagaaauucgacaaacuuuacaucuggggcguccaccauccuggcacagauaaugaccagauuaguuuguaugcccaggcuagcgggcguaucacugugucuaccaagagaucccaacagacaguaauuccaaacaucggaucaaggccccggguucgcgauauaagcaguagaauuucuaucuacuggaccauugugaagccuggugacauccugcuaaucaauuccacgggcaaccucauugccccaaggggguacuuuaagauacggagcggaaaaucgucuaucaugcgcuccgacgcgccgauuggcaaguguucaagugagugcaucacucccaaugguagcauaccuaacgauaaaccauuccagaaugucaaccgaauuacauauggggcaugucccagauacgugaagcagaauacccugaaacuugccacuggaaugaggaacgugccugaaacacaaacccggggcaucuuuggcgcuaucgccggguucauugagaauggaugggaagguauggucgacggcugguauggguuucgucaccagaacuccgagggaacgggccaggcagcugaucugaagucuacccaagccgcgaucaaucagauuaacgguaaauugaaucgccucauagggaagacaaacgagaaguuccaccagaucgaaaaagaguucagcgaaguugagggcaggauucaggaccuggaaaaguacguggaggauacuaaaaucgacuuauggucauauaacgccgagcugcucguagcacuugaaaaucaacauaccaucgaucugacagacagugagaugaacaaguuguuugaaagaacuaaaaagcagcuacgggagaaugcugaagauaugggaaacggcugcuucaagauuuaccacaaaugugacaaugccugcauaggguccauccgaaacggaaccuaugaucaugacguguaccgcgacgaggcucugaauaacagauuucagauuaagggugucgagcucaaaagcggcuacaaggauuggauccuguggauuucuuucgccaucucaugcuuucuucuguguguggcauugcucggguucauaaugugggccugccagaaaggaaauaucagguguaacauuugcaucuga

SEQ ID NO: 124651 - RNA, 1701 nt, Artificial Sequence; identical to SEQ ID NO: 124613
  derived and/or modified sequence opt3 from hemagglutinin__InfluenzaA__ACO95204

SEQ ID NO: 124652 - RNA, 1701 nt, Artificial Sequence
  derived and/or modified sequence opt3 from hemagglutinin__InfluenzaA__ACO95215
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagauaaugaccagaucagcuuguaugcccaggcuucugggcguauuacugucuccaccaagagaucacaacagacagugaucccaaacauaggaagcaggccccggguacgcgauauuaguucuagaaucuccauuuacuggaccaucguuaaaccuggugacauccugcuaauuaauagcacgggcaaccucauagccccaaggggguacuuuaagauccggucgggaaagucuuccauuaugcgcucagacgcgccgaucggcaaauguaauagugagugcauaacucccaacgguagcauuccuaaugauaagccauuccagaacgugaaucgaaucacauauggggcaugucccagauacgucaaacagaacacccugaaacuugccacuggaaugaggaaugugccugaaacacaaacccggggcaucuuuggcgcuauugccggguucaucgagaacggaugggaagguaugguggacggcugguauggguuucgucaccaaaauuccgagggaacgggccaggcagcugaucugaagucuacccaggccgcgauuaaccagauaaaugguaaguugaaccgccucaucgggaaaacaaacgagaaguuccaccagauugaaaaggaguucagcgaagucgagggcagaauccaggaccuggaaaaauacguugaggauacuaagaucgacuuauggucauauaaugccgagcugcucguggcacuugaaaaccaacauaccauugaucugacagacagugagaugaauaaauuguuugaaaggacuaagaaacagcuacgggagaacgcugaagauaugggaaauggcugcuucaagauauaccacaagugugacaacgccugcaucggguccauucgaaaugagaccuaugaucaugacguauaccgcgacgaggcucugaacaauagauuucagaucaaaagcguggaacucaagucuggauacaaagauuggauucuguggaucucauucgccauaaguugcuuucuucugugugucgcauugcucgguuucaucaugugggccugccagaagggcaacauuagguguaauaucugcauuuga

SEQ ID NO: 124653 - RNA, 1701 nt, Artificial Sequence; identical to SEQ ID NO: 122297
  derived and/or modified sequence opt3 from hemagglutinin__InfluenzaA__ACO95226

SEQ ID NO: 124654 - RNA, 1701 nt, Artificial Sequence; identical to SEQ ID NO: 122646
  derived and/or modified sequence opt3 from hemagglutinin__InfluenzaA__ACO95248

SEQ ID NO: 124655 - RNA, 1701 nt, Artificial Sequence
  derived and/or modified sequence opt3 from hemagglutinin__InfluenzaA__ACO95270
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcauccggcgcuccaacaauucauuuuucagucgacugaacuggcucacccauuuaaaguuuaaguauccagcucugaaugugacaaugcccaacaacgagaaauucgacaaacuuuacauuuggggaguccaccauccugugacugauaauaaccagaucuuuuuguaugcacaggccagcggccguauuaccguaucuacaaaaagaucccaacagaccguuaucccaaauauaggcucaaggccccgggugcgcaacauuccuagcagaaucaguauuuacuggacgaucgucaagccaggggacauccugcuaauuaauucuacuggaaaccucauagcuccgagggguuacuucaaaauccgguccggcaagagcucgauuaugcgcucugaugcccccaucgggaaguguaauuccgaaugcauaacaccuaacggaucaauuccaaaugacaaacccuuucagaacgugaaucgaaucaccuauggcgcguguccuagauacgugaagcagaacacucugaaacuugcaacagguaugaggaaugucccagagaagcaaacccgggggaucuucggagccauugcuggcuuuaucgaaaacggcugggaggggaugguugacggaugguaugguuuccgucaccagaauagugagggcauugggcaggccgcagaucugaaaagcacgcaagcugccauagaccagaucaacggaaaguugaaccgccucauuggcaaaaccaaugaaaaguuccaccagaucgagaaggaauuuuccgagguggaagguagaauccaggaucuggagaaauacguagaggacacaaagauugauuuauggucuuauaacgcggaacugcucguggcccuugagaaucaacauacuauagaccugaccgauagcgaaaugaacaaauuguucgagaagacuaaaaagcagcuaagggaaaaugcagaggacauggggaacggcugcuuuaagaucuaccacaaaugugauaaugcuugcauuggaucaauccggaacggcacauaugaccaugaugucuaccgagacgaggcccugaauaaccgcuuccagauuaaggggguggaacucaaaaguggauacaaggacuggauccuguggauauccuuugcuaucagcugcuuccuucuguguguugccuugcucgguuuuauuaugugggcaugccagaaaggcaauaucagauguaacauuugcaucuga

SEQ ID NO: 124656 - RNA, 1701 nt, Artificial Sequence; identical to SEQ ID NO: 124450
  derived and/or modified sequence opt3 from hemagglutinin__InfluenzaA__ACO95281

SEQ ID NO: 124657 - RNA, 1701 nt, Artificial Sequence
  derived and/or modified sequence opt3 from hemagglutinin__InfluenzaA__ACO95292
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccaguccgggaaaagcucgauuaugcggucugacgcgcccaucggaaaguguaacuccgaaugcauaacuccuaauggcucaauuccaaacgacaagcccuuucaaaaugucaaccgcaucacauauggugcauguccucgauacgugaaacagaauacccugaagcuggccacugggaugagaaacgugccagagaaacagacaaggggaaucuucggcgcuauugccggcuuuaucgaaaaugggugggagggaauggucgaugguugguauggcuuccggcaccaaaacagugaggggcguggacaggcagcugaccuuaagagcacccaggccgcgauugaucagauaaauggcaaauugaaccgccucaucgguaagacgaacgaaaaauuccaccaaauugagaaggaauuuuccgagguugaagggagaauccaggaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuaagggaaaacgcugaggauaugggcaauggaugcuuuaagauauaccacaagugugacaacgccugcaucggcucaauucggaaugggacauaugaucaugacguguaccgagacgaggcucugaacaaucgcuuccaaaucaaaggagucgaacucaagagugguuacaaagauuggauucuguggaucuccuuugccauaagcugcuuccuucuguguguggcauugcucggcuuuaucaugugggccugccagaaggggaacauuagauguaauaucugcauuuga

SEQ ID NO: 124658 - RNA, 1701 nt, Artificial Sequence; identical to SEQ ID NO: 124553
  derived and/or modified sequence opt3 from hemagglutinin__InfluenzaA__ACO95303

SEQ ID NO: 124659 - RNA, 1698 nt, Artificial Sequence
  derived and/or modified sequence opt3 from hemagglutinin__InfluenzaA__ACO95382
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcagcuucgaaagguuugagauuuucccuaaggaggguaguuggccaaaccacacugucacagggguguccgccucuugcagccauaauggagaauccucauuuuaucggaacuuacuguggcuuaccggcaaaaauggcuuguaccccaaccugaguaagagcuaugcaaauaacaaagagaaggaaguucuaguacucuggggagugcaccacccuccaaacaucggggaccagaaagcccuguaccauacggagaaugcuuacgucucugugguguccucacacuauagccgcaaguucacucccgaaauagcaaagcgaccuaaaguccgugaucaggaggguagaaucaacuacuauuggacccuucuggagccaggcgacacaauuaucuuugaagccaaugggaacuugauugcuccgagguacgccuucgcgcucagucggggauuuggcucugguaucauaaauuccaacgcacccauggauaagugugacgccaaaugccagacuccucaaggggcuauuaauagcucgcugccauuccagaacguucaucccgugaccaucggagaguguccuaaguauguacgcucugccaaauuaagaauggugacaggccugaggaauauuccauccauccagucacggggccucuuuggggcaaucgcuggauucauugaagguggcuggaccgggauggucgauggaugguacggcuaucaccaccagaacgagcaagguaguggguacgccgcggaccagaagucaacgcagaaugccauaaacggcaucacuaauaaagugaacuccguuauugaaaagaugaauacacaguuuaccgcagugggaaaggaguucaacaaacuugagcgccgaauggaaaaccugaauaagaaagucgaugacggcuucaucgauauauggacuuacaacgcugaguugcuagugcugcucgaaaaugagagaacacuggacuuucaugacucuaacguaaagaaucuuuaugaaaaaguuaagagccaacugaagaacaaugccaaagagauugggaacggaugcuucgaguuuuaccacaaguguaaugaugaaugcauggagucagugaaaaacgguaccuaugacuaccccaaguauagugaagaguccaaauugaauagggagaagaucgauggcgucaagcucgaaagcauggggguguaccagauccuggcuauuuauucuacggucgccucaaguuuagugcugcuaguuagccucggagcaaucuccuucuggaugugcucuaacggcucgcugcagugucggauuugcauauga

SEQ ID NO: 124660 - RNA, 1698 nt, Artificial Sequence
  derived and/or modified sequence opt3 from hemagglutinin__InfluenzaA__ACO95415
augaaggugaaacugcucguccuucugugcaccuucacagccacuuacgcugacacgaucuguauuggcuaucacgcaaacaauagcaccgauacaauagacacuguuuuggagaagaacgugaccguaacacauuccgugaauuuacuggaaaacucucacaaugggaaacuaugccuccugaagggaaucgcgccccuucagcuggguaacuguucagucgccggcuggauuuuggggaauccugagugcgaacuccugaucaguaaagagagcugguccuacauuguggaaaagccaaacccggagaauggaaccuguuaucccggccauuuugcugauuacgaggaacugagagagcaacucucuucgguuagcucauucgaaagguuugagaucuucccuaaggagaguuccuggccaaaccacacugugacaggugucucugccagcugcucccauaauggggaaucaaguuuuuaucggaacuuacuguggcuuaccgggaaaaauggcuuguaccccaaccugagcaagucuuaugcaaauaacaaaggcaaggaggugcuaguacucuggggaguucaccacccuccaaacauaggagaccagaauacgcuguaccauacugaaaacgccuacguguccgucgugucaagccacuauagucgcaaauucacccccgagaucgcuaagcgaccuaaggugcgugaucaggaagguagaauuaauuacuauuggacacuucuggagccaggcgacacuaucauuuuugaggcaaacgggaauuugaucgccccgagguacgcuuucgcccucucucggggauuuggcuccgguauaauuaacagcaaugcgcccauggauaaaugugacgcaaagugccagaccccucaaggggccaucaacucgucucugccauuccagaauguccaucccguuacaauuggagaauguccuaaauaugugcgcuccgcuaaguuaagaaugguaaccggccugaggaacaucccaucaauccagagucggggccucuuuggggccauugcaggauucauagaggguggcuggacggggaugguggauggaugguacggcuaucaccaccagaaugaacaagguagcggguacgcugccgaccagaaauccacucagaacgcgaucaauggcauuacaaacaaggucaauucugugaucgagaaaaugaacacccaguuuacugccguuggaaaggaguucaacaaacuugaacgccgaauggagaaucugaacaagaagguggaugacggcuucauagauauuuggacauacaaugcagaauugcuaguccugcucgagaacgaaagaacccuggacuuucaugacagcaaugugaaaaaccuuuaugagaagguaaaaucacaacugaagaauaacgcuaaggaaaucgggaauggaugcuucgaguuuuaccacaaauguaacgaugagugcauggaaaguguuaagaaugguacguaugacuaccccaaauauuccgaggaaagcaaguugaacagggagaaaaucgauggcgugaagcucgagucuaugggggucuaccagauucuggccaucuauucaaccguggcuaguagcuuaguccugcuagugucccucggagccauuucuuucuggaugugcucgaauggcagccugcagugucggauaugcaucuga

SEQ ID NO: 124661 - RNA, 1701 nt, Artificial Sequence
  derived and/or modified sequence opt3 from hemagglutinin__InfluenzaA__ACO95426
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcuccugcaagcggcgcucaaauaacagcuuuuucagucgacugaauuggcucacucauuuaaaguauaaauacccagcucugaacgugaccaugcccaauaacgagaaguuugauaaacuuuauaucuggggcguccaccauccuggcacagacucugaucagauuuccuuguacgcacaggccucagggcguaucacugugagcaccaagagaagucaacagacaguaauuccaaacaucggaucuaggccccggguucgcgacguguccagcagaauaucgauuuacuggaccaucgucaaaccuggugacauucugcuaaucaauucuacgggcaaccucaucgcuccaaggggguauuucaagauucgguccggaaagucaaguauaaugcgcagcgaugccccgaucggcaaauguaauuccgagugcauuacucccaacgguucuaucccuaaugacaagccauuucagaacgugaaucgaauaacauacggggcgugucccagauaugugaaacagaacacccugaaacuugcaacuggaaugaggaaugucccugaaaaacaaacacggggcauuuucggcgccaucgcuggguuuaucgagaacggaugggaagguaugguugauggcugguacggguuccgucaccagaauagcgagggaaccggccaggccgcagaccugaagucaacgcaagcugccauuaaccagaucaaugguaaauugaaccgccucauugggaagaccaaugagaaguuucaccagauagaaaaagaguucagugaaguggagggcagaauccaggaucuggaaaaguauguagaggacacaaaaauugauuuaugguccuacaacgcggagcugcucguggcccuugaaaaccaacauacuaucgaccugaccgauagcgagaugaauaaguuguucgaaaggacaaagaagcagcuacgggagaacgcagaagacaugggaaauggcugcuuuaagaucuaucacaaaugugauaacgcuugcauugggucuauacgaaauggaacuuacgaccaugacgucuaccgcgaugaggcccugaacaauagauuccagaucaaggguguggagcucaaaucaggcuauaaggacuggauucuguggaucaguuuugcuauuagcugcuuccuucuguguguugccuugcucggguuuaucaugugggcaugccagaaaggaaacauaagguguaauaucugcauuuga

SEQ ID NO: 124662 - RNA, 1701 nt, Artificial Sequence; identical to SEQ ID NO: 123811
  derived and/or modified sequence opt3 from hemagglutinin__InfluenzaA__ACO95437

SEQ ID NO: 124663 - RNA, 1701 nt, Artificial Sequence
  derived and/or modified sequence opt3 from hemagglutinin__InfluenzaA__ACO95448
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgaggaguucgacaaacuuuacauuuggggcgugcaccauccuggcacagauaaugaccagaucaacuuguaugcccaggcuagcgggcguauuacugucucuaccaagagaucccaacagacagugaucccaaauauaggaucaaggccccggguacgcgauauuccuagcagaaucaguauuuacuggaccaucguuaagccaggugacauccugcuaauuaacucuacgggcaaucucauagccccgaggggguacuuuaaaauccgguccggaaagagcucgauuaugcgcucugacgcgcccaucggcaaguguaacuccgaaugcauaacuccuaaugguucaauuccaaacgauaaacccuuccagaaugugaaccgaaucacauauggggcauguccuagauacgucaagcagaauacccugaaacuugccacuggaaugaggaacgugccagagaagcaaacacggggcaucuuuggcgcuauugccggguucaucgaaaauggaugggaggguaugguggacggcugguauggguuucgucaccagaacagugagggaauuggccaggcagcugaucugaaaagcacccaagccgcgauagaccagaucaaugguaaguugaaccgccucauugggaaaacgaacgaaaaguuccaccagaucgagaaggaguucuccgaagucgaaggcagaauccaggaucuggagaaauacguugaggacaccaagauugauuuauggucuuauaaugccgaacugcucguggcacuugagaaccaacauacaauagaccugacugauagcgaaaugaauaaauuguuugagaggaccaagaaacagcuacgggaaaacgcugaggacaugggaaauggcugcuucaagaucuaccacaagugugauaacgccugcauugggucaauccgaaauggaacauaugaccaugacguauaccgcgaugaggcucugaacaauagauuucagauuaaagguguggaacucaagaguggcuacaaagacuggauccuguggauauccuucgccaucagcugcuuucuucugugugucgcauugcucggguucauuaugugggccugccagaagggaaacaucagguguaauauuugcaucuga

SEQ ID NO: 124664 - RNA, 1701 nt, Artificial Sequence; identical to SEQ ID NO: 122646
  derived and/or modified sequence opt3 from hemagglutinin__InfluenzaA__ACO95459

SEQ ID NO: 124665 - RNA, 1701 nt, Artificial Sequence
  derived and/or modified sequence opt3 from hemagglutinin__InfluenzaA__ACO95470
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggccgauguaacuccgagugcaucacuccuaaugguucaauaccaaacgacaaacccuuucagaaugucaacagaauuacauauggggcauguccuagguacgugaagcagaauacccugaaacuugccacuggaaugcggaacgugccagaaaagcaaacacguggcaucuucggcgcuaucgccggguuuauugagaauggaugggaagguauggucgauggcugguauggguuccgccaccagaacagugagggaaucggccaggcagcugaccugaaaagcacccaagccgcgauuaaucagauaaacgguaaguugaacagacucaucgggaaaacgaaugagaaguuccaccagauugaaaaggaguuuuccgaaguugagggcaggauccaggaucuggaaaaauacguggaggacaccaagaucgauuuauggucuuauaacgccgagcugcucguagcacuugaaaaucaacauacaauugaccugacugauagcgagaugaacaaauuguucgaacggaccaagaaacagcuacgagagaaugcugaagacaugggaaacggcugcuuuaagauauaccacaagugugauaaugccugcaucgggucaauucgcaacggaacauaugaccaugauguguacagagacgaggcucugaauaacagguuccagaucaaaggugucgagcucaagaguggcuacaaagacuggauucuguggaucuccuuugccauaagcugcuuccuucuguguguggcauugcucggguuuaucaugugggccugccagaagggaaauauucgguguaacaucugcauuuga

SEQ ID NO: 124666 - RNA, 1701 nt, Artificial Sequence
  derived and/or modified sequence opt3 from hemagglutinin__InfluenzaA__ACO95481
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaaguuggccacuggaaugaggaaccugccagaaaaacaaacacggggcaucuucggcgcuaucgccggguuuauugagaauggaugggaagguaugguggauggcugguauggguuccgucaccagaacagugagggaaucggccaggcagcugaccuuaagagcacccaagccgcgauuaaucagauaaacgguaaacucaaccgccugaucgggaagacgaaugagaaguuccaccagauugaaaaagaguuuuccgaagucgagggcagaauccaggauuuagaaaaguacguugaggacaccaaaaucgaucuguggucuuauaacgccgagcuccuuguggcacuggaaaaucaacauacaauugacuugacugauagcgagaugaacaagcuauucgaaaggaccaaaaagcagcugcgggagaaugcugaagacaugggaaacggcugcuuuaagauauaccacaaaugugauaaugccugcaucgggucaauucgaaacggaacauaugaccaugauguauaccgcgacgaggcucucaauaacagauuccagaucaaggguguggagcugaaaaguggcuacaaggacuggauucuuuggaucuccuuugccauaagcugcuuccuguugugugucgcacuccugggguuuaucaugugggccugccagaaaggaaauauuagguguaacaucugcauuuga

SEQ ID NO: 124667 - RNA, 1701 nt, Artificial Sequence; identical to SEQ ID NO: 122646
  derived and/or modified sequence opt3 from hemagglutinin__InfluenzaA__ACO95492

SEQ ID NO: 124668 - RNA, 1701 nt, Artificial Sequence; identical to SEQ ID NO: 122646
  derived and/or modified sequence opt3 from hemagglutinin__InfluenzaA__ACO95503

SEQ ID NO: 124669 - RNA, 1701 nt, Artificial Sequence; identical to SEQ ID NO: 122646
  derived and/or modified sequence opt3 from hemagglutinin__InfluenzaA__ACO95514

SEQ ID NO: 124670 - RNA, 1701 nt, Artificial Sequence; identical to SEQ ID NO: 122646
  derived and/or modified sequence opt3 from hemagglutinin__InfluenzaA__ACO95536

SEQ ID NO: 124671 - RNA, 1701 nt, Artificial Sequence; identical to SEQ ID NO: 122646
  derived and/or modified sequence opt3 from hemagglutinin__InfluenzaA__ACO95547

SEQ ID NO: 124672 - RNA, 1701 nt, Artificial Sequence
  derived and/or modified sequence opt3 from hemagglutinin__InfluenzaA__ACP41963
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaaaucggcaacggauguuuugaguucuaucacaagugcgacaauaccuguauggaauccgugaaaaacggcacauacgauuauccuaaguacagcgaggaagccaaacugaauagagaggagauugacggggucaaacuugaaucuacuaggaucuaucaaauucuggcuauauacucaaccguggcgaguagcuugguccucgugguuucccugggagcaaucucuuuuuggaugugcucgaacgguagcuuacagugccggauuuguaucuga

SEQ ID NO: 124673 - RNA, 1698 nt, Artificial Sequence; identical to SEQ ID NO: 124659
  derived and/or modified sequence opt3 from hemagglutinin__InfluenzaA__ACP44192

SEQ ID NO: 124674 - RNA, 1698 nt, Artificial Sequence; identical to SEQ ID NO: 124659
  derived and/or modified sequence opt3 from hemagglutinin__InfluenzaA__ACP44203

SEQ ID NO: 124675 - RNA, 1698 nt, Artificial Sequence
  derived and/or modified sequence opt3 from hemagglutinin__InfluenzaA__ACP44225
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcggacuccugauuaguaaagaaagcugguccuacaucguugagaagccaaacccggaaaauggcaccuguuaucccggucauuuugcugauuacgaggagcugagagaacaacucucuucggugagcucauucgagagguuugaaauuuucccuaaggagaguuccuggccaaaccacacugucacaggggugucugccagcugcucccauaauggagagucaaguuuuuaucggaacuuacuguggcuuaccggcaaaaauggcuuguaccccaaccugagcaagucuuaugcaaauaacaaagaaaaggagguucuaguacucuggggagugcaccacccuccaaacaucggggaccagaaagcccuguaccauacggaaaaugcuuacgucuccguggugucaagccacuauagucgcaaguucacucccgagauagcaaagcgaccuaaaguccgugaucaggaagguagaaucaacuacuauuggacccuucuggagccaggcgacacaauuaucuuugaggccaaugggaacuugauugcuccgagguacgccuucgcgcucucucggggauuuggcuccgguaucauaaauagcaacgcacccauggauaagugugacgccaaaugccagacuccucaaggggcuauuaauucgucucugccauuccagaacguucaucccgugaccaucggagaauguccuaaguauguacgcuccgccaaauuaagaauggugacaggccugaggaauauuccaucaauccagagucggggccucuuuggggcaaucgcuggauucauugaggguggcuggaccgggauggucgauggaugguacggcuaucaccaccagaacgaacaagguagcggguacgccgcggaccagaaguccacgcagaaugccauaaacggcaucacuaauaaagugaacucuguuauugagaagaugaauacacaguuuaccgcagugggaaaggaguucaacaaacuugaacgccgaauggagaaccugaauaagaaagucgaugacggcuucaucgauauauggacuuacaacgcugaauugcuagugcugcucgagaaugaaagaacacuggacuuucaugacagcaacguaaagaaucuuuaugagaaaguuaagucacaacugaagaacaaugccaaagaaauugggaacggaugcuucgaguuuuaccacaaguguaaugaugagugcauggaaagugugaaaaacgguaccuaugacuaccccaaguauuccaaagagagcaaguugaauagggaaaagaucgauggcgucaaacucgagucuauggggguguaccagauccuggcuauuuauucaacggucgccaguagcuuagugcugcuaguuucccucggagcaaucucuuucuggaugugcucgaacggcagccugcagugucggauuugcauauga

SEQ ID NO: 124676 - RNA, 1701 nt, Artificial Sequence
  derived and/or modified sequence opt3 from hemagglutinin__InfluenzaA__ACP44236
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccgacaagucauuuuucagucgacugaacuggcucacucauuuaaaauuuaaguauccagcacugaaugugaccaugcccaacaaugagaaauucgauaaacuuuacaucuggggcguccaccauccuggcacagacaacgaucagauuagcuuguaugcccaggcuucugggcguaucacuguguccaccaagagaucacaacagacaguaauuccaaacaucggaagcaggccccggguucgcgacgugccuaguagaauaucuauuuacuggaccaucgucaagccaggugacauucugcuaaucaauuccacgggcaaccucaucgccccgaggggguacuuuaagauucggagcggaaaaucgucuauaaugcgcuccgaugcgcccaucggcaaguguaauucagagugcauuacuccuaacgguaguaucccaaaugacaaacccuuccagaacgugaaucgaauaacauauggggcauguccuagauacgugaagcagaacacccugaaacuugccacuggaaugaggaaugucccagaaaagcaaacacggggcauuuuuggcgcuaucgccggguucaucgagaacggaugggaagguaugguugauggcugguauggguuucgucaccagaauagcgagggaaccggccaggcagcugaccugaaauccacgcaagccgcgauuaaccagaucaaugguaaguugaaccgccucauugggaagaccaaugagaaauuccaccagauagaaaaggaguucucugaaguggagggcagaauccaggaucuggaaaaauacguagaggacacaaagauugauuuauggagcuauaacgccgagcugcucguggcacuugaaaaccaacauacuaucgaccugaccgauucagagaugaauaaauuguuugaaaggacaaagaagcagcuacgggagaacgcugaagacaugggaaauggcugcuucaaaaucuaccacaagugugauaacgccugcauugggaguauacgaaauggaacuuaugaccaugacgucuaccgcgaugaggcucugaacaauagauuucagaucaaagguguggagcucaaguccggcuacaaagacuggauucuguggaucagcuucgccauuucuugcuuucuucuguguguugcauugcucggguucaucaugugggccugccagaagggaaacauaagguguaauaucugcauuuga

SEQ ID NO: 124677 - RNA, 1701 nt, Artificial Sequence; identical to SEQ ID NO: 124613
  derived and/or modified sequence opt3 from hemagglutinin__InfluenzaA__ACP44247

SEQ ID NO: 124678 - RNA, 1701 nt, Artificial Sequence; identical to SEQ ID NO: 122646
  derived and/or modified sequence opt3 from hemagglutinin__InfluenzaA__ACP44258

SEQ ID NO: 124679 - RNA, 1701 nt, Artificial Sequence; identical to SEQ ID NO: 122646
  derived and/or modified sequence opt3 from hemagglutinin__InfluenzaA__ACP44269

SEQ ID NO: 124680 - RNA, 1701 nt, Artificial Sequence; identical to SEQ ID NO: 124672
  derived and/or modified sequence opt3 from hemagglutinin__InfluenzaA__ACQ44554

SEQ ID NO: 124681 - RNA, 1701 nt, Artificial Sequence; identical to SEQ ID NO: 124672
  derived and/or modified sequence opt3 from hemagglutinin__InfluenzaA__ACQ44556

SEQ ID NO: 124682 - RNA, 1701 nt, Artificial Sequence; identical to SEQ ID NO: 124672
  derived and/or modified sequence opt3 from hemagglutinin__InfluenzaA__ACQ45338

SEQ ID NO: 124683 - RNA, 1701 nt, Artificial Sequence
  derived and/or modified sequence opt3 from hemagglutinin__InfluenzaA__ACQ55359
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaguucucgcuauuccaagaaauuuaagccagagauugcaauccgacccaaagugcgugaucaggagggaagaaugaauuacuauuggacucugguggaaccuggugacaagauuaccuucgaggccacaggcaaccuagucguuccaagguacgcuuuugccauggaacggaacgcagggagcggaaucauaauuucggauacuccggugcaugacugcaauaccacaugucaaacccccaaaggcgcuaucaacacgucucucccuuuccagaauauucacccaaucacuaucgguaagugccccaaguauguaaaauccacaaagcugcgccuugccaccgggcugagaaacauuccuucaauacagaguaggggauuguuuggcgcgaucgccggcuucauugaagggggauggacugguaugguggacggcugguacggguaucaucaccagaaugaacaaggaagcggcuacgcagcugaucucaaauccacacagaacgccaucgacgagauaaccaauaaggucaacucugugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauagcaaugugaaaaaccuguacgagaagguacgaucacagcucaaaaacaaugcaaaggaaauuggcaacggauguuuugaguucuaucacaagugcgacaauaccuguauggaaaguguuaaaaacggcacauacgauuauccaaaguacuccgaggaagccaaacugaauagagaggagaucgacggggugaaacuugaaagcacuaggauuuaucaaauacuggcuaucuacucuaccgucgcgucaaguuuggugcucgucgugagccugggagcaauuuccuuuuggaugugcucuaacgguucguuacagugccggaucuguaucuga

SEQ ID NO: 124684 - RNA, 1701 nt, Artificial Sequence; identical to SEQ ID NO: 124672
  derived and/or modified sequence opt3 from hemagglutinin__InfluenzaA__ACQ55361

SEQ ID NO: 124685 - RNA, 1701 nt, Artificial Sequence
  derived and/or modified sequence opt3 from hemagglutinin__InfluenzaA__ACQ63223
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 124686 - RNA, 1701 nt, Artificial Sequence; identical to SEQ ID NO: 124685
  derived and/or modified sequence opt3 from hemagglutinin__InfluenzaA__ACQ63239

SEQ ID NO: 124687 - RNA, 1701 nt, Artificial Sequence; identical to SEQ ID NO: 124685
  derived and/or modified sequence opt3 from hemagglutinin__InfluenzaA__ACQ63244

SEQ ID NO: 124688 - RNA, 1701 nt, Artificial Sequence; identical to SEQ ID NO: 124685
  derived and/or modified sequence opt3 from hemagglutinin__InfluenzaA__ACQ63257

SEQ ID NO: 124689 - RNA, 1701 nt, Artificial Sequence
  derived and/or modified sequence opt3 from hemagglutinin__InfluenzaA__ACQ65691
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcuccugcaagcggggcucagacaacagcuuuuucagucgccugaauuggcucacucauuuaaaguuuaaauauccagcucugaacgugaccaugcccaauaacgagaaguucgauaaacuuuacaucuggggcguccaccauccugggacagacaacgaucagauuuuuccauaugcacaggccucuggacgaaucacuguguccaccaagcguucacaacagacaguaauucccaauaucgguagcagaccuaggguucgggacauaccaagucgcauuucuaucuacuggaccauugugaaaccgggcgacaucuugcugaucaacuccacggggaaucuaauugcucccagaggauacuucaagauaaggagcggcaagucgucuaucaugcgguccgaugccccuauugguaaauguaacucagagugcaucacuccaaaugggaguauacccaacgacaagccuuuucagaaugucaaccgcauuacauauggagcguguccacgauacgugaaacagaauacccucaagcuggcaacuggcaugagaaacgugcccgaaaaacaaacaaggggcaucuucggggccaucgcuggauuuauugagaaugguugggaaggcauggucgaugggugguauggauuccggcaccagaacagcgagggcaucggucaggccgcagaccuuaaguccacccaagcugccauuaaucagauaaacgggaaacugaaucguuugaucggcaagacgaacgagaaguuccaccagauugaaaaagaguuuucugaaguugagggacgcauccaggaucucgaaaaguacguggaggacaccaaaaucgaucuguggagcuauaacgcggaguuacugguagcccucgaaaaucaacauacaauugaccuuacugauucagagaugaacaagcuguucgaaagaaccaaaaagcaguugagggagaaugcagaagacaugggcaacgggugcuuuaagauauaccacaaaugugauaaugcuugcaucggaaguauucggaacgguacauaugaccaugacguguaccgagaugaggcccuaaauaaccgcuuccagaucaagggcgucgagcugaaauccggguacaaggacuggauucucuggaucagcuuuacuauaucuugcuuccugcuuuguguggcucuguugggauuuaucaugugggccugccagaaaggcaauauuagauguaacaucugcauuuga

SEQ ID NO: 124690 - RNA, 1701 nt, Artificial Sequence; identical to SEQ ID NO: 124450
  derived and/or modified sequence opt3 from hemagglutinin__InfluenzaA__ACQ65713

SEQ ID NO: 124691 - RNA, 1701 nt, Artificial Sequence
  derived and/or modified sequence opt3 from hemagglutinin__InfluenzaA__ACQ65724
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacugggcugguguuacacagaaugggaccucuagcgcaugcauccggcgcuccaacaauucauuuuucagucgacugaacuggcucacgcauuuaaaguuuaaguauccagcccugaaugugacuaugcccaacaacgagcaguucgacaaacuuuacauuuggggaguccaccauccuggcaccgauaaugaccagaucuuuuuguaugcucaagccagcggccguauuacagugucuacuaagagaucccagcagaccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuauggugccuguccuagauacgugaaacaaaauacacugaagcuggcuaccgggaugaggaacgugccagagaaacagacucggggaaucuucggcgccauugcaggcuuuaucgaaaaugggugggagggaauggucgaugguugguauggcuuccgucaccagaacagugaggggcgcggacaagcugccgaccuuaagagcacacaggcggccauugaucagauaaauggcaaauugaacagacucaucgguaagaccaacgaaaaauuccaccagauugagaaggaauuuuccgagguugaagggaggauccaagaccuggagaaguacguggaggauacgaaaaucgacuuauggucuuauaaugcagaacugcucguagcucuugagaaccagcauaccauugaucugacagacagcgaaaugaauaaguuguucgagaaaacuaagaaacagcuacgggaaaacgccgaggauaugggcaauggaugcuuuaagauauaccacaagugugacaacgcuugcaucggcucaauucgaaaugggaccuaugaucaugacguguaccgcgacgaggcccugaacaauagauuccagaucaaaggagucgaacucaagagugguuacaaagauuggauucuguggaucuccuuugcaauaagcugcuuccuucuguguguggccuugcucggcuuuaucaugugggcuugccaaaaggggaacauuagguguaauaucugcauuuga

SEQ ID NO: 124692 - RNA, 1701 nt, Artificial Sequence
  derived and/or modified sequence opt3 from hemagglutinin__InfluenzaA__ACQ65747
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcacuaacaauuccuuuuucucacgacugaacuggcucacccauuuaaaguuuaaguauccagcacugaaugugacaaugcccaacaacgagaaauucgacaaacuuuacauuuggggaguccaccauccuggcacugauaaugaccagaucuuuuuguaugcccaggcuaguggccguauuaccgugagcacaaaaagaucucaacagaccguaaucccaaacauaggguccaggccccggguucgcaauauuccuucaagaaucagcauuuacuggacgaucgugaagccaggagauauccugcuaauuaacaguacugguaaucucauagccccgaggggcuacuucaaaauccggucugggaaguccagcauuaugcgcucggacgcgcccaucggaaaguguaacucugaaugcauaacaccuaauggcuccauuccaaacgacaaacccuuucagaaugucaaccgaaucaccuauggugcauguccuagauacgugaagcagaauacucugaaacuugccacagggaugaggaacgugccagagaagcaaacccggggaaucuucggcgcuauugccggcuuuaucgaaaaugggugggagggaaugauggaugguugguauggcuuccgucaccagaacucagaggggauuggacaggcagcugaccugaaaaguacgcaagccgcgauagaucagaucaauggcaaguugaacggucucauugggaaaaccaacgaaaaguuccaccagaucgagaaggaauuuagcgaggucgaaggccgcauccaggaccuggagaaauacguugaggauacaaagauugacuuaugguccuauaaugccgaacugcucguggcacuugagaaccaacauacuauagaucugaccgacucugaaaugaauaaauuguucgagaagacaaagaagcagcuaagagaaaacgcugaggauaugggaaauggcugcuuuaagaucuaccacaaaugugacaacgccugcauugggagcaucaggaauggaacuuaugaucaugacguauaccgggacgaggcucugaacaaucgauuccagauuaaggguguggaacucaaaucaggcuacaaggauuggauccuguggauaaguuuugccaucuccugcuuccuucugugugucgcauugcucggguuuauuaugugggccugccagaaaggaaacauccgcuguaauauuugcaucuga

SEQ ID NO: 124693 - RNA, 1698 nt, Artificial Sequence
  derived and/or modified sequence opt3 from hemagglutinin__InfluenzaA__ACQ65758
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacguuguggaaaagccaaacccggagaauggaaccuguuaucccggccauuuugcugauuacgaggaacugagagagcaacucucuucggucagcucauucgaaagguuugagaucuucccuaaggagaguuccuggccaaaccacacugugacagguguaucugccagcugcucccauaauggggaaucaaguuuuuaucggaacuuacuguggcuuaccgggaaaaauggcuuguaccccaaccugagcaagucuuaugcaaauaacaaaggcaaggagguucuagugcucuggggaguccaccacccuccaaacauuggagaccagaauacgcuguaccauacugaaaacgccuacguguccguggucucaagccacuauagucgcaaauucacccccgagaucgcuaagcgaccuaagguucgugaucaggaagguagaauaaauuacuauuggacacuucuggagccaggcgacacuaucauuuuugaggcaaacgggaauuugaucgccccgagguacgcuuucgcccucucucggggauuuggcuccgguauuaucaacagcaaugcgcccauggauaaaugugacgcaaagugccagaccccucaaggggccauaaacucgucucugccauuccagaaugugcaucccguaacaauuggagaauguccuaaauaugugcgcuccgcuaaguuaagaauggucaccggccugaggaacaucccaucaauucagagucggggccucuuuggggccaucgcaggauucaucgaggguggcuggacggggaugguggauggaugguacggcuaucaccaccagaaugaacaagguagcggguacgcugccgaccagaaauccacucagaacgcgauuaauggcauaacaaacaagguuaauucugugaucgagaaaaugaacacccaguuuacugccgucggaaaggaguucaacaaacuugaacgccgaauggagaaucugaacaagaagguggaugacggcuucauugauaucuggacauacaaugcagaauugcuaguacugcucgagaacgaaagaacccuggacuuucaugacagcaauguuaaaaaccuuuaugagaaggugaaaucacaacugaagaauaacgcuaaggaaauagggaauggaugcuucgaguuuuaccacaaauguaacgaugagugcauggaaagugucaagaaugguacguaugacuaccccaaauauuccgaggaaagcaaguugaacagggagaaaauugauggcgugaagcucgagucuaugggggucuaccagauccuggccaucuauucaaccguggcuaguagcuuaguucugcuagugucccucggagccauuucuuucuggaugugcucgaauggcagccugcagugucggaucugcauuuga

SEQ ID NO: 124694 - RNA, 1701 nt, Artificial Sequence; identical to SEQ ID NO: 124672
  derived and/or modified sequence opt3 from hemagglutinin__InfluenzaA__ACQ73386

SEQ ID NO: 124695 - RNA, 1701 nt, Artificial Sequence; identical to SEQ ID NO: 124685
  derived and/or modified sequence opt3 from hemagglutinin__InfluenzaA__ACQ73387

SEQ ID NO: 124696 - RNA, 1701 nt, Artificial Sequence
  derived and/or modified sequence opt3 from hemagglutinin__InfluenzaA__ACQ73555
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaagcccaacaacgagaaauucgacaaguuguacaucuggggcguccaccauccuggcacagauaaugaccagauuuuucuuuaugcccaggcuagcgggcguaucacugugucuaccaaaagaucccaacagacaguaauuccaaacaucggaucaaggccccggguucgcaauauaccuagcagaauuaguaucuacuggaccauugugaagccaggugauauccugcuaaucaacucuacgggcaaucucauugccccgaggggguacuucaagauacgguccggaaaaagcucgaucaugcgcucugacgcgcccauuggcaaguguaacuccgagugcaucacuccuaaugguucaauaccaaacgacaaacccuuucagaaugucaaccgaauuacauauggggcauguccuagauacgugaagcagaauacccugaaacuugccacuggaaugaggaacgugccagaaaagcaaacacggggcaucuucggcgcuaucgccggguuuauugagaauggaugggaagguauggucgauggcugguauggguuccgucaccagaacagugagggaaucggccaggcagcugaccugaaaagcacccaagccgcgauuaaucagauaaacgguaaguugaaccgccucaucgggaagacgaaugagaaauuccaccagauugaaaaggaguuuuccgaaguugagggcagaauccaggaucuggaaaaauacguggaggacaccaagaucgauuuauggucuuauaacgccgagcugcucguagcacuugaaaaucaacauacaauugaccugacugauagcgagaugaacaaauuguucgaaaggaccaagaagcagcuacgggagaaugcugaagacaugggaaacggcugcuuuaaaauauaccacaagugugauaaugccugcaucgggucaauucgaaacggaacauaugaccaugauguguaccgcgacgaggcucugaauaacagauuccagaucaaaggugucgagcucaagaguggcuacaaagacuggauucuguggaucuccuuugccauaagcugcuuccuucuguguguggcauugcucggguuuaucaugugggccugccagaagggaaauauuagguguaacaucugcauuuga

SEQ ID NO: 124697 - RNA, 1701 nt, Artificial Sequence; identical to SEQ ID NO: 124685
  derived and/or modified sequence opt3 from hemagglutinin__InfluenzaA__ACQ76294

SEQ ID NO: 124698 - RNA, 1701 nt, Artificial Sequence; identical to SEQ ID NO: 124685
  derived and/or modified sequence opt3 from hemagglutinin__InfluenzaA__ACQ76314

SEQ ID NO: 124699 - RNA, 1701 nt, Artificial Sequence; identical to SEQ ID NO: 124685
  derived and/or modified sequence opt3 from hemagglutinin__InfluenzaA__ACQ76317

SEQ ID NO: 124700 - RNA, 1701 nt, Artificial Sequence
  derived and/or modified sequence opt3 from hemagglutinin__InfluenzaA__ACQ76318
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacacuuacguguucgucgggaguucucgcuauuccaagaaauuuaagccagagauugcgauccgacccaaagugcgugaucaggagggaagaaugaauuacuauuggacccugguggaaccuggugacaagauuacauucgaggcaacuggcaaccuagucguuccaagguacgccuuugcuauggaacggaacgccgggagcggaaucauaauuucggauaccccggugcaugacugcaauacaaccugucaaacgcccaaaggcgcaaucaacacuucucucccuuuccagaauauucacccaaucacaaucgguaagugccccaaguauguaaaauccaccaagcugcgccuugcuacugggcugagaaacauuccuucaauacagaguaggggauuguuuggcgccaucgcgggcuucauugaagggggauggacagguaugguggacggcugguacggguaucaucaccagaaugaacaaggaagcggcuacgccgcagaucucaaauccacccagaacgcuaucgacgagauaacgaauaaggucaacucugugauugagaaaaugaauacccaguuuacagccguugguaaggaguucaaccaccuggaaaagcggaucgaaaauuuaaacaaaaagguggaugacggguuccuggauaucuggacuuacaaugcugagcuccuuguccuguuggaaaacgagcgcacccuagacuaucaugauagcaaugugaaaaaccuguacgagaagguacgaucacagcucaaaaacaaugccaaggaaauuggcaacggauguuuugaguucuaucacaagugcgacaauacauguauggaaaguguuaaaaacggcacuuacgauuauccaaaguacuccgaggaagcaaaacugaauagagaggagaucgacggggugaaacuugaaagcaccaggauuuaucaaauacuggccaucuacucuacagucgcuucaaguuuggugcucgucgugagccugggagcgauuuccuuuuggaugugcucuaacgguucguuacagugccggaucuguaucuga

SEQ ID NO: 124701 - RNA, 1701 nt, Artificial Sequence; identical to SEQ ID NO: 124672
  derived and/or modified sequence opt3 from hemagglutinin__InfluenzaA__ACQ76326

SEQ ID NO: 124702 - RNA, 1701 nt, Artificial Sequence; identical to SEQ ID NO: 124672
  derived and/or modified sequence opt3 from hemagglutinin__InfluenzaA__ACQ76336

SEQ ID NO: 124703 - RNA, 1701 nt, Artificial Sequence; identical to SEQ ID NO: 124672
  derived and/or modified sequence opt3 from hemagglutinin__InfluenzaA__ACQ76347

SEQ ID NO: 124704 - RNA, 1701 nt, Artificial Sequence; identical to SEQ ID NO: 124685
  derived and/or modified sequence opt3 from hemagglutinin__InfluenzaA__ACQ76365

SEQ ID NO: 124705 - RNA, 1701 nt, Artificial Sequence; identical to SEQ ID NO: 124685
  derived and/or modified sequence opt3 from hemagglutinin__InfluenzaA__ACQ76370

SEQ ID NO: 124706 - RNA, 1701 nt, Artificial Sequence; identical to SEQ ID NO: 124672
  derived and/or modified sequence opt3 from hemagglutinin__InfluenzaA__ACQ76376

SEQ ID NO: 124707 - RNA, 1701 nt, Artificial Sequence
  derived and/or modified sequence opt3 from hemagglutinin__InfluenzaA__ACQ76383
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaaggguaucaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggucuucccgcuauagcaagaaauuuaagccugagaucgcaauucgaccaaaaguccgugaucaggagggaagaaugaauuacuauuggacucugguggaacccggugacaagaucaccuucgaggccacaggcaaccuaguggucccuagguacgcuuuugccauggaacggaacgcagggucgggaauaauuaucucugauacuccaguucaugacugcaauaccacaugucaaaccccgaaaggcgcuauuaacacgucccuccccuuccagaauauccacccuaucacuauugguaagugcccaaaguaugugaaaucaacaaagcugcgccuugccaccgggcugagaaacguacccaguauacagagcaggggauuguuuggcgcgaucgccggcuucauugaagggggauggacugguaugguggacggcugguacggguaucaucaccagaaugaacaaggauccggcuacgcagcugaucucaaaucuacacagaacgccaucgacgagauaaccaauaaggucaacagcgugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauucaaaugugaaaaaccuguacgagaagguacgaagucagcucaaaaacaaugcaaaggaaauuggcaacggauguuuugaguucuaucacaagugcgacaauaccuguauggaauccguuaaaaacggcacauacgauuauccuaaguacagcgaggaagccaaacugaauagagaggagaucgacggggugaaacuugaaucuacuaggauuuaucaaauacuggcuaucuacucaaccgucgcgaguagcuuggugcucgucgugucccugggagcaauuucuuuuuggaugugcucgaacgguagcuuacagugccggaucuguaucuga

SEQ ID NO: 124708 - RNA, 1701 nt, Artificial Sequence; identical to SEQ ID NO: 124685
  derived and/or modified sequence opt3 from hemagglutinin__InfluenzaA__ACQ76389

SEQ ID NO: 124709 - RNA, 1701 nt, Artificial Sequence; identical to SEQ ID NO: 124672
  derived and/or modified sequence opt3 from hemagglutinin__InfluenzaA__ACQ76401

SEQ ID NO: 124710 - RNA, 1701 nt, Artificial Sequence; identical to SEQ ID NO: 124685
  derived and/or modified sequence opt3 from hemagglutinin__InfluenzaA__ACQ76405

SEQ ID NO: 124711 - RNA, 1701 nt, Artificial Sequence
  derived and/or modified sequence opt3 from hemagglutinin__InfluenzaA__ACQ76408
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggucuucccgcuauagcaagaaauuuaagccugagauugcaauccgaccaaaagugcgugaucaggagggaagaaugaauuacuauuggacuuugguggaacccggugacaagauuaccuucgaggccacaggcaaccuggucguuccuagguacgcuuuugccauggaacggaacgcagggucgggaaucauaauuucugauacuccagugcaugacugcaauaccacaugucaaaccccgaaaggcgcuaucaacacgucccuacccuuccagaauauucacccuaucacuaucgguaagugcccaaaguauguaaaaucaacaaagcuccgccuggccaccgggcuuagaaacgugcccaguauucagagcaggggacuguuuggcgcgauagccggcuucaucgaagggggauggacugguauggucgacggcugguacggguaucaucaccagaaugaacaaggauccggcuacgcagcugauuugaaaucuacacagaacgccauugacgagaucaccaauaaggugaacagcguuauagagaaaaugaauacgcaguuuaccgcuguggguaaggaguucaaccaccucgagaagcggauugaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaaucggcaacggauguuuugaguucuaucacaagugcgacaauaccuguauggaauccgugaaaaacggcacauacgauuauccuaaguacagcgaggaagccaaacucaauagagaggagauugacggggucaagcuggaaucuacuaggaucuaucaaauucuugcuauauacucaaccguggcgaguagccuggucuuggugguuucccucggagcaaucucuuuuuggaugugcucgaacgguagccugcagugccggauuuguaucuga

SEQ ID NO: 124712 - RNA, 1701 nt, Artificial Sequence
  derived and/or modified sequence opt3 from hemagglutinin__InfluenzaA__ACQ77601
augaagaccaucauugcccugagcuacauacucugccuugcuuucgcacagaaacugcccggcaacgacaauuccacagccacuuuguguuuagggcaccaugcggugccuaacggaacgcuggucaagaccaucacaaaugaucaaauugagguuacuaacgcuaccgagcuagugcagucuucaaguacagguagaaucugcgacagcccacaccagauucucgauggcgaaaauuguacccugaucgacgcccuucugggggauccgcauugcgacggauuucagaacaaagaaugggauuuguucguagagagguccaaggcauauucugacuguuaccccuaugaugugccugacuacgccucgcuccggucacuggucgcuagcaguggcacucuggaauuuaauaacgaguccuucaauuggacagguguggcacaaaacgggaccucuagcgccugcaaacgccgauccauaaagucauuuuucagucgucucaauugguuacaccagcuggagaacagauauccagcucccaauguuacgaugccuaacaaugauaaguuugacaaacuuuacaucuggggagugcaucacccaagcacugauucugaccagauuuccgucuaugcccaggcgucaggcagggugaccguaagcacaaagcggagucaacagacuguuauccccaacauuggcucucgcccuugggugagagggaucuccagcaggauaucgauuuacuggaccaucgucaaaccaggagacauuuugcugaucaacucuacagguaaucuaaucgcaccgcggggcuacuucaagauucgcuccgggaaaucaaguauaaugcgaagcgaugcccccaucggaaaguguaacuccgaaugcauuaccccuaauggcucuaucccaaacgacaagcccuuucagaaugugaacagaauaacguauggugcuuguccuagguacgugaaacagaauacucucaagcuggccacagggaugcggaacgucccagagaaacaaacccguggaauuuucggcgcaaucgcuggcuuuaucgaaaaugggugggagggaaugauggaugguugguauggcuuccgccaccagaacagcgaggggacuggacaggccgcggaccuuaagucaacacaagccgcaauuaaucagaucaacggcaaacugaauaaguugauugagaaaaccaacgaaaaguuucaucagauagaaaaggaguucagugaaguugaggguagaauccaggaucucgagaaauacguggaagacacgaagauugaucugugguccuauaaugcugaguuacugguagcccucgaaaaccaacacaccaucgaccuuacagauagcgagaugaacaaacuguucgaaaggacucggaagcaguugcgagagaaugcugaggacauggggaacggcugcuuuaaaaucuaccauaagugugauaaugccugcauuggaucuauacgcaacggcaccuaugaccacgacguguacagagaugaagcacuaaauaacagguuccagaucaagggggucgagcugaaaucaggauacaaggacuggauucucuggaucaguuuugccauuagcugcuuccugcuuugugugguucuguuggguuuuaucaugugggcuugccagaaaggcaauauacgguguaacaucugcauuuga

SEQ ID NO: 124713 - RNA, 1701 nt, Artificial Sequence
  derived and/or modified sequence opt3 from hemagglutinin__InfluenzaA__ACQ83310
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguauguccucuuucgaacgguuugagauuuucccgaagacaagcuccuggcccaaucacgauucaaacaagggugugaccgccgcuuguccucaugcaggggccaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgcugaucaacagaguuuguaccagaacgccgacgcguacguuuucguggggucuucccgcuauagcaagaaacugaagccugagauugcaauccgaccaaaaguccgugaucaggagggaagaaugaauuacuauuggacucuaguggaacccggugacaagauuaccuuugaggccacaggcaaccucguggucccuagguacgcuuucgccauggaacggaacgcagggucgggaaucauaauuucugauacuccaguucaugacugcaauaccacaugucaaaccccgaaaggcgcuaucaacacgucccugcccuuucagaauauucacccuaucacuaucgguaagugcccaaaguaugugaaaucaacaaaacuucgccuggccaccggguugagaaacguacccaguauucagagcaggggacucuucggcgcgauagccggcuuuaucgaagggggauggacugguaugguggacggcugguacggguaucaucaccagaaugaacaaggauccggcuacgcagcugaucugaagucuacacagaacgccauugacgagaucaccaauaaggucaacagcgugauagagaaaaugaauacgcaguucaccgcuguugguaaggaauuuaaccacuuagagaagcggauugaaaaucugaacaaaaagguggaugacggguuccucgauaucuggacauacaaugccgagcuucuggucuugcuagaaaacgagcgcacucuggacuaucaugauucaaaugugaaaaaccucuacgagaagguacgaagucagcugaaaaacaaugcaaaggaaaucggcaacggauguuucgaguuuuaucacaagugcgacaauaccuguauggaauccguuaaaaacggcacauacgauuauccuaaguacagcgaggaagccaaacuuaauagagaggagauugacggggugaagcuggaaucuacuaggaucuaucaaauuuuggcuauauacucaaccgucgcgaguagccucgugcuggucguguccuuaggagcaaucucuuucuggaugugcucgaacgguagccugcagugccggauuuguaucuga

SEQ ID NO: 124714 - RNA, 1701 nt, Artificial Sequence; identical to SEQ ID NO: 124672
  derived and/or modified sequence opt3 from hemagglutinin__InfluenzaA__ACQ84451

SEQ ID NO: 124715 - RNA, 1701 nt, Artificial Sequence; identical to SEQ ID NO: 124672
  derived and/or modified sequence opt3 from hemagglutinin__InfluenzaA__ACQ84457

SEQ ID NO: 124716 - RNA, 1701 nt, Artificial Sequence
  derived and/or modified sequence opt3 from hemagglutinin__InfluenzaA__ACQ84477
augaaggccauccugcucgugcuucuguacaccuucacagcugcaaacgccgacacuuugugcauuggcuaucacgcgaauaacagcacggauaccgucgacacaguuuuagagaagaaugugacuguaacccauuccgugaaccugcuagaagauagacacaaugggaagcucuguaaacugaggggagucgcuccccuucaucuggguaagugcaacauagccggcugguugcucgggaauccugagugugaacugcuguuuacagcaucuucauggaguuacaucguggagaccagcaacuccgacaauggaacuugcuauccaggcgauuucauuaacuacgaagaacuccgggagcaguuaucuucgguuucuagcuuugaacgcuucgagaucuuuccgaaagccaguuccuggcccgaccacgaaacaaaucgaggugugaccgcugcauguccuuaugccggggcuaacucuuucuaccguaaucugauuuggcuugucaagaagggaaacagcuauccaaaauuguccaagucauacgugaauaacaaagagaaggagguacugguucuauggggcauccaucaucccccuacgaguacugaucaacagagccucuaccagaacgccgacgcguauguguuugucggcucauccaaauacaauaagaaguucaaaccagaaauagcaaccagacccaaggugagggggcaggccggacggaugaacuauuacuggacacugguggagccuggugauacuaucaccuuugaagcuacaggcaaucuugucguuccacgcuaugccuucgcaaugaaaagagggucaggaagcggcauuaucauuagugacaccccggugcacgauugcaacacgacuugucaaacacccaagggugcuaucaauaccucucugccuuuucagaacauacacccaguaacuauuggggagugccccaaauacgugaaguccacaaaauugaggauggccaccggacuccggaauaucccuagcauucagucgcgcggccuguucggcgcgaucgccggguuuaucgaaggagguuggacgggcaugauugacgggugguauggauaccaccaucagaacgagcaaggcucugguuacgcagcugaucagaaguccacccagaaugccauagacgggaucacaaacaaggucaauucagugauugagaaaaugaacacucaguucaccgcuguuggcaaggaguucaaucacuuagagaaacgaaucgaaaaccugaauaagaaaguggacgauggauuucucgacgucuggacauauaacgccgagcuucugguguugcuagaaaacgagagaacucuggauuaccacgacaguaauguaaagaaccucuaugagaagguuaggagccaacugaaaaauaacgcaaaggaaauaggcaauggguguuucgaguuuuaccauaaaugcgaugacaccuguauggaauccgugaagaacggaacauaugauuacccaaaauauucugaggaaagcaaacuuaaucgggaggagauugacggugucaagcuggaaucaacccguaucuaccagaucuuggccauuuacaguacuguggcuuccagccucguccuguuagugucucugggcgcgaucucauucuggaugugcaguaacgggagccuacagugccgcauuuguauauga

SEQ ID NO: 124717 - RNA, 1701 nt, Artificial Sequence
  derived and/or modified sequence opt3 from hemagglutinin__InfluenzaA__ACQ89900
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuguggagaaaaugaauacgcaguuuaccgcugucgguaaggaguucaaccaccuggaaaagcggauagaaaauuuaaacaaaaagguggaugacggguuccuggauauuuggacauacaaugccgagcuccuuguacuguuggaaaacgagcgcacucuagacuaucaugauucaaauguuaaaaaccuguacgagaaggugcgaagucagcucaaaaacaaugcaaaggaaaucggcaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacuaggauuuaucaaauccuggcuauuuacucaaccgucgcgaguagcuuggugcucguugugucccugggagcaauaucuuuuuggaugugcucgaacgguagcuuacagugccggaucuguauuuga

SEQ ID NO: 124718 - RNA, 1701 nt, Artificial Sequence; identical to SEQ ID NO: 124685
  derived and/or modified sequence opt3 from hemagglutinin__InfluenzaA__ACQ89902

SEQ ID NO: 124719 - RNA, 1701 nt, Artificial Sequence
  derived and/or modified sequence opt3 from hemagglutinin__InfluenzaA__ACQ89904
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaagggaacuugcuauccaggcgauuuuaucgacuacgaggagcucagggagcagcugagcaguguguccucuuucgaacgguuugagauuuucccgaagacaagcuccuggcccaaccacgauucaaauaaaggugucaccgccgcuuguccucaugcaggggccaagaguuuuuauaaaaaccugaucuggcucgugaagaaaggaaauagcuacccaaaguuaucuaaguccuauauaaacgacaaaggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaucuagucguuccuagguacgcuuuugccauggaacggaacgcagggagcggaaucauaauuucggauaccccagugcaugacugcaacacaaccugucaaacgccgaagggcgcuaucaauacuucucuccccuuccagaacauucacccuaucacaaucgguaagugcccaaaauauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacgagaucacgaacaaaguuaauucugugauagagaagaugaacacccaguuuacagcuguggguaaggaguucaaucaccuggaaaaacggauugaaaacuuaaauaagaaagucgaugacggguuccuggauaucuggacuuacaacgccgagcuccuugugcuguuggaaaaugagcgcacccuagacuaucaugauagcaacguaaagaaucuguacgagaaaguucgaucacagcucaagaacaacgcaaaggaaaucggcaauggauguuuugaguucuaucacaaaugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 124720 - RNA, 1701 nt, Artificial Sequence; identical to SEQ ID NO: 124717
  derived and/or modified sequence opt3 from hemagglutinin__InfluenzaA__ACQ89905

SEQ ID NO: 124721 - RNA, 1701 nt, Artificial Sequence; identical to SEQ ID NO: 124672
  derived and/or modified sequence opt3 from hemagglutinin__InfluenzaA__ACQ99607

SEQ ID NO: 124722 - RNA, 1701 nt, Artificial Sequence; identical to SEQ ID NO: 124672
  derived and/or modified sequence opt3 from hemagglutinin__InfluenzaA__ACQ99608

SEQ ID NO: 124723 - RNA, 1701 nt, Artificial Sequence; identical to SEQ ID NO: 124672
  derived and/or modified sequence opt3 from hemagglutinin__InfluenzaA__ACQ99609

SEQ ID NO: 124724 - RNA, 1701 nt, Artificial Sequence; identical to SEQ ID NO: 124672
  derived and/or modified sequence opt3 from hemagglutinin__InfluenzaA__ACQ99611

SEQ ID NO: 124725 - RNA, 1701 nt, Artificial Sequence
  derived and/or modified sequence opt3 from hemagglutinin__InfluenzaA__ACQ99614
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuuauccuguuggaaaacgagcgcacucuagacuaucaugauucaaaugugaaaaaccuguacgagaagguacgaagucagcucaaaaacaaugcaaaggaaauuggcaacggauguuuugaguucuaucacaagugcgacaauaccuguauggaauccguuaaaaacggcacauacgauuauccuaaguacagcgaggaagccaaacugaauagagaggagaucgacggggugaaacuugaaucuacuaggauuuaucaaauacuggcuaucuacucaaccgucgcgaguagcuuggugcucgucgugucccugggagcaauuucuuuuuggaugugcucgaacgguagcuuacagugccggaucuguaucuga

SEQ ID NO: 124726 - RNA, 1701 nt, Artificial Sequence; identical to SEQ ID NO: 124725
  derived and/or modified sequence opt3 from hemagglutinin__InfluenzaA__ACQ99616

SEQ ID NO: 124727 - RNA, 1701 nt, Artificial Sequence; identical to SEQ ID NO: 124672
  derived and/or modified sequence opt3 from hemagglutinin__InfluenzaA__ACQ99617

SEQ ID NO: 124728 - RNA, 1701 nt, Artificial Sequence; identical to SEQ ID NO: 124672
  derived and/or modified sequence opt3 from hemagglutinin__InfluenzaA__ACQ99618

SEQ ID NO: 124729 - RNA, 1701 nt, Artificial Sequence; identical to SEQ ID NO: 124672
  derived and/or modified sequence opt3 from hemagglutinin__InfluenzaA__ACQ99619

SEQ ID NO: 124730 - RNA, 1701 nt, Artificial Sequence; identical to SEQ ID NO: 124672
  derived and/or modified sequence opt3 from hemagglutinin__InfluenzaA__ACQ99620

SEQ ID NO: 124731 - RNA, 1701 nt, Artificial Sequence; identical to SEQ ID NO: 124725
  derived and/or modified sequence opt3 from hemagglutinin__InfluenzaA__ACQ99621

SEQ ID NO: 124732 - RNA, 1701 nt, Artificial Sequence; identical to SEQ ID NO: 124672
  derived and/or modified sequence opt3 from hemagglutinin__InfluenzaA__ACQ99622

SEQ ID NO: 124733 - RNA, 1701 nt, Artificial Sequence
  derived and/or modified sequence opt3 from hemagglutinin__InfluenzaA__ACR01014
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauggaaaauuuaaacaaaaaggucgaugacggguuccuggauauuuggacauacaaugccgagcuccuugugcuguuggaaaacgagcgcacucuagacuaucaugauucaaauguaaagaaccuguacgagaagguucgaagucagcucaaaaacaaugcaaaggaaaucggcaacggauguuuugaguucuaucacaagugcgacaauaccuguauggaauccgugaaaaacggcacauacgauuauccuaaguacagcgaggaagccaaacugaauagagaggagaucgacggggucaaacuugaaucuacuaggauuuaucaaauccuggcuauuuacucaaccguggcgaguagcuugguccucgugguuucccugggagcaauaucuuuuuggaugugcucgaacgguagcuuacagugccggaucuguauuuga

SEQ ID NO: 124734 - RNA, 1701 nt, Artificial Sequence; identical to SEQ ID NO: 124685
  derived and/or modified sequence opt3 from hemagglutinin__InfluenzaA__ACR08419

SEQ ID NO: 124735 - RNA, 1701 nt, Artificial Sequence
  derived and/or modified sequence opt3 from hemagglutinin__InfluenzaA__ACR08429
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacaccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 124736 - RNA, 1701 nt, Artificial Sequence; identical to SEQ ID NO: 124685
  derived and/or modified sequence opt3 from hemagglutinin__InfluenzaA__ACR08439

SEQ ID NO: 124737 - RNA, 1701 nt, Artificial Sequence; identical to SEQ ID NO: 124685
  derived and/or modified sequence opt3 from hemagglutinin__InfluenzaA__ACR08449

SEQ ID NO: 124738 - RNA, 1701 nt, Artificial Sequence
  derived and/or modified sequence opt3 from hemagglutinin__InfluenzaA__ACR08459
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcgacaccacaugucaaaccccgaaaggcgcuaucaauacgucccuccccuuccagaacauucacccuaucacuaucgguaagugcccaaaguauguaaaaucaacaaagcugcgccuugccaccgggcugagaaaugugcccaguauucagagcaggggauuguuuggcgcgauagccggcuucaucgaagggggauggacugguauggucgauggcugguacggguaucaucaccagaacgaacaaggauccggcuacgcagcugaccucaaaucuacacagaaugccauugaugagaucaccaacaaggugaauagcguuauagagaaaaugaacacgcaguuuaccgcuguggguaaggaguucaaucaccuggaaaagcggauugaaaacuuaaauaaaaaggucgacgauggguuccuggacaucuggacauacaacgccgagcuccuugugcuguuggaaaaugagcgcacucuagauuaucaugacucaaacguaaagaaucuguacgagaagguucgaagucagcucaaaaacaacgcaaaggaaaucggcaauggauguuuugaguucuaucacaagugcgauaacaccuguauggaauccgugaaaaauggcacauacgacuauccuaaguacagcgaggaagccaaacugaacagagaggagauugauggggucaaacuugaaucuacuaggaucuaucaaauucuggcuauauacucaaccguggcgaguagcuugguccucgugguuucccugggagcaaucucuuuuuggaugugcucgaaugguagcuuacagugccggauuuguaucuga

SEQ ID NO: 124739 - RNA, 1701 nt, Artificial Sequence; identical to SEQ ID NO: 124672
  derived and/or modified sequence opt3 from hemagglutinin__InfluenzaA__ACR08528

SEQ ID NO: 124740 - RNA, 1701 nt, Artificial Sequence; identical to SEQ ID NO: 124672
  derived and/or modified sequence opt3 from hemagglutinin__InfluenzaA__ACR08530

SEQ ID NO: 124741 - RNA, 1701 nt, Artificial Sequence; identical to SEQ ID NO: 124738
  derived and/or modified sequence opt3 from hemagglutinin__InfluenzaA__ACR08531

SEQ ID NO: 124742 - RNA, 1701 nt, Artificial Sequence; identical to SEQ ID NO: 124685
  derived and/or modified sequence opt3 from hemagglutinin__InfluenzaA__ACR08533

SEQ ID NO: 124743 - RNA, 1701 nt, Artificial Sequence; identical to SEQ ID NO: 124738
  derived and/or modified sequence opt3 from hemagglutinin__InfluenzaA__ACR08535

SEQ ID NO: 124744 - RNA, 1701 nt, Artificial Sequence; identical to SEQ ID NO: 124685
  derived and/or modified sequence opt3 from hemagglutinin__InfluenzaA__ACR08536

SEQ ID NO: 124745 - RNA, 1701 nt, Artificial Sequence; identical to SEQ ID NO: 124738
  derived and/or modified sequence opt3 from hemagglutinin__InfluenzaA__ACR08537

SEQ ID NO: 124746 - RNA, 1701 nt, Artificial Sequence; identical to SEQ ID NO: 124738
  derived and/or modified sequence opt3 from hemagglutinin__InfluenzaA__ACR08538

SEQ ID NO: 124747 - RNA, 1701 nt, Artificial Sequence; identical to SEQ ID NO: 124685
  derived and/or modified sequence opt3 from hemagglutinin__InfluenzaA__ACR08539

SEQ ID NO: 124748 - RNA, 1701 nt, Artificial Sequence; identical to SEQ ID NO: 124685
  derived and/or modified sequence opt3 from hemagglutinin__InfluenzaA__ACR08540

SEQ ID NO: 124749 - RNA, 1701 nt, Artificial Sequence; identical to SEQ ID NO: 124672
  derived and/or modified sequence opt3 from hemagglutinin__InfluenzaA__ACR08542

SEQ ID NO: 124750 - RNA, 1701 nt, Artificial Sequence; identical to SEQ ID NO: 124672
  derived and/or modified sequence opt3 from hemagglutinin__InfluenzaA__ACR08543

SEQ ID NO: 124751 - RNA, 1701 nt, Artificial Sequence; identical to SEQ ID NO: 124711
  derived and/or modified sequence opt3 from hemagglutinin__InfluenzaA__ACR08544

SEQ ID NO: 124752 - RNA, 1701 nt, Artificial Sequence; identical to SEQ ID NO: 124738
  derived and/or modified sequence opt3 from hemagglutinin__InfluenzaA__ACR08545

SEQ ID NO: 124753 - RNA, 1701 nt, Artificial Sequence; identical to SEQ ID NO: 124672
  derived and/or modified sequence opt3 from hemagglutinin__InfluenzaA__ACR08546

SEQ ID NO: 124754 - RNA, 1701 nt, Artificial Sequence; identical to SEQ ID NO: 124685
  derived and/or modified sequence opt3 from hemagglutinin__InfluenzaA__ACR08547

SEQ ID NO: 124755 - RNA, 1701 nt, Artificial Sequence; identical to SEQ ID NO: 124738
  derived and/or modified sequence opt3 from hemagglutinin__InfluenzaA__ACR08548

SEQ ID NO: 124756 - RNA, 1701 nt, Artificial Sequence; identical to SEQ ID NO: 124685
  derived and/or modified sequence opt3 from hemagglutinin__InfluenzaA__ACR08549

SEQ ID NO: 124757 - RNA, 1701 nt, Artificial Sequence; identical to SEQ ID NO: 124685
  derived and/or modified sequence opt3 from hemagglutinin__InfluenzaA__ACR08550

SEQ ID NO: 124758 - RNA, 1701 nt, Artificial Sequence; identical to SEQ ID NO: 124685
  derived and/or modified sequence opt3 from hemagglutinin__InfluenzaA__ACR08551

SEQ ID NO: 124759 - RNA, 1701 nt, Artificial Sequence; identical to SEQ ID NO: 124672
  derived and/or modified sequence opt3 from hemagglutinin__InfluenzaA__ACR08552

SEQ ID NO: 124760 - RNA, 1701 nt, Artificial Sequence; identical to SEQ ID NO: 124711
  derived and/or modified sequence opt3 from hemagglutinin__InfluenzaA__ACR08553

SEQ ID NO: 124761 - RNA, 1701 nt, Artificial Sequence; identical to SEQ ID NO: 124711
  derived and/or modified sequence opt3 from hemagglutinin__InfluenzaA__ACR08554

SEQ ID NO: 124762 - RNA, 1701 nt, Artificial Sequence; identical to SEQ ID NO: 124672
  derived and/or modified sequence opt3 from hemagglutinin__InfluenzaA__ACR09365

SEQ ID NO: 124763 - RNA, 1701 nt, Artificial Sequence; identical to SEQ ID NO: 124672
  derived and/or modified sequence opt3 from hemagglutinin__InfluenzaA__ACR09366

SEQ ID NO: 124764 - RNA, 1701 nt, Artificial Sequence; identical to SEQ ID NO: 124672
  derived and/or modified sequence opt3 from hemagglutinin__InfluenzaA__ACR09367

SEQ ID NO: 124765 - RNA, 1701 nt, Artificial Sequence; identical to SEQ ID NO: 124672
  derived and/or modified sequence opt3 from hemagglutinin__InfluenzaA__ACR09368

SEQ ID NO: 124766 - RNA, 1701 nt, Artificial Sequence; identical to SEQ ID NO: 124672
  derived and/or modified sequence opt3 from hemagglutinin__InfluenzaA__ACR09369

SEQ ID NO: 124767 - RNA, 1701 nt, Artificial Sequence; identical to SEQ ID NO: 124672
  derived and/or modified sequence opt3 from hemagglutinin__InfluenzaA__ACR09370

SEQ ID NO: 124768 - RNA, 1701 nt, Artificial Sequence; identical to SEQ ID NO: 124672
  derived and/or modified sequence opt3 from hemagglutinin__InfluenzaA__ACR09371

SEQ ID NO: 124769 - RNA, 1701 nt, Artificial Sequence; identical to SEQ ID NO: 124672
  derived and/or modified sequence opt3 from hemagglutinin__InfluenzaA__ACR09373

SEQ ID NO: 124770 - RNA, 1701 nt, Artificial Sequence; identical to SEQ ID NO: 124672
  derived and/or modified sequence opt3 from hemagglutinin__InfluenzaA__ACR09374

SEQ ID NO: 124771 - RNA, 1701 nt, Artificial Sequence
  derived and/or modified sequence opt3 from hemagglutinin__InfluenzaA__ACR09375
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggagaaaaacgcagggucgggaaucauaauuucugauacuccagugcaugacugcaauaccacaugucaaaccccgaagggcgcuaucaacacgucccuccccuuccagaauauucacccuaucacuaucgguaagugcccaaaauauguaaagucaacaaaacugcggcuugccaccgggcugcgcaacgugcccaguauucagagcagaggauuguuuggcgcgauagccggcuucaucgaagggggauggacugguauggucgacggcugguacggguaucaucaccagaaugaacaaggauccggcuacgcagcugaucucaagucuacacagaacgccauugacgagaucaccaauaaagugaacagcguuauagagaagaugaauacgcaguuuaccgcuguggguaaggaguucaaccaccuggagaaaaggauugaaaauuuaaacaagaaagucgaugacggguuccuggauaucuggacauacaaugccgagcuccuugugcuguuggaaaacgagcggacucuagacuaucaugauucaaauguaaagaaccuguacgagaaaguucgcagucagcucaagaacaaugcaaaggaaaucggcaacggauguuuugaguucuaucacaaaugcgacaauaccuguauggaauccgugaagaacggcacauacgauuauccuaaauacagcgaggaagccaagcugaaucgagaggagauugacggggucaaacuugaaucuacuagaaucuaucaaauucuggcuauauacucaaccguggcgaguagcuugguccucgugguuucccugggagcaaucucuuuuuggaugugcucgaacgguagcuuacagugcaggauuuguaucuga

SEQ ID NO: 124772 - RNA, 1701 nt, Artificial Sequence; identical to SEQ ID NO: 124672
  derived and/or modified sequence opt3 from hemagglutinin__InfluenzaA__ACR09376

SEQ ID NO: 124773 - RNA, 1701 nt, Artificial Sequence; identical to SEQ ID NO: 124672
  derived and/or modified sequence opt3 from hemagglutinin__InfluenzaA__ACR09377

SEQ ID NO: 124774 - RNA, 1701 nt, Artificial Sequence; identical to SEQ ID NO: 124672
  derived and/or modified sequence opt3 from hemagglutinin__InfluenzaA__ACR09395

SEQ ID NO: 124775 - RNA, 1701 nt, Artificial Sequence; identical to SEQ ID NO: 124672
  derived and/or modified sequence opt3 from hemagglutinin__InfluenzaA__ACR09396

SEQ ID NO: 124776 - RNA, 1701 nt, Artificial Sequence
  derived and/or modified sequence opt3 from hemagglutinin__InfluenzaA__ACR10186
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaagaucgaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 124777 - RNA, 1701 nt, Artificial Sequence; identical to SEQ ID NO: 124776
  derived and/or modified sequence opt3 from hemagglutinin__InfluenzaA__ACR10222

SEQ ID NO: 124778 - RNA, 1701 nt, Artificial Sequence
  derived and/or modified sequence opt3 from hemagglutinin__InfluenzaA__ACR10223
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggucuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguaaagaaccuguacgagaagguucgaagucagcucaaaaacaaugccaaggaaaucggcaacggauguuuugaguucuaucacaagugcgacaauacauguauggaauccgugaaaaacggcacuuacgauuauccuaaguacagcgaggaagcaaaacugaauagagaggagauugacggggucaaacuugaaucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 124779 - RNA, 1701 nt, Artificial Sequence
  derived and/or modified sequence opt3 from hemagglutinin__InfluenzaA__ACR15183
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggggcuccgacaacucauuuuucagucgccugaauuggcucacucauuuaaaguuuaaauauccagcacugaacgugaccaugcccaauaacgagaaguucgauaaacuuuacaucuggggcguccaccauccugggacagacaacgaucagauuuuuccauaugcccaggcuagcggacgaaucacugugucuaccaagcguucccaacagacaguaauucccaauaucgguucaagaccuaggguucggaacauaccaagccgcauuaguaucuacuggaccauugugaaaccgggcgacaucuugcugaucaauucuacggggaaccuaauugcccccagaggauacuucaagauaagguccggcaagagcucgaucaugcggucugacgcgccuauugguaaauguaauuccgagugcaucacuccaaacgggucaauacccaaugauaagccuuuucagaacgucaaucgcauuacauauggagcauguccacgauacgugaaacagaacacccucaagcuggccacuggcaugagaaaugugcccgaaaaacaaacaaggggcaucuucggggcuaucgccggauuuauugagaacgguugggaaggcauggucgacgggugguauggauuccggcaccagaauagugagggcaucggucaggcagcugaucuuaagagcacccaagccgcgauuaaccagauaaaugggaaacugaaccguuugaucggcaagacgaacgagaaguuccaccagauugaaaaagaguuuuccgaaguugagggacgcauccaggaccucgaaaaguacguggaggauaccaaaaucgaccuguggucuuauaaugccgaguuacugguagcacucgaaaaccaacauacaauugaucuuacugacagcgagaugaauaagcuguucgaaagaaccaaaaagcaguugagggagaacgcugaagauaugggcaaugggugcuuuaagauauaccacaaaugugacaacgccugcaucggaucaauucggaaugguacauaugaucaugacguguaccgagacgaggcucuaaacaaucgcuuccagaucaagggcgucgagcugaaaaguggguacaaggauuggauucucuggaucuccuuugccauaagcugcuuccugcuuuguguggcacuguugggauuuaucaugugggccugccagaaaggcaacauuagauguaauaucugcauuuga

SEQ ID NO: 124780 - RNA, 1698 nt, Artificial Sequence
  derived and/or modified sequence opt3 from hemagglutinin__InfluenzaA__ACR15194
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucgggaaucagaaagcccuguaccauacggagaacgcuuacgucuccguggugucaagccacuauagucgcaaguucacucccgaaauagcaaagcgaccuaaaguccgugaccaggagggaagaaucaauuacuauuggacccuucuggagccaggugauacaauuaucuuugaagccaacggcaauuugauugcuccgagguacgccuucgcgcucucucgggggcugggauccggcaucauaaacagcaaugcacccauggacaagugugaugccaaaugccagacuccucaaggugcuauuaacucgucuuuaccauuucagaauguucaucccgugaccaucggggaguguccuaaguauguacgcuccgccaaacugagaauggugacaggacucaggaacauuccaucaauccagagucggggccuuuucggcgcaaucgcuggguuuauugaaggagguuggaccggcauggucgacgggugguacggauaucaccaccagaaugagcaaggcagcgguuacgccgcggaucagaaguccacgcagaacgccauaaaugggaucacuaacaaaguaaauucuguuauugaaaagaugaacacacaguucaccgcagugggcaaggaguuuaacaaacuggagcgccgaauggaaaauuugaacaagaaagucgacgauggauucaucgacauauggacuuacaaugcugagcuacuggugcuccuggaaaacgagagaacacuugauuuccaugacagcaauguaaagaaccuguaugaaaaaguuaagucacaauugaagaauaacgccaaagagauuggcaauaggugcuuugaguucuaccacaaguguaacgacgaaugcauggagagugugaaaaaugggaccuaugauuaccccaaguauuccgaagagagcaaacucaaccgggagaagaucgacggagucaagcuggaaucuauggguguguaccagaucuuagcuauuuauucaacggucgccaguagccuggugcuacucguuucccugggcgcaaucucuuuuuggaugugcucgaaugggagccuucagugucguauuugcauauga

SEQ ID NO: 124781 - RNA, 1698 nt, Artificial Sequence; identical to SEQ ID NO: 122886
  derived and/or modified sequence opt3 from hemagglutinin__InfluenzaA__ACR15216

SEQ ID NO: 124782 - RNA, 1701 nt, Artificial Sequence
  derived and/or modified sequence opt3 from hemagglutinin__InfluenzaA__ACR15227
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugccagcggcgcuccaacaagucauuuuucagucgacugaauuggcucacucauuuaaaguuuaaauauccagcacugaacgugaccaugcccaauaacgagaaguucgacaaacuuuacaucuggggcguccaccauccuggcacagauaacgaccagauuagcuuguaugcccaaacuucugggcguaucaccguguccacaaagagaucacagcagaccguaauuccaaauaucggaagcaggccccggguucgcgaugugccuaguagaauaucuauuuacuggacgaucgucaaaccaggugacauucugcuaaucaacuccacuggcaaucucaucgcuccgaggggguacuuuaagauucggagcggaaagucgucuauaaugcgcuccgacgcccccaucggcaaauguaacucagagugcauuacaccuaaugguaguaucccaaacgauaagcccuuccagaaugugaaccgaauaaccuauggggcguguccuagauacgugaaacaaaauacucugaaacuugcaacaggaaugaggaacgucccagaacggcagacccguggcauuuuuggcgccaucgcuggguucaucgagaauggaugggaagguaugauggacggcugguauggguuucgccaccagaacagcgagggaacgggccaagccgcagaucugaaguccacccaggcugccauuaaucagaucaacgguaaguugaauagacucauugggaaaacaaacgagaaguuccaccagauagaaaaggaguucucugaaguugagggcaggauccaagaccuggaaaaauacguggaggauacuaagauugacuuauggagcuauaacgcggagcugcucguagcccuugaaaaucagcauaccaucgaucugacagacucagagaugaacaaauuguuugaacggacuaagaaacagcuacgagagaaugcagaagauaugggaaacggcugcuucaagaucuaccacaagugugacaaugcuugcauugggaguauacgcaacggaaccuaugaucaugacguguacagagacgaggcccugaauaacagguuucagaucaaaggugucgagcucaaguccggcuacaaagauuggauucuguggaucagcuucgcuauuucuugcuuucuucuguguguggccuugcucggguucaucaugugggcaugccaaaagggaaauauacgguguaacaucugcauuuga

SEQ ID NO: 124783 - RNA, 1698 nt, Artificial Sequence
  derived and/or modified sequence opt3 from hemagglutinin__InfluenzaA__ACR15238
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgggguccagaaagcccuguaccauacggagaaugcuuacguguccguggucucaagccacuauagucgcaaguucacucccgaaauagcaaagcgaccuaaaguucgugaccaggagggaagaaucaacuacuauuggacccuucuggagccaggugauacaauuaucuuugaagccaauggcaacuugauugcuccgagguacgccuucgcgcucucucggggguuuggauccggcaucauaaauagcaacgcacccauggacaagugugaugccaaaugccagacuccucaaggugcuauuaauucgucucugccauuccagaacgugcaucccguaaccaucggggaguguccuaaguaugugcgcuccgccaaauuaagaauggucacaggacugaggaauauuccaucaauccagagucggggccucuuuggcgcaaucgcuggguucauugaaggagguuggaccggcaugguggacgggugguacggauaucagcaccaaaacgagcagggcagcgguuacgccgcggaucagaaguccacgcagaaugccauaaacgggaucacuaauaaaguuaacucugugauugaaaagaugaauacacaauuuaccgcagucggcaaggaguucaacaaacuugagcgccgaauggaaaaccugaauaagaaaguggacgauggauucaucgacauauggacuuacaacgcugaguugcuaguacugcucgaaaaugagagaacacuggauuuucacgacagcaacguuaagaaucuuuaugaaaaagugaagucacagcugaagaacaaugccaaagagauuggcaacgggugcuucgaguuuuaccauaaguguaaugacgaaugcauggagagugucaaaaacggaaccuaugauuaccccaaguauuccgaagagagcaaauugaauagggagaagaucgacggugugaagcucgaaucuaugggcgucuaccagauccuggcuauuuauucaacgguggccaguagcuuaguucugcuagugucccucggggcaaucucuuucuggaugugcucgaacggaagccugcaaugucggauuugcauauga

SEQ ID NO: 124784 - RNA, 1701 nt, Artificial Sequence
  derived and/or modified sequence opt3 from hemagglutinin__InfluenzaA__ACR15249
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauagcaaguuuaaguauccagcauuaaaugugaccaugcccaacaacgagaaauucgacaagcuguacauuuggggaguccaccauccuggcacagauaaugaccagaucuuucuuuaugcccaggcuucuggccguauuacuguguccaccaaaagaucacaacagacaguaaucccaaacauagggagcaggccccggguucgcaauauuccuaguagaaucucuauuuacuggaccaucgugaagccaggagauaucuugcugauuaacuccacggguaaucuaauagccccgaggggcuacuucaaaauccggagcgggaagucgucuauuaugcgcuccgacgcgcccaucggaaaguguaacucagaaugcauaacuccuaauggcaguauuccaaacgacaaacccuuucagaaugucaaccgaaucacauauggugcauguccuagauacgugaagcagaauacccucaaacuggccacugggaugaggaacgugccagagaagcaaacacggggaaucuucggcgcuauugccggcuuuaucgaaaaugggugggagggaauggucgaugguugguauggcuuccgucaccagaacagcgaggggauuggacaggcagcugaccuuaaauccacccaagccgcgauagaucagaucaauggcaagcugaaccgcuugauugguaaaacgaacgaaaaguuccaccagaucgagaaggaauuuucugagguugaagggagaauccaggaccucgagaaauacguggaggauaccaagauugaccuguggagcuauaaugccgaauuacugguagcacucgagaaccaacauacaauagaucuuacugacucagaaaugaauaaacuguucgagaagaccaaaaagcaguugagggaaaacgcugaggauaugggcaauggaugcuuuaagaucuaccacaaaugugacaacgccugcauuggcaguauccggaaugggacauaugaucaugacguguaccgagacgaggcucuaaacaaucgcuuccagauuaagggagucgaacugaaauccgguuacaaggauuggauccucuggaucagcuuugccauaucuugcuuccugcuuuguguggcacuguugggcuuuauuaugugggccugccagaaagggaacaucagauguaauauuugcaucuga

SEQ ID NO: 124785 - RNA, 1701 nt, Artificial Sequence
  derived and/or modified sequence opt3 from hemagglutinin__InfluenzaA__ACR15282
augaagaccaucauugcccugagcuacauacucugccuuguguucgcucagaaacugcccggcaacgacaauuccacagcaacuuuguguuuagggcaccaugccgucccuaacggaacgaucguuaagaccauuaugaaugaucaaaucgaggugacaaacgcgacugaacugguacagucuucaaguaccggugagauuugcgacagcccacaccagauccuagauggcgaaaauuguacacucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacccuggaauuuaacaaugaguccuucaacuggacugguguuacacagaaugggaccucuagcgcuugcauccggcgcuccaacaauucauuuuucagucgacugaacuggcucacgcauagcaaguuuaaguauccagcauuaaaugugacuaugcccaacaacgagaaauucgacaagcuguacauuuggggaguccaccauccuggcaccgauaaugaccagaucuuucuuuaugcccaggcuucuggccguauuacaguguccacuaaaagaucacaacagaccguaaucccaaacauagggagcaggccccggguucgcaauauuccuaguagaaucucuauuuacuggacaaucgugaagccaggagauaucuugcugauuaacuccaccgguaaucuaauagccccgaggggcuacuucaaaauccggagcgggaagucgucuauuaugcgcuccgacgcgcccaucggaaaguguaacucagaaugcauaacgccuaauggcaguauuccaaacgacaaacccuuucagaaugucaaccgaaucacuuauggugcauguccuagauacgugaagcagaauacacucaaacuggccaccgggaugaggaacgugccagagaagcaaacucggggaaucuucggcgcuauugccggcuuuaucgaaaaugggugggagggaauggucgaugguugguauggcuuccgucaccagaacagcgaggggauuggacaggcagcugaccuuaaauccacacaagccgcgauagaucagaucaauggcaagcugaaccgcuugauugguaaaaccaacgaaaaguuccaccagaucgagaaggaauuuucugagguugaagggagaauccaggaccucgagaaauacguggaggauacgaagauugaccuguggagcuauaaugccgaauuacugguagcacucgagaaccaacauaccauagaucuuacagacucagaaaugaauaaacuguucgagaagacuaaaaagcaguugagggaaaacgcugaggauaugggcaauggaugcuuuaagaucuaccacaaaugugacaacgccugcauuggcaguauccggaaugggaccuaugaucaugacguguaccgagacgaggcucuaaacaaucgcuuccagauuaagggagucgaacugaaauccgguuacaaggauuggauccucuggaucagcuuugccauaucuugcuuccugcuuuguguggcacuguugggcuuuauuaugugggccugccagaaagggaacaucagauguaauauuugcaucuga

SEQ ID NO: 124786 - RNA, 1701 nt, Artificial Sequence
  derived and/or modified sequence opt3 from hemagglutinin__InfluenzaA__ACR15293
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaaaacuucaauuggacaggggugacccagaacggaacguccucugcuugcaagcggggcagcgacaauuccuuuuucucacgccugaacuggcucacucauuuaaaguuuaaauauccagcacugaagguuaccaugcccaauaacgagaaauucgauaaacuuuacauuuggggcgugcaccauccugggacagacaacgaucagaucuuuuuguaugcccaggcuaguggacgaauuacugucagcaccaagcguucucaacagacagugaucccaaauauagguuccagacccaggguacggaacauuccuucacgcaucagcauuuacuggaccaucguuaagccaggcgacauccugcuaauuaauaguacggggaaccucauagccccgagaggauacuucaagaucaggucuggcaaauccagcauuaugcggucggacgcgcccaucgguaaguguaauucugagugcauaacuccuaacggguccauuccaaaugauaaacccuuucagaacgugaaucgcaucacauauggagcauguccucgauacgucaagcagaacacccugaaacuugccacuggcaugagaaaugugccagaaaagcaaacaaggggcaucuucggggcuauugccggauuuaucgagaacgguugggaaggcaugguggacgggugguauggauuccggcaccaaaauucagagggcauuggucaggcagcugaucugaaaaguacccaggccgcgauaaaccagaucaaugggaaguugaaccgucucauuggcaagacgaacgagaaauuccaccagaucgaaaaggaguuuagcgaagucgagggacgcauccaggaccuggaaaaauacguugaggauaccaagauugacuuaugguccuauaaugccgagcugcucguggcacuugaaaaccaacauacaauagaucugacugacucugagaugaauaaauuguucgaaagaaccaagaagcagcuaagggagaacgcugaagauaugggcaaugggugcuuuaaaaucuaccacaagugugacaacgccugcauuggaagcauccggaaugguacauaugaucaugacguauaccgagacgaggcucugaacaaucgcuuccagauuaaaggcguggagcucaagucaggguacaaagauuggauccuguggauaaguuuugccaucuccugcuuccuucugugugucgcauugcucggauuuauuaugugggccugccagaagggcaacaucagauguaauauuugcaucuga

SEQ ID NO: 124787 - RNA, 1698 nt, Artificial Sequence
  derived and/or modified sequence opt3 from hemagglutinin__InfluenzaA__ACR15304
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggagaguuccuggccaaaucauacagugaccggugucucugcaagcugcucccacaacgggaagucaaguuuuuaccggaauuuacuguggcuuacgggcaaaaacggauuguaucccaaucugagcaagucuuacgccaacaauaaagaaaaggaggugcuaguacucuggggcguucaucacccuccaaacacugggaaccagcgcgcucuguaccacaccgaaaaugcauauguguccgucgugucaagccauuacagucgacguuucacacccgagaucgccaaaagaccuaaggugagggaucaggaaggacggauaaacuauuacuggacucuucuggagccaggugacaccaucauuuuugaggcuaauggcaacuugaucgccccgugguaugcguucgcacucucucgcggguuuggauccggcauuaucacaagcaaugcccccauggaugaaugugacgcuaagugccagaccccucaaggugccauaaacucgucucugccauuccagaauguccaccccguuacgauuggggaguguccuaaauacgugagauccgcaaaguuaaggaugguaacuggacugcggaacaucccaucaauucagagucgcggccucuuuggcgcuaucgccggguucaucgaaggagguuggacaggcaugguggaugggugguauggauaccaucaccagaaugagcaaggcagcgguuacgcggccgaccagaaauccacccagaacgcaauuaaugggauaacuaacaaggucaauucugugaucgaaaagaugaacacacaguuuaccgcuguuggcaaagaguucaaucgacuugagagaaggauggaaaaccugaacaaaaagguggaugacggauucuuggauauuuggacguauaaugccgagcuacugguccuccuggaaaacgagcggacccuugacuuucacgacagcaaugugaagaaccuguacgaaaaaguaaagucacaauugaaaaauaacgcuaaggagaucggcaaugggugcuucgaguuuuaucauaaauguaacaaugaaugcauggagaguguuaagaacggaacauacgauuaucccaaguacuccgaagagagcaaacucaaucgugagaagauagacggugugaaacuggaaucuaugggcgucuaucagauuuuagccaucuacucaacuguggcaaguagccugguccuacucgugucccugggggccaucucuuucuggaugugcucgaacggaagccuucagugucgcauuugcaucuga

SEQ ID NO: 124788 - RNA, 1698 nt, Artificial Sequence
  derived and/or modified sequence opt3 from hemagglutinin__InfluenzaA__ACR15315
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacauccgcgaucagcgagcccuguaccacacugagaacgcuuaugucuccguggugucaagccauuacagucguagauucacccccgaaauagcaaagaggccuaaaguccgggaccaggaggggcgcaucaauuauuacuggacacuucuggaaccaggugauacuauuaucuuugaggccaacggcaauuugauugcuccgugguaugccuucgcgcucucuagaggguuuggauccggcaucauaaccagcaacgcacccaugggugagugugacgccaagugccagacaccucaaggggcuauuaauucgucucugccauuccagaacguucaccccgugaccaucggagaauguccuaaguacguaagguccgccaaauuacggauggugacgggccugcgcaauauuccaucaauccagagucgaggccucuuuggggcaaucgcuggauucauugaggguggcuggacugggauggucgauggaugguauggcuaccaucaccagaacgaacaagguagcggguacgccgcggaccagaaguccacacagaaugccauaaacggcaucaccaauaaagugaacucuguuauugagaagaugaauacucaguuuacagcagugggaaaagaguucaacaagcuagaaagaaggauggagaaucugaacaaaaaggucgaugacggcuucuuggauaucuggaccuauaacgcugaacuacuggugcuccuggagaaugaacggacgcuugacuuucacgacagcaacguaaagaaucuguacgagaaaguuaagucacaauugaaaaacaaugccaaggaaauagggaacggaugcuucgaguuuuaucauaaauguaauaacgagugcauggaaagugugaagaaugguaccuacgauuaucccaaguacuccgaggaaagcaaacucaaccgugagaagauugacggcgucaaacuggagucuauggggguguaucagaucuuagcuaucuacucaacagucgccaguagccuggugcuacucguuucccugggagcaauuucuuucuggaugugcucgaauggcagccuucagugucgcaucugcauuuga

SEQ ID NO: 124789 - RNA, 1698 nt, Artificial Sequence
  derived and/or modified sequence opt3 from hemagglutinin__InfluenzaA__ACR15326
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuucaucuuucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucgggaaccagcgcgcccuguaccacacugagaaugcuuaugucuccguggugucaagccauuacagucgacguuucacccccgaaauagcaaagagaccuaaagucagggaucaggagggucggaucaacuauuacuggacacuucuggaaccaggcgacacuauuaucuuugaggccaaugggaacuugauugcuccgugguaugccuucgcgcucucucgcggauuuggcuccgguaucauaaccagcaaugcacccaugggggagugugaugaaaagugccagacaccucaaggagccauuaacucgucucugccauuccagaauguucaccccgugaccaucggcgaguguccuaaguacguaagauccgcuaaauuaaggauggugacgggccugcggaacauuccaucaauccagagucgcgggcucuuuggagccaucgcagguuucauugaaggcggguggacuggaauggucgacggcugguaugguuaccaucaccagaaugagcaagggagcggcuacgcugccgaucagaaguccacacagaacgcgauaaauggaaucaccaacaaagugaauagcguuauugaaaagaugaacacucaguuuacagccgugggcaaagaguucaauaagcuagagcgaagaauggaaaaccugaacaaaaaggucgacgauggguucuuggacaucuggaccuauaaugcagagcuacuggugcuccuggaaaacgagaggacgcuugauuuucacgacagcaauguaaagaaccuguacgaaaaaguuaagucacaauugaaaaauaacgcuaaggagauaggaaaugguugcuucgaguuuuaucauaaauguaacaaugaaugcauggagagugugaagaacggcaccuacgacuaucccaaguacuccgaagagagcaaacucaaucgggagaagauugauggggucaaacuggaaucuaugggaguguaucagaucuuagccaucuacucaacagucgcuaguagccuggugcuacucguuucccugggcgccauuucuuucuggaugugcucgaacgguagccuucagugucguaucugcauuuga

SEQ ID NO: 124790 - RNA, 1698 nt, Artificial Sequence
  derived and/or modified sequence opt3 from hemagglutinin__InfluenzaA__ACR15359
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcggacuccugauuaguaaagaaagcugguccuacaucguugagaagccaaacccggaaaauggcaccuguuaucccggucauuuugcugauuacgaggagcugagagaacaacucucuucggugagcucauucgagagguuugaaauuuucccuaaggagaguuccuggccaaaccacacugucacaggggugucugccagcugcucccauaauggagagucaaguuuuuaucggaacuuacuguggcuuaccggcaaaaauggcuuguaccccaaccugagcaagucuuaugcaaauaacaaagaaaaggagguucuaguacucuggggagugcaccacccuccaaacaucggggaccagaaagcccuguaccauacggaaaaugcuuacgucuccguggugucaagccacuauagucgcaaguucacucccgagauagcaaagcgaccuaaaguccgugaucaggaagguagaaucaacuacuauuggacccuucuggagccaggcgacacaauuaucuuugaggccaaugggaacuugauugcuccgagguacgccuucgcgcucucucggggauuuggcuccgguaucauaaauagcaacgcacccauggauaagugugacgccaaaugccagacuccucaaggggcuauuaauucgucucugccauuccagaacguucaucccgugaccaucggagaauguccuaaguauguacgcuccgccaaauuaagaauggugacaggccugaggaauauuccaucaauccagagucggggccucuuuggggcaaucgcuggauucauugaggguggcuggaccgggauggucgauggaugguacggcuaucaccaccagaacgaacaagguagcggguacgccgcggaccagaaguccacgcagaaugccauaaacggcaucacuaauaaagugaacucuguuauugagaagaugaauacacaguuuaccgcagugggaaaggaguucaacaaacuugaacgccgaauggagaaccugaauaagaaagucgaugacggcuucaucgauauauggacuuacaacgcugaauugcuagugcugcucgagaaugaaagaacacuggacuuucaugacagcaacguaaagaaucuuuaugagaaaguuaagucacaacugaagaacaaugccaaagaaauugggaacggaugcuucgaguuuuaccacaaguguaaugaugagugcauggaaagugugaaaaacgguaccuaugacuaccccaaguauuccgaggaaagcaaauugaauagggagaagaucgauggcgucaagcucgagucuauggggguguaccagauccuggcuauuuauucaacggucgccaguagcuuagugcugcuaguuucccucggagcaaucucuuucuggaugugcucgaacggcagccugcagugucggauuugcauauga

SEQ ID NO: 124791 - RNA, 1698 nt, Artificial Sequence
  derived and/or modified sequence opt3 from hemagglutinin__InfluenzaA__ACR15370
augaaggugaaacugcucguccuucugugcaccuugacagccacuuacgcugacacgaucuguauuggcuaucacgcaaacaauagcaccgauacaguugacacuguguuagagaagaacguaaccgugacacauuccgucaaucugcuagaaaacucucacaaugggaaacucugccugcuuaagggaauagcgccccugcaguuggguaacuguucaguggccggcuggauccucgggaauccugagugcgaacugcugauuaguaaagagagcugguccuacaucguugaaaagccaaacccggagaauggaaccuguuaucccggccauuucgcugauuacgaggaacucagagagcaauuaucuucggugagcucauuugaaagguucgagauuuuuccuaaggagaguuccuggccaaaccacacugucacaggugugucugccagcugcucccauaauggggaaucaaguuucuaucggaaccugcuuugguugaccggcaaaaauggacuguaccccaaccuaagcaagucuuaugcaaauaacaaagagaaggaaguacucguucuguggggcgugcaccacccuccaaacaucggggaccagaaagcccuuuaccauacggagaaugcuuacgucuccguggugucaagccacuauagucgcaaguuuacucccgaaauagcaaagcgaccuaaaguccgugaucaggagggaagaaucaacuacuauuggacccuguuggagccaggugacacaauuaucuucgaagccaauggcaaccucauugcuccgagguacgccuuugcgcugucucggggguucggauccggcaucauaaauagcaacgcacccauggauaagugugacgccaaaugccagacuccucaaggugcuauuaauucgucuuuaccauuucagaacguucaucccgugaccaucggggaguguccuaaguauguacgcuccgccaaacugagaauggugacaggacucaggaauauuccaucaauccagagucggggccuuuucggcgcaaucgcuggguuuauugaaggagguuggaccggcauggucgaugggugguacggauaucaccaccagaacgagcaaggcagcgguuacgccgcggaccagaaguccacgcagaaugccauaaacgggaucacuaauaaagugaacucuguuauugaaaagaugaauacacaguucaccgcagugggcaaggaguuuaacaaacuggagcgccgaauggaaaacuugaauaagaaagucgaugacggauucaucgauauauggacuuacaacgcugagcuacuggugcuccuggaaaaugagagaacacuugacuuccaugacagcaacguaaagaaucuguaugaaaaaguuaagucacaauugaagaacaaugccaaagagauuggcaacgggugcuuugaguucuaccacaaguguaaugaugaaugcauggagagugugaaaaacggaaccuaugacuaccccaaguauuccgaagagagcaaacucaauagggagaagaucgauggugucaagcuggaaucuaugggcguguaccagaucuuagcuauuuauucaacggucgccaguagccugauccuacucgugucccugggggcaauuucuuuuuggaugugcucgaacggaagccuucagugucggauaugcaucuga

SEQ ID NO: 124792 - RNA, 1701 nt, Artificial Sequence; identical to SEQ ID NO: 124317
  derived and/or modified sequence opt3 from hemagglutinin__InfluenzaA__ACR15381

SEQ ID NO: 124793 - RNA, 1701 nt, Artificial Sequence; identical to SEQ ID NO: 124324
  derived and/or modified sequence opt3 from hemagglutinin__InfluenzaA__ACR15392

SEQ ID NO: 124794 - RNA, 1701 nt, Artificial Sequence; identical to SEQ ID NO: 123944
  derived and/or modified sequence opt3 from hemagglutinin__InfluenzaA__ACR15403

SEQ ID NO: 124795 - RNA, 1701 nt, Artificial Sequence; identical to SEQ ID NO: 123944
  derived and/or modified sequence opt3 from hemagglutinin__InfluenzaA__ACR15414

SEQ ID NO: 124796 - RNA, 1698 nt, Artificial Sequence; identical to SEQ ID NO: 124790
  derived and/or modified sequence opt3 from hemagglutinin__InfluenzaA__ACR15425

SEQ ID NO: 124797 - RNA, 1698 nt, Artificial Sequence
  derived and/or modified sequence opt3 from hemagglutinin__InfluenzaA__ACR15436
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccgggaaaaauggcuuguaccccaaccugagcaagucuuaugcaaauaacaaaggcaaggaggugcuaguucucuggggagugcaccacccuccaaacaucggagaccagaauacgcuguaccauacugaaaacgccuacgucuccguggugucaagccacuauagucgcaaauucacccccgagauagcuaagcgaccuaagguccgugaucaggaagguagaaucaauuacuauuggacacuucuggagccaggcgacacuauuaucuuugaggcaaacgggaauuugauugccccgagguacgcuuucgcccucucucggggauuuggcuccgguaucauaaacagcaaugcgcccauggauaaaugugacgcaaagugccagaccccucaaggggccauuaacucgucucugccauuccagaauguucaucccgugacaaucggagaauguccuaaauauguacgcuccgcuaaguuaagaauggugaccggccugaggaacauuccaucaauccagagucggggccucuuuggggccaucgcaggauucauugaggguggcuggacggggauggucgauggaugguacggcuaucaccaccagaaugaacaagguagcggguacgcugccgaccagaaauccacucagaacgcgauaaauggcaucacaaacaagguaaauucuguuauugagaaaaugaacacccaguuuacugccgugggaaaggaguucaacaaacuugaacgccgaauggagaaucugaacaaaaaggucgaugacggcuucaucgauauauggacauacaaugcagaauugcuagugcugcucgagaacgaaagaacccuggacuuucaugacagcaauguaaagaaccuuuaugagaagguuaaaucacaacugaagaauaacgcuaaggaaauugggaauggaugcuucgaguuuuaccacaaauguaacgaugagugcauggaaagugugaagaaugguacguaugacuaccccaaauauuccgaggaaagcaaguugaacagggagaaaaucgauggcgucaagcucgagucuauggggguguaccagauccuggccauuuauucaaccgucgcuaguagcuuagugcugcuaguuucccucggagccaucucuuucuggaugugcucgaauggcagccugcagugucggauuugcauauga

SEQ ID NO: 124798 - RNA, 1698 nt, Artificial Sequence
  derived and/or modified sequence opt3 from hemagglutinin__InfluenzaA__ACR15458
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaacccaaauccggagaacggaaccuguuaucccggccauuuugcugauuacgaggaacugagagagcaacucucuucggugagcucauucgaaagguuugagauuuucccuaaggagaguuccuggccaaaucacacugucacaggugugucugccagcugcucccauaacggggaaucaaguuuuuaucggaauuuacuguggcuuaccggaaagaacggcuuguaccccaaucugagcaaaucuuaugcaaacaacaaggagaaagaagugcuaguucucuggggcgugcaccacccuccaaauaucggggaccagaaggcccuguaccauacggagaacgcuuacgucuccguggugucaagccacuauagucgcaaauucacucccgaaauagcaaagcgaccuaagguccgugaucaggagggaagaaucaauuacuauuggacccuucuggagccaggugacacaauuaucuuugaagccaacggcaauuugauugcuccgagguacgccuucgcgcucucucggggguuuggauccggcaucauaaacagcaaugcacccauggauaaaugugacgccaagugccagacuccucaaggugcuauuaacucgucucugccauuccagaauguucaucccgugaccaucggggaguguccuaaauauguacgcuccgccaaguuaagaauggugacaggacugaggaacauuccaucaauccagagucggggccucuuuggcgcaaucgcuggguucauugaaggagguuggaccggcauggucgaugggugguacggauaucaccaccagaaugagcaaggcagcgguuacgccgcggaccagaaauccacgcagaacgccauaaaugggaucacuaacaagguaaauucuguuauugaaaagaugaacacacaguuuaccgcagugggcaaggaguucaacaaacuugagcgccgaauggaaaaucugaacaaaaaggucgaugacggauucaucgauauauggacuuacaaugcugaguugcuagugcugcucgaaaacgagagaacacuggacuuucaugacagcaauguuaaaaaccuuuaugaaaagguaaaaucacaacugaagaauaacgccaaggagauuggcaaugggugcuucgaguuuuaccacaaauguaacgaugaaugcauggagagugugaagaauggaaccuaugacuaccccaaauauuccgaagagagcaaguugaacagggagaaaaucgauggugucaagcucgaaucuaugggcguguaccagauccuggcuauuuauucaacggucgccaguagcuuagugcugcuaguuucccucggggcaaucucuuucuggaugugcucgaauggaagccugcagugucggauuugcauauga

SEQ ID NO: 124799 - RNA, 1698 nt, Artificial Sequence
  derived and/or modified sequence opt3 from hemagglutinin__InfluenzaA__ACR15469
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccagacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaauaucggggaccagaacacgcuguaccauacugagaacgccuacgucuccguggugucaagccacuauagucgcaaauucacccccgaaauagcuaagcgaccuaagguccgugaucaggagggaagaaucaauuacuauuggacacuucuggagccaggugacacuauuaucuuugaagcaaacggcaauuugauugccccgagguacgcuuucgcccucucucggggguuuggauccggcaucauaaacagcaaugcgcccauggauaaaugugacgcaaagugccagaccccucaaggugccauuaacucgucucugccauuccagaauguucaucccgugacaaucggggaguguccuaaauauguacgcuccgcuaaguuaagaauggugaccggacugaggaacauuccaucaauccagagucggggccucuuuggcgccaucgcaggguucauugaaggagguuggacgggcauggucgaugggugguacggauaucaccaccagaaugagcaaggcagcgguuacgcugccgaccagaaauccacucagaacgcgauaaaugggaucacaaacaagguaaauucuguuauugaaaagaugaacacccaguuuacugccgugggcaaggaguucaauaaacuugagcgccgaauggaaaaccugaacaaaaaggucgaugacggauucaucgacauauggacauacaaugcagaguugcuagugcugcucgaaaacgagagaacccuggauuuucaugacagcaauguuaaaaaccuuuaugaaaagguaaaaucacaacugaagaauaacgcuaaggagauuggcaaugggugcuucgaguuuuaccacaaauguaacgaugaaugcauggagagugugaagaauggaacguaugacuaccccaaauauuccgaagagagcaaguugaacagggagaaaaucgauggugucaagcucgaaucuaugggcguguaccagauccuggccauuuauucaaccgucgcuaguagcuuagugcugcuaguuucccucggggccaucucuuucuggaugugcucgaauggaagccugcagugucggauuugcauauga

SEQ ID NO: 124800 - RNA, 1698 nt, Artificial Sequence; identical to SEQ ID NO: 124797
  derived and/or modified sequence opt3 from hemagglutinin__InfluenzaA__ACR15480

SEQ ID NO: 124801 - RNA, 1698 nt, Artificial Sequence
  derived and/or modified sequence opt3 from hemagglutinin__InfluenzaA__ACR15491
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggacgcaauggcuuguaccccaaccugagcaaaucuuaugcaaauaacaaggagaaagaaguucuaguacucuggggcgugcaccacccuccaaacaucgucgaccagaagacgcuguaccgaacugagaaugccuacguguccguggucucaagccauuauagucguaaauucacccccgaaauagcuaagagaccuaagguuagggaucaggaggggcggaucaacuacuauuggacacuucuggagccaggagacacuauuaucuuugaagcaaaugguaacuugauugccccgcgcuacgcuuucgcccucucuagaggcuuuggguccggaaucauaaauagcaacgcgcccauggauaaaugugacgcaaagugccagaccccucaaggcgccauuaauucgucucugccauuccagaacgugcaccccguaacaaucggugaguguccuaaauaugugagguccgcuaaguuacggauggucaccgggcugcgcaauauuccaucaauccagagucgaggacucuuuggcgccaucgcaggcuucauugaagggggauggacggguaugguggauggcugguacggguaucaucaccagaacgagcaaggaagcggcuacgcugccgaccagaaauccacucagaaugcgauaaacgguaucacaaauaagguuaacucugugauugaaaagaugaauacccaguuuacugccgucgggaaggaguucaacaaacuugagagaaggauggaaaaccugaauaaaaagguggaugacggcuucaucgauauauggacauacaacgcagaguugcuaguacugcucgaaaaugagcggacccuggacuuucacgacagcaacguuaaaaaucuuuaugaaaaggugaaaucacaacugaagaacaaugcuaaggagauuggaaacggcugcuucgaguuuuaccauaaauguaaugaugaaugcauggagagugucaagaacgggacguaugacuaccccaaauauuccgaagagagcaaguugaaucgugagaaaaucgauggaaucaagcucgaaucuauggguguguaccagauucuggccaucuauucaaccgucgcuaguagcuuagugcugcuaguuucccucggcgccauuucuuucuggaugugcucgaacgggagccugcagugucgcauaugcaucuga

SEQ ID NO: 124802 - RNA, 1698 nt, Artificial Sequence
  derived and/or modified sequence opt3 from hemagglutinin__InfluenzaA__ACR15502
augaaggugaaacugcucguccuucugugcaccuucacagccacuuacgcugacacgaucuguauuggcuaucacgcaaacaaugccaccgauacaguugacacuguguuggagaagaacguaaccgugacacauagcgucaauuuacuggaaaacucccacaaugggaaacuaugccuccugaagggaauagcgccccuucagcuggguaacuguucuguggcuggcuggaucuuggggaauccugagugcgaacuccugauuucaaaagagaguuggagcuacaucguugaaaagccaaacccggagaauggaaccuguuaucccggccauuuugccgauuacgaggaacugagagagcaacucuccucugugucgucauucgaaagguuugagauuuucccuaaggagagcaguuggccaaaccacacugucacagguguguccgcaucuugcagccauaauggggaauccucauuuuaucggaacuuacuguggcuuaccgggaaaaauggcuuguaccccaaccugaguaagagcuaugccaauaacaaaggcaaggaggugcuaguucucuggggagugcaccacccuccaaacaucggagaccagaauacgcuguaccauacugaaaacgcuuacgucucugugguguccucacacuauagccgcaaauucacccccgagauagcaaagcgaccuaagguccgugaucaggaagguagaaucaauuacuauuggacacuucuggagccaggcgacacuauuaucuuugaggccaacgggaauuugauugcuccgagguacgccuucgcgcucagucggggauuuggcucugguaucauaaacuccaaugcacccauggauaaaugugacgccaagugccagaccccucaaggggcuauuaacagcucgcugccauuccagaauguucaucccgugacaaucggagaauguccuaaauauguacgcucugccaaguuaagaauggugaccggccugaggaacauuccauccauccagucacggggccucuuuggggcaaucgcuggauucauugaggguggcuggacggggauggucgauggaugguacggcuaucaccaccagaaugaacaagguaguggguacgccgcggaccagaaaagcacucagaacgccauaaauggcaucacaaacaagguaaauuccguuauugagaaaaugaacacccaguuuacugcagugggaaaggaguucaacaaacuugaacgccgaauggagaaucugaacaaaaaggucgaugacggcuucaucgauauauggacauacaaugcugaauugcuagugcugcucgagaacgaaagaacccuggacuuucaugacucuaauguaaagaaccuuuaugagaagguuaaaagccaacugaagaauaacgccaaggaaauugggaauggaugcuucgaguuuuaccacaaauguaacgaugagugcauggaaucagugaagaaugguacguaugacuaccccaaauauagugaggaauccaaguugaacagggagaaaaucgauggcgucaagcucgagagcauggggguguaccagauccuggcuauuuauucuaccgucgccucaaguuuagugcugcuaguuagccucggagcaaucuccuucuggaugugcucuaauggcucgcugcagugucggauuugcauauga

SEQ ID NO: 124803 - RNA, 1698 nt, Artificial Sequence; identical to SEQ ID NO: 124659
  derived and/or modified sequence opt3 from hemagglutinin__InfluenzaA__ACR15513

SEQ ID NO: 124804 - RNA, 1701 nt, Artificial Sequence
  derived and/or modified sequence opt3 from hemagglutinin__InfluenzaA__ACR15524
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuagcuuguaugcccaggcuucugggcguaucacuguguccaccaagagaucacaacagacaguaauuccaaauaucggaagcaggccccggguucgcgaugugccuaguagaauaucuauuuacuggaccaucgucaaguccggugacauucugcuaaucaacagcacgggcaaucucaucgccccaaggggguacuuuaagauucggucgggaaaaucuuccauaaugcgcucagacgcgccgaucggcaaguguaacagugagugcauuacucccaaugguagcaucccuaacgauaaaccauuccagaaugugaaccgaauaacauauggggcaugucccagauacgugaagcagaauacccugaaacuugccacuggaaugaggaacgucccugaaaagcaaacacggggcauuuuuggcgcuaucgccggguucaucgagaauggaugggaagguaugguugacggcugguauggguuucgucaccagaacuccgagggaaccggccaggcagcugaucugaaaucuacgcaagccgcgauuaaucagaucaacgguaaguugaaucgccucauugggaagaccaacgagaaauuccaccagauagaaaaggaguucagcgaaguggagggcagaauccaggaccuggaaaaauacguagaggauacaaagauugacuuauggucauauaacgccgagcugcucguggcacuugaaaaucaacauacuaucgaucugaccgacagugagaugaacaaauuguuugaaaggacaaagaagcagcuacgggagaaugcugaagauaugggaaacggcugcuucaaaaucuaccacaagugugacaaugccugcauuggguccauacgaaacggaacuuaugaucaugacgucuaccgcgacgaggcucugaauaacagauuucagaucaaagguguggagcucaagagcggcuacaaagauuggauucuguggaucucuuucgccauuucaugcuuucuucuguguguuguguugcucggguucaucaugugggcaugccagaagggaaauauaagguguaacaucugcauuuga

SEQ ID NO: 124805 - RNA, 1701 nt, Artificial Sequence; identical to SEQ ID NO: 124613
  derived and/or modified sequence opt3 from hemagglutinin__InfluenzaA__ACR15535

SEQ ID NO: 124806 - RNA, 1701 nt, Artificial Sequence
  derived and/or modified sequence opt3 from hemagglutinin__InfluenzaA__ACR15546
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccauauccuagauggggagaauuguacccucauagacgcucugcuuggagauccgcagugcgacggcuuucagaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccaaaauggaacgucuagcgcuugcaagcggcgcuccaacaauucauuuuucagucgacugaacuggcucacucacuuaaaguuuaaauauccagcacugaaugugaccaugcccaacaacgagaaguucgacaaacuuuacaucuggggcguccaucacccuggcacagauaaugaccagauuagcuuguaugcccaggcuucugggcguaucacuguguccaccaagagaucacagcaaacaguaauuccaaacaucggaagcaggccccggguucgcgauauaaguucuagaauuuccaucuacuggaccauugugaaaccuggugacauccugcuaaucaauagcacgggcaaccucauugccccaaggggguacuuuaagauacggucgggaaagucuuccaucaugcgcucagacgcgccgauuggcaaauguaauagugagugcaucacucccaacgguagcauaccuaaugauaagccauuccagaacgucaaucgaauuacauauggggcaugucccagauacgugaaacagaacacccugaaacuugccacuggaaugaggaaugugccugaaacacagacccggggcaucuuuggcgcuaucgccggguucauugagaacggaugggaagguauggucgacggcugguauggguuucgucaccaaaauuccgagggaacgggccaggcagcugaucugaagucuacccaggccgcgaucaaccaaauuaaugguaaguugaaccgccucauagggaaaacaaacgagaaguuccaucagaucgaaaaggaguucagcgaaguugagggcaggauucaggaccuggaaaaauacguggaggauacuaagaucgacuuauggucauauaaugccgagcugcucguagcacuugaaaaccagcacaccaucgaucugacagacagugagaugaauaaauuguuugaaagaacuaagaaacaacuacgggagaacgcugaagauaugggaaauggcugcuucaagauuuaccauaagugugacaacgccugcauaggguccauccgaaaugagaccuaugaucacgacguguaccgcgacgaggcucugaacaauagauuucagauuaaaggagucgaacucaagagcgguuacaaagauuggauccuguggauuucuuucgccaucucaugcuuucuucuguguguggcauugcucggcuucauaaugugggccugccagaaggggaacaucagguguaauauuugcaucuga

SEQ ID NO: 124807 - RNA, 1701 nt, Artificial Sequence; identical to SEQ ID NO: 124388
  derived and/or modified sequence opt3 from hemagglutinin__InfluenzaA__ACR15557

SEQ ID NO: 124808 - RNA, 1701 nt, Artificial Sequence; identical to SEQ ID NO: 122646
  derived and/or modified sequence opt3 from hemagglutinin__InfluenzaA__ACR15568

SEQ ID NO: 124809 - RNA, 1701 nt, Artificial Sequence
  derived and/or modified sequence opt3 from hemagglutinin__InfluenzaA__ACR15579
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaacccaggugauauccugcuaaucaauucuacgggcaaccucauugccccgaggggguacuucaaaauacgguccggaaagagcucgaucaugcgcucugacgcgcccauuggcaaguguaauuccgagugcaucacuccuaacgguucaauaccaaaugacaaacccuuucagaacgucaaucgaauuacauauggggcauguccuagauacgugaagcagaacacccugaaacuugccacuggaaugaggaaugugccagaaaagcaaacacggggcaucuucggcgcuaucgccggguuuauugagaacggaugggaagguauggucgauggcugguauggguuccgucaccagaauagugagggaaucggccaggcagcugaccugaaaagcacccaagccgcgauuaaccagauaaacgguaaguugaaucgccucaucgggaaaacgaacgagaaguuccaccagauugaaaaggaguuuuccgaaguugagggcagaauccaggaucuggaaaaauacguggaggacaccaagaucgauuuauggucuuauaaugccgagcugcucguagcacuugaaaaccaacauacaauugaccugacugauagcgagaugaauaaauuguucgaaaggaccaagaaacagcuacgggagaacgcugaagacaugggaaauggcugcuuuaagauauaccacaagugugauaacgccugcaucgggucaauucgaaauggaacauaugaccaugauguguaccgcgacgaggcucugaacaauagauuccagaucaaaggugucgagcucaagaguggcuacaaagacuggauucuguggaucuccuuugccauaagcugcuuccuucuguguguggcauugcucggguuuaucaugugggccugccagaagggaaacauuagguguaauaucugcauuuga

SEQ ID NO: 124810 - RNA, 1701 nt, Artificial Sequence
  derived and/or modified sequence opt3 from hemagglutinin__InfluenzaA__ACR15590
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccgguggcauuugcgacagcccacaccagauccuagauggggagaauuguacucucauagacgcgcugcuuggagauccgcagugcgacggcuuucaaaacaaaaagugggaucuguucguggaaagauccaaggcuuauucuaauuguuaccccuaugacgucccugauuacgccucguugaggucacucguggcaagcagugguacacuggaguuuaacaaugaauccuucaacuggaccgggguuacgcagaauggaacuucuagcgccugcaagcggcgcuccaacaauucauuuuucagucgacugaacuggcucacccauuuaaaguuuaaauauccagcucugaaugugacaaugcccaacaacgagaaguucgacaaacuuuacaucuggggcguccaccauccuggcacugauaaugaccagaucuuuuuguaugcacaggccagcgggcguauuaccgugucuacaaagagaucccaacagaccguaauuccaaacaucggaucaaggccccggguucgcaauauaccuagcagaauuaguaucuacuggacgauugugaaaccaggugauauccugcuaaucaacucuacuggcaaucucauugcuccgaggggguacuucaagauacgguccggaaagagcucgaucaugcgcucugacgcccccauuggcaaauguaacuccgagugcaucacaccuaaugguucaauaccaaacgacaagcccuuucagaaugucaaccgaauuaccuauggggcguguccuagauacgugaaacagaauacucugaaacuugcaacaggaaugaggaacgugccagaaaaacaaacccggggcaucuucggcgccaucgcuggguuuauugagaauggaugggaagguauggucgauggcugguauggguuccgucaccagaacagugagggaaucggccaggccgcagaccugaaaagcacgcaagcugccauuaaucagauaaacgguaaauugaaccgccucaucgggaagaccaaugagaaguuccaccagauugaaaaagaguuuuccgaaguugagggcagaauccaggaucuggaaaaguacguggaggacacaaaaaucgauuuauggucuuauaacgcggagcugcucguagcccuugaaaaucaacauacuauugaccugaccgauagcgagaugaacaaguuguucgaaaggacaaagaagcagcuacgggagaaugcagaagacaugggaaacggcugcuuuaagauauaccacaaaugugauaaugcuugcaucgggucaauucgaaacggaacuuaugaccaugauguguaccgcgacgaggcccugaauaacagauuccagaucaagggugucgagcucaaaaguggcuacaaggacuggauucuguggaucuccuuugcuauaagcugcuuccuucuguguguggccuugcucggguuuaucaugugggcaugccagaaaggaaauauuagguguaacaucugcauuuga

SEQ ID NO: 124811 - RNA, 1701 nt, Artificial Sequence; identical to SEQ ID NO: 122646
  derived and/or modified sequence opt3 from hemagglutinin__InfluenzaA__ACR15601

SEQ ID NO: 124812 - RNA, 1701 nt, Artificial Sequence
  derived and/or modified sequence opt3 from hemagglutinin__InfluenzaA__ACR18920
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauauucaguuuacggcuguggguaaggaguucaaccaccuggaaaagcggaucgaaaauuuaaacaaaaaggucgaugacggguuccuggauaucuggaccuacaaugccgagcuccuugugcuguuggaaaacgagcgcacacuagacuaucaugauucaaauguaaagaaccuguacgagaagguucgaagucagcucaaaaacaaugcaaaggaaauuggcaacggauguuuugaguucuaucacaagugcgacaauacuuguauggaauccgugaaaaacggcaccuacgauuauccuaaguacagcgaggaagccaaacugaauagagaggagaucgacggggucaaacuugaaucuacaaggauuuaucaaauacuggcuaucuacucaacuguggcgaguagcuugguccucgugguuucccugggagcaauuucuuuuuggaugugcucgaacgguagcuuacagugccggaucuguaucuga

SEQ ID NO: 124813 - RNA, 1701 nt, Artificial Sequence; identical to SEQ ID NO: 124685
  derived and/or modified sequence opt3 from hemagglutinin__InfluenzaA__ACR18975

SEQ ID NO: 124814 - RNA, 1701 nt, Artificial Sequence; identical to SEQ ID NO: 124672
  derived and/or modified sequence opt3 from hemagglutinin__InfluenzaA__ACR18976

SEQ ID NO: 124815 - RNA, 1701 nt, Artificial Sequence; identical to SEQ ID NO: 124672
  derived and/or modified sequence opt3 from hemagglutinin__InfluenzaA__ACR18977

SEQ ID NO: 124816 - RNA, 1701 nt, Artificial Sequence; identical to SEQ ID NO: 124685
  derived and/or modified sequence opt3 from hemagglutinin__InfluenzaA__ACR18978

SEQ ID NO: 124817 - RNA, 1701 nt, Artificial Sequence; identical to SEQ ID NO: 124672
  derived and/or modified sequence opt3 from hemagglutinin__InfluenzaA__ACR18979

SEQ ID NO: 124818 - RNA, 1701 nt, Artificial Sequence; identical to SEQ ID NO: 124738
  derived and/or modified sequence opt3 from hemagglutinin__InfluenzaA__ACR18981

SEQ ID NO: 124819 - RNA, 1701 nt, Artificial Sequence; identical to SEQ ID NO: 124672
  derived and/or modified sequence opt3 from hemagglutinin__InfluenzaA__ACR18982

SEQ ID NO: 124820 - RNA, 1701 nt, Artificial Sequence; identical to SEQ ID NO: 124685
  derived and/or modified sequence opt3 from hemagglutinin__InfluenzaA__ACR18988

SEQ ID NO: 124821 - RNA, 1701 nt, Artificial Sequence
  derived and/or modified sequence opt3 from hemagglutinin__InfluenzaA__ACR18991
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaauagaaaacuauguaagcucaggggaguggcuccccugcaucuuggaaaaugcaacauagccgguuggauccugggcaauccugagugugaaucuuugucaacagcaaguagcugguccuacauuguugagaccucuucgucagacaacgggacuugcuauccaggagauuuuaucgacuacgaagaacuccgggagcagcugagcaguguguccucuuucgaacgcuuugagauuuucccgaagacaagcuccuggcccaaucacgauucaaacaagggcgucaccgccgcuuguccucaugccggugcaaaaaguuuuuauaagaaucugaucuggcucgugaaaaaggggaacagcuacccaaaauuaucuaaguccuauauaaaugacaagggaaaagaaguacugguucuuuggggcauccaccaccccucaacgagcgcugaucaacagaguuuguaccagaacgccgacgcguacguguucgucgggucuucccgauauagcaagaaauuuaagccugagauugcaauccguccaaaagugagagaucaggagggcaggaugaauuacuauuggacucugguggaacccggagacaagauuaccuucgaggccacagguaaccuagucguuccucgguacgcuuuugccauggaacgcaacgcaggcucggggaucauaauuucugauacuccagugcaugacugcaauaccacaugucaaaccccgaaaggagcuaucaacacgucccuccccuuccagaauauucacccuaucacuaucggcaagugcccaaaguauguaaaaucaacaaagcugagacuugccaccggucugaggaacgugcccaguauucagagccggggguuguuuggagcgauagccggcuucaucgagggcggguggacuggaauggucgacgguugguacggcuaucaucaccagaaugaacaaggguccggauacgcagcugaucucaaaucuacacagaacgccauugacgagaucaccaauaaggugaacagcguuauagagaaaaugaauacgcaguuuaccgcugugggcaaggaguucaaccaccuggagaagcgcauugaaaauuuaaacaaaaaggucgaugacgguuuccuggauaucuggacauacaaugccgagcuccuugugcuguuggaaaacgagcgaacucuagacuaucaugauucaaauguaaagaaccuguacgagaagguuagaagucagcucaaaaacaaugcaaaggaaaucgggaacggcuguuuugaguucuaucacaagugcgacaauaccuguauggaauccgugaaaaacggaacauacgauuauccuaaguacagcgaggaagccaaacugaauagggaggagauugacggcgucaaacuugaaucuacucggaucuaucaaauucuggcuauauacucaaccguggcgaguagcuugguccucgugguuucccugggggcaaucucuuuuuggaugugcucgaacgggagcuuacagugccguauuuguaucuga

SEQ ID NO: 124822 - RNA, 1701 nt, Artificial Sequence; identical to SEQ ID NO: 124672
  derived and/or modified sequence opt3 from hemagglutinin__InfluenzaA__ACR18993

SEQ ID NO: 124823 - RNA, 1701 nt, Artificial Sequence; identical to SEQ ID NO: 124711
  derived and/or modified sequence opt3 from hemagglutinin__InfluenzaA__ACR18995

SEQ ID NO: 124824 - RNA, 1701 nt, Artificial Sequence; identical to SEQ ID NO: 124733
  derived and/or modified sequence opt3 from hemagglutinin__InfluenzaA__ACR23302

SEQ ID NO: 124825 - RNA, 1701 nt, Artificial Sequence; identical to SEQ ID NO: 124685
  derived and/or modified sequence opt3 from hemagglutinin__InfluenzaA__ACR33743

SEQ ID NO: 124826 - RNA, 1701 nt, Artificial Sequence; identical to SEQ ID NO: 124672
  derived and/or modified sequence opt3 from hemagglutinin__InfluenzaA__ACR38821

SEQ ID NO: 124827 - RNA, 1701 nt, Artificial Sequence; identical to SEQ ID NO: 124672
  derived and/or modified sequence opt3 from hemagglutinin__InfluenzaA__ACR38822

SEQ ID NO: 124828 - RNA, 1701 nt, Artificial Sequence; identical to SEQ ID NO: 124672
  derived and/or modified sequence opt3 from hemagglutinin__InfluenzaA__ACR38823

SEQ ID NO: 124829 - RNA, 1701 nt, Artificial Sequence; identical to SEQ ID NO: 124738
  derived and/or modified sequence opt3 from hemagglutinin__InfluenzaA__ACR38824

SEQ ID NO: 124830 - RNA, 1701 nt, Artificial Sequence
  derived and/or modified sequence opt3 from hemagglutinin__InfluenzaA__ACR38825
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguggacaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugaugagaucacgaauaaggugaacucuguuauagagaaaaugaauacccaguuuacagcuguggggaaggaguucaaccaccuggagaagcggauugaaaauuuaaacaaaaagaucgacgauggcuuccuggacaucuggacuuacaaugccgagcuccuuguccuguuggaaaacgagcgcacccuagauuaucaugacagcaaugugaaaaaccuguacgagaagguacgaucacagcucaaaaacaaugcaaaggaaauuggaaacggcuguuuugaguucuaucacaagugcgauaauacauguauggaaaguguuaaaaacgggacuuacgacuauccuaaguacuccgaggaagccaaacugaauagagaggagaucgauggagugaaacuugaaagcaccaggauuuaucaaauacuggcuaucuacucuacagucgcgucaaguuuggugcucgucgugagccugggugcaauuuccuuuuggaugugcucuaacggcucguuacagugccggaucuguaucuga

SEQ ID NO: 124831 - RNA, 1701 nt, Artificial Sequence; identical to SEQ ID NO: 124685
  derived and/or modified sequence opt3 from hemagglutinin__InfluenzaA__ACR38826

SEQ ID NO: 124832 - RNA, 1701 nt, Artificial Sequence; identical to SEQ ID NO: 124672
  derived and/or modified sequence opt3 from hemagglutinin__InfluenzaA__ACR38827

SEQ ID NO: 124833 - RNA, 1701 nt, Artificial Sequence; identical to SEQ ID NO: 124738
  derived and/or modified sequence opt3 from hemagglutinin__InfluenzaA__ACR38828

SEQ ID NO: 124834 - RNA, 1701 nt, Artificial Sequence; identical to SEQ ID NO: 124672
  derived and/or modified sequence opt3 from hemagglutinin__InfluenzaA__ACR38829

SEQ ID NO: 124835 - RNA, 1701 nt, Artificial Sequence; identical to SEQ ID NO: 124711
  derived and/or modified sequence opt3 from hemagglutinin__InfluenzaA__ACR38830

SEQ ID NO: 124836 - RNA, 1701 nt, Artificial Sequence; identical to SEQ ID NO: 124685
  derived and/or modified sequence opt3 from hemagglutinin__InfluenzaA__ACR39354

SEQ ID NO: 124837 - RNA, 1701 nt, Artificial Sequence; identical to SEQ ID NO: 124685
  derived and/or modified sequence opt3 from hemagglutinin__InfluenzaA__ACR39393

SEQ ID NO: 124838 - RNA, 1701 nt, Artificial Sequence; identical to SEQ ID NO: 124685
  derived and/or modified sequence opt3 from hemagglutinin__InfluenzaA__ACR39403

SEQ ID NO: 124839 - RNA, 1701 nt, Artificial Sequence; identical to SEQ ID NO: 124685
  derived and/or modified sequence opt3 from hemagglutinin__InfluenzaA__ACR39413

SEQ ID NO: 124840 - RNA, 1701 nt, Artificial Sequence; identical to SEQ ID NO: 124685
  derived and/or modified sequence opt3 from hemagglutinin__InfluenzaA__ACR39423

SEQ ID NO: 124841 - RNA, 1701 nt, Artificial Sequence; identical to SEQ ID NO: 124685
  derived and/or modified sequence opt3 from hemagglutinin__InfluenzaA__ACR39433

SEQ ID NO: 124842 - RNA, 1701 nt, Artificial Sequence; identical to SEQ ID NO: 124685
  derived and/or modified sequence opt3 from hemagglutinin__InfluenzaA__ACR39443

SEQ ID NO: 124843 - RNA, 1701 nt, Artificial Sequence
  derived and/or modified sequence opt3 from hemagglutinin__InfluenzaA__ACR39453
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugaucaggaaggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggaaagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 124844 - RNA, 1701 nt, Artificial Sequence; identical to SEQ ID NO: 124685
  derived and/or modified sequence opt3 from hemagglutinin__InfluenzaA__ACR39463

SEQ ID NO: 124845 - RNA, 1701 nt, Artificial Sequence; identical to SEQ ID NO: 124685
  derived and/or modified sequence opt3 from hemagglutinin__InfluenzaA__ACR39473

SEQ ID NO: 124846 - RNA, 1701 nt, Artificial Sequence; identical to SEQ ID NO: 124685
  derived and/or modified sequence opt3 from hemagglutinin__InfluenzaA__ACR39483

SEQ ID NO: 124847 - RNA, 1701 nt, Artificial Sequence; identical to SEQ ID NO: 124685
  derived and/or modified sequence opt3 from hemagglutinin__InfluenzaA__ACR39493

SEQ ID NO: 124848 - RNA, 1701 nt, Artificial Sequence; identical to SEQ ID NO: 124685
  derived and/or modified sequence opt3 from hemagglutinin__InfluenzaA__ACR40288

SEQ ID NO: 124849 - RNA, 1701 nt, Artificial Sequence; identical to SEQ ID NO: 124685
  derived and/or modified sequence opt3 from hemagglutinin__InfluenzaA__ACR40298

SEQ ID NO: 124850 - RNA, 1701 nt, Artificial Sequence
  derived and/or modified sequence opt3 from hemagglutinin__InfluenzaA__ACR40308
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauuuauccuaucacuaucgguaagugcccaaaguacguaaaaucaacaaagcugcgccuugccaccgggcugagaaacgugcccaguauucagagcaggggauuguuuggcgcgauagccggcuucaucgaagggggauggacugguauggucgacggcugguauggguaccaccaucagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauauaaugccgagcuccuugugcuguuggaaaacgagcgcacucuagacuaccacgauucaaauguaaagaaccuguaugagaagguucgaagucagcucaaaaacaaugcaaaggaaaucggcaacggauguuuugaguucuaccauaagugcgacaauaccuguauggaauccgugaaaaacggcacauaugauuacccuaaguauagcgaggaagccaaacugaauagagaggagauugacggggucaaacuugaaucuacuaggaucuaccaaauucuggcuauauacucaaccguggcgaguagcuugguccucgugguuucccugggagcaaucucuuuuuggaugugcucgaacgguagcuuacagugccggauuuguaucuga

SEQ ID NO: 124851 - RNA, 1701 nt, Artificial Sequence; identical to SEQ ID NO: 124685
  derived and/or modified sequence opt3 from hemagglutinin__InfluenzaA__ACR40318

SEQ ID NO: 124852 - RNA, 1701 nt, Artificial Sequence; identical to SEQ ID NO: 124685
  derived and/or modified sequence opt3 from hemagglutinin__InfluenzaA__ACR40328

SEQ ID NO: 124853 - RNA, 1701 nt, Artificial Sequence; identical to SEQ ID NO: 124685
  derived and/or modified sequence opt3 from hemagglutinin__InfluenzaA__ACR40338

SEQ ID NO: 124854 - RNA, 1701 nt, Artificial Sequence; identical to SEQ ID NO: 124685
  derived and/or modified sequence opt3 from hemagglutinin__InfluenzaA__ACR40348

SEQ ID NO: 124855 - RNA, 1701 nt, Artificial Sequence; identical to SEQ ID NO: 124685
  derived and/or modified sequence opt3 from hemagglutinin__InfluenzaA__ACR40358

SEQ ID NO: 124856 - RNA, 1701 nt, Artificial Sequence; identical to SEQ ID NO: 124685
  derived and/or modified sequence opt3 from hemagglutinin__InfluenzaA__ACR40378

SEQ ID NO: 124857 - RNA, 1701 nt, Artificial Sequence; identical to SEQ ID NO: 124685
  derived and/or modified sequence opt3 from hemagglutinin__InfluenzaA__ACR40388

SEQ ID NO: 124858 - RNA, 1701 nt, Artificial Sequence; identical to SEQ ID NO: 124672
  derived and/or modified sequence opt3 from hemagglutinin__InfluenzaA__ACR46986

SEQ ID NO: 124859 - RNA, 1701 nt, Artificial Sequence; identical to SEQ ID NO: 124672
  derived and/or modified sequence opt3 from hemagglutinin__InfluenzaA__ACR46988

SEQ ID NO: 124860 - RNA, 1701 nt, Artificial Sequence; identical to SEQ ID NO: 124672
  derived and/or modified sequence opt3 from hemagglutinin__InfluenzaA__ACR46989

SEQ ID NO: 124861 - RNA, 1701 nt, Artificial Sequence; identical to SEQ ID NO: 124672
  derived and/or modified sequence opt3 from hemagglutinin__InfluenzaA__ACR46990

SEQ ID NO: 124862 - RNA, 1701 nt, Artificial Sequence; identical to SEQ ID NO: 124672
  derived and/or modified sequence opt3 from hemagglutinin__InfluenzaA__ACR46992

SEQ ID NO: 124863 - RNA, 1701 nt, Artificial Sequence; identical to SEQ ID NO: 124672
  derived and/or modified sequence opt3 from hemagglutinin__InfluenzaA__ACR46993

SEQ ID NO: 124864 - RNA, 1701 nt, Artificial Sequence; identical to SEQ ID NO: 124672
  derived and/or modified sequence opt3 from hemagglutinin__InfluenzaA__ACR46994

SEQ ID NO: 124865 - RNA, 1701 nt, Artificial Sequence
  derived and/or modified sequence opt3 from hemagglutinin__InfluenzaA__ACR47006
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaauuggcaacggauguuuugaguucuaucacaagugcgacaauaccuguauggaauccgugaaaaacggcacauacgauuauccuaaguacagcgaggaagccaaacucaauagagaggagaucgacggggucaagcuggaaucuacuaggauuuaucaaauacuugcuaucuacucaaccguggcgaguagccuggucuuggugguuucccucggagcaauuucuuuuuggaugugcucgaacgguagccugcagugccggaucuguaucuga

SEQ ID NO: 124866 - RNA, 1701 nt, Artificial Sequence; identical to SEQ ID NO: 124685
  derived and/or modified sequence opt3 from hemagglutinin__InfluenzaA__ACR49281

SEQ ID NO: 124867 - RNA, 1701 nt, Artificial Sequence
  derived and/or modified sequence opt3 from hemagglutinin__InfluenzaA__ACR49282
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggucuucccgcuauagcaagaaauuuaagccugagauugcaauccgaccaaaagugcgugaccaggagggaagaaugaacuacuauuggacucugguggaacccggugauaagauuaccuucgaggccacaggcaaucuagucguuccuagguacgcuuuugccauggaacggaacgcagggucgggaaucauaauuucugacacuccagugcaugacugcaacaccacaugucaaaccccgaaaggcgcuaucaauacgucccuccccuuccagaacauucacccuaucacuaucgguaagugcccaaaguauguaaaaucaacaaagcugcgccuugccaccgggcugagaaaugugcccaguauucagagcaggggauuguuuggcgcgauagccggcuucaucgaagggggauggacugguauggucgauggcugguacggguaucaucaccagaacgaacaaggauccggcuacgcagcugaccucaaaucuacacagaaugccauugaugagaucaccaacaaggugaauagcguuauagagaaaaugaacacgcaguuuaccgcuguggguaaggaguucaaucaccuggaaaagcggauugaaaacuuaaauaaaaaggucgacgauggguuccuggacaucuggacauacaacgccgagcuccuugugcuguuggaaaaugagcgcacucuagauuaucaugacucaaacguaaagaaucuguacgagaagguucgaagucagcucaaaaacaacgcaaaggaaaucggcaauggauguuuugaguucuaucacaagugcgauaacaccuguauggaauccgugaaaaauggcacauacgacuauccuaaguacagcgaggaagccaaacugaacagagaggagauugauggggucaaacuugaaucuacuaggaucuaucaaauucuggcuauauacucaaccguggcgaguagcuugguccucgugguuucccugggagcaaucucuuuuuggaugugcucgaaugguagcuuacagugccggauuuguaucuga

SEQ ID NO: 124868 - RNA, 1701 nt, Artificial Sequence; identical to SEQ ID NO: 124672
  derived and/or modified sequence opt3 from hemagglutinin__InfluenzaA__ACR49283

SEQ ID NO: 124869 - RNA, 1701 nt, Artificial Sequence; identical to SEQ ID NO: 124672
  derived and/or modified sequence opt3 from hemagglutinin__InfluenzaA__ACR49288

SEQ ID NO: 124870 - RNA, 1701 nt, Artificial Sequence; identical to SEQ ID NO: 124711
  derived and/or modified sequence opt3 from hemagglutinin__InfluenzaA__ACR49290

SEQ ID NO: 124871 - RNA, 1701 nt, Artificial Sequence; identical to SEQ ID NO: 124685
  derived and/or modified sequence opt3 from hemagglutinin__InfluenzaA__ACR49291

SEQ ID NO: 124872 - RNA, 1701 nt, Artificial Sequence; identical to SEQ ID NO: 124711
  derived and/or modified sequence opt3 from hemagglutinin__InfluenzaA__ACR49293

SEQ ID NO: 124873 - RNA, 1701 nt, Artificial Sequence; identical to SEQ ID NO: 124711
  derived and/or modified sequence opt3 from hemagglutinin__InfluenzaA__ACR49295

SEQ ID NO: 124874 - RNA, 1701 nt, Artificial Sequence; identical to SEQ ID NO: 124725
  derived and/or modified sequence opt3 from hemagglutinin__InfluenzaA__ACR50993

SEQ ID NO: 124875 - RNA, 1701 nt, Artificial Sequence; identical to SEQ ID NO: 124685
  derived and/or modified sequence opt3 from hemagglutinin__InfluenzaA__ACR50995

SEQ ID NO: 124876 - RNA, 1701 nt, Artificial Sequence; identical to SEQ ID NO: 124685
  derived and/or modified sequence opt3 from hemagglutinin__InfluenzaA__ACR51005

SEQ ID NO: 124877 - RNA, 1701 nt, Artificial Sequence; identical to SEQ ID NO: 124685
  derived and/or modified sequence opt3 from hemagglutinin__InfluenzaA__ACR51015

SEQ ID NO: 124878 - RNA, 1701 nt, Artificial Sequence; identical to SEQ ID NO: 124685
  derived and/or modified sequence opt3 from hemagglutinin__InfluenzaA__ACR51025

SEQ ID NO: 124879 - RNA, 1701 nt, Artificial Sequence; identical to SEQ ID NO: 124685
  derived and/or modified sequence opt3 from hemagglutinin__InfluenzaA__ACR51035

SEQ ID NO: 124880 - RNA, 1701 nt, Artificial Sequence; identical to SEQ ID NO: 124685
  derived and/or modified sequence opt3 from hemagglutinin__InfluenzaA__ACR51045

SEQ ID NO: 124881 - RNA, 1701 nt, Artificial Sequence; identical to SEQ ID NO: 124685
  derived and/or modified sequence opt3 from hemagglutinin__InfluenzaA__ACR51055

SEQ ID NO: 124882 - RNA, 1701 nt, Artificial Sequence; identical to SEQ ID NO: 124672
  derived and/or modified sequence opt3 from hemagglutinin__InfluenzaA__ACR51065

SEQ ID NO: 124883 - RNA, 1701 nt, Artificial Sequence; identical to SEQ ID NO: 124685
  derived and/or modified sequence opt3 from hemagglutinin__InfluenzaA__ACR52368

SEQ ID NO: 124884 - RNA, 1701 nt, Artificial Sequence; identical to SEQ ID NO: 124685
  derived and/or modified sequence opt3 from hemagglutinin__InfluenzaA__ACR52378

SEQ ID NO: 124885 - RNA, 1701 nt, Artificial Sequence; identical to SEQ ID NO: 124685
  derived and/or modified sequence opt3 from hemagglutinin__InfluenzaA__ACR52398

SEQ ID NO: 124886 - RNA, 1701 nt, Artificial Sequence; identical to SEQ ID NO: 124685
  derived and/or modified sequence opt3 from hemagglutinin__InfluenzaA__ACR52408

SEQ ID NO: 124887 - RNA, 1701 nt, Artificial Sequence; identical to SEQ ID NO: 124685
  derived and/or modified sequence opt3 from hemagglutinin__InfluenzaA__ACR52418

SEQ ID NO: 124888 - RNA, 1701 nt, Artificial Sequence; identical to SEQ ID NO: 124685
  derived and/or modified sequence opt3 from hemagglutinin__InfluenzaA__ACR52428

SEQ ID NO: 124889 - RNA, 1701 nt, Artificial Sequence; identical to SEQ ID NO: 124685
  derived and/or modified sequence opt3 from hemagglutinin__InfluenzaA__ACR52438

SEQ ID NO: 124890 - RNA, 1701 nt, Artificial Sequence; identical to SEQ ID NO: 124685
  derived and/or modified sequence opt3 from hemagglutinin__InfluenzaA__ACR52448

SEQ ID NO: 124891 - RNA, 1701 nt, Artificial Sequence; identical to SEQ ID NO: 124685
  derived and/or modified sequence opt3 from hemagglutinin__InfluenzaA__ACR52458

SEQ ID NO: 124892 - RNA, 1701 nt, Artificial Sequence; identical to SEQ ID NO: 124685
  derived and/or modified sequence opt3 from hemagglutinin__InfluenzaA__ACR52468

SEQ ID NO: 124893 - RNA, 1701 nt, Artificial Sequence; identical to SEQ ID NO: 124685
  derived and/or modified sequence opt3 from hemagglutinin__InfluenzaA__ACR52478

SEQ ID NO: 124894 - RNA, 1701 nt, Artificial Sequence; identical to SEQ ID NO: 124685
  derived and/or modified sequence opt3 from hemagglutinin__InfluenzaA__ACR52488

SEQ ID NO: 124895 - RNA, 1701 nt, Artificial Sequence; identical to SEQ ID NO: 124685
  derived and/or modified sequence opt3 from hemagglutinin__InfluenzaA__ACR54045

SEQ ID NO: 124896 - RNA, 1701 nt, Artificial Sequence
  derived and/or modified sequence opt3 from hemagglutinin__InfluenzaA__ACR54047
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaaaucggcaacggauguuuugaguucuaucacaagugcgacaauaccuguauggaauccgugaaaaacggcacauacgauuauccuaaguacagcgaggaagccaaacugaauagagaggagauugacgggaucaaacuugaaucuacuaggauuuaucaaauacuggcuaucuacucaaccgucgcgaguagcuuggugcucgucgugucccugggagcaauuucuuuuuggaugugcucgaacgguagcuuacagugccggaucuguaucuga

SEQ ID NO: 124897 - RNA, 1701 nt, Artificial Sequence
  derived and/or modified sequence opt3 from hemagglutinin__InfluenzaA__ACR54964
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuauugcuguggguaaggaguucaaccaccuggaaaagcggaucgaaaauuuaaacaaaaaggucgaugacggguuccuggauaucuggacauacaaugccgagcuccuugugcuguuggaaaacgagcgcacucuagacuaucaugauagcaauguaaagaaccuguacgagaagguucgaucacagcucaaaaacaaugcaaaggaaauuggcaacggauguuuugaguucuaucacaagugcgacaauaccuguauggaaagugugaaaaacggcacauacgauuauccuaaguacuccgaggaagccaaacugaauagagaggagaucgacggggucaaacuugaaagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 124898 - RNA, 1701 nt, Artificial Sequence; identical to SEQ ID NO: 124776
  derived and/or modified sequence opt3 from hemagglutinin__InfluenzaA__ACR54974

SEQ ID NO: 124899 - RNA, 1701 nt, Artificial Sequence; identical to SEQ ID NO: 124685
  derived and/or modified sequence opt3 from hemagglutinin__InfluenzaA__ACR54984

SEQ ID NO: 124900 - RNA, 1701 nt, Artificial Sequence; identical to SEQ ID NO: 124672
  derived and/or modified sequence opt3 from hemagglutinin__InfluenzaA__ACR54994

SEQ ID NO: 124901 - RNA, 1701 nt, Artificial Sequence; identical to SEQ ID NO: 124672
  derived and/or modified sequence opt3 from hemagglutinin__InfluenzaA__ACR55004

SEQ ID NO: 124902 - RNA, 1701 nt, Artificial Sequence; identical to SEQ ID NO: 124865
  derived and/or modified sequence opt3 from hemagglutinin__InfluenzaA__ACR56380

SEQ ID NO: 124903 - RNA, 1701 nt, Artificial Sequence; identical to SEQ ID NO: 124738
  derived and/or modified sequence opt3 from hemagglutinin__InfluenzaA__ACR56390

SEQ ID NO: 124904 - RNA, 1701 nt, Artificial Sequence; identical to SEQ ID NO: 124685
  derived and/or modified sequence opt3 from hemagglutinin__InfluenzaA__ACR56400

SEQ ID NO: 124905 - RNA, 1701 nt, Artificial Sequence; identical to SEQ ID NO: 124685
  derived and/or modified sequence opt3 from hemagglutinin__InfluenzaA__ACR56410

SEQ ID NO: 124906 - RNA, 1701 nt, Artificial Sequence; identical to SEQ ID NO: 124685
  derived and/or modified sequence opt3 from hemagglutinin__InfluenzaA__ACR56420

SEQ ID NO: 124907 - RNA, 1701 nt, Artificial Sequence; identical to SEQ ID NO: 124685
  derived and/or modified sequence opt3 from hemagglutinin__InfluenzaA__ACR56430

SEQ ID NO: 124908 - RNA, 1701 nt, Artificial Sequence; identical to SEQ ID NO: 124685
  derived and/or modified sequence opt3 from hemagglutinin__InfluenzaA__ACR56440

SEQ ID NO: 124909 - RNA, 1698 nt, Artificial Sequence
  derived and/or modified sequence opt3 from hemagglutinin__InfluenzaA__ACR58541
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuacccgcaaaaauggauuguaccccaaccugagcaagucuuaugcaaauaacaaagagaaggaaguucuaguacucuggggcgugcaccacccuccaaacaucggcgaccagaaagcccuguaccauacggagaaugcuuacgucuccguggugucaagccacuauagucgaaaguucacucccgaaauagcaaagcguccuaaagucagagaucaggaggggaggaucaacuacuauuggacccuucuggagccaggagacacaauuaucuuugaagccaaugguaacuugauugcuccgcgguacgccuucgcgcucucucgcggcuuuggguccggaaucauaaauagcaacgcacccauggauaagugugacgccaaaugccagacuccucaaggcgcuauuaauucgucucugccauuccagaacguucaucccgugaccaucggugaguguccuaaguauguaagauccgccaaauuaaggauggugacagggcugcggaauauuccaucaauccagagucgcggacucuuuggcgcaaucgcuggcuucauugaagggggauggaccgguauggucgauggcugguacggguaucaccaccagaacgagcaaggaagcggcuacgccgcggaccagaaguccacgcagaaugccauaaacgguaucacuaauaaagugaacucuguuauugauaagaugaauacacaguuuaccgcaguggggaaggaguucaacaaacuugaacgaagaauggagaaccugaauaagaaagucgacgauggcuucaucgacauauggacuuacaacgcugaauugcuagugcugcucgagaaugaaaggacacuggacuuucaugauagcaacguaaagaaucuuuaugagaaaguuaagucacaacugaagaacaaugccaaagaaauuggaaacggcugcuucgaguuuuaccacaaguguaaugacgagugcauggaaagugugaaaaacgggaccuaugauuaccccaaguauuccgaggaaagcaaauugaaucgggagaagaucgacggagucaagcucgagucuauggguguguaccagauccuggcuauuuauucaacggucgccaguagcuuagugcugcuaguuucccucggcgcaaucucuuucuggaugugcucgaacgggagccugcagugucguauuugcauauga

SEQ ID NO: 124910 - RNA, 1698 nt, Artificial Sequence; identical to SEQ ID NO: 123930
  derived and/or modified sequence opt3 from hemagglutinin__InfluenzaA__ACR61655

SEQ ID NO: 124911 - RNA, 1698 nt, Artificial Sequence; identical to SEQ ID NO: 123946
  derived and/or modified sequence opt3 from hemagglutinin__InfluenzaA__ACR61666

SEQ ID NO: 124912 - RNA, 1701 nt, Artificial Sequence; identical to SEQ ID NO: 124450
  derived and/or modified sequence opt3 from hemagglutinin__InfluenzaA__ACR61677

SEQ ID NO: 124913 - RNA, 1701 nt, Artificial Sequence; identical to SEQ ID NO: 124450
  derived and/or modified sequence opt3 from hemagglutinin__InfluenzaA__ACR61688

SEQ ID NO: 124914 - RNA, 1701 nt, Artificial Sequence; identical to SEQ ID NO: 124450
  derived and/or modified sequence opt3 from hemagglutinin__InfluenzaA__ACR61699

SEQ ID NO: 124915 - RNA, 1701 nt, Artificial Sequence; identical to SEQ ID NO: 124672
  derived and/or modified sequence opt3 from hemagglutinin__InfluenzaA__ACR67170

SEQ ID NO: 124916 - RNA, 1701 nt, Artificial Sequence; identical to SEQ ID NO: 124711
  derived and/or modified sequence opt3 from hemagglutinin__InfluenzaA__ACR67171

SEQ ID NO: 124917 - RNA, 1701 nt, Artificial Sequence; identical to SEQ ID NO: 124672
  derived and/or modified sequence opt3 from hemagglutinin__InfluenzaA__ACR67172

SEQ ID NO: 124918 - RNA, 1701 nt, Artificial Sequence; identical to SEQ ID NO: 124672
  derived and/or modified sequence opt3 from hemagglutinin__InfluenzaA__ACR67177

SEQ ID NO: 124919 - RNA, 1701 nt, Artificial Sequence; identical to SEQ ID NO: 124672
  derived and/or modified sequence opt3 from hemagglutinin__InfluenzaA__ACR67181

SEQ ID NO: 124920 - RNA, 1701 nt, Artificial Sequence
  derived and/or modified sequence opt3 from hemagglutinin__InfluenzaA__ACR67183
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugauagagagggaaggaugaauuacuauuggacucugguggaacccggugacaagauuaccuucgaggccacaggcaaccuagucguuccucgguacgcuuuugccauggaacgcaacgcagggucgggaaucauaauuucugauacuccagugcaugacugcaauaccacaugucagaccccgaaaggcgcuaucaacacgucccuccccuuccaaaauauucacccuaucacuaucgguaagugcccaaaguauguaaaaucaacaaagcugagacuugccaccgggcugaggaacgugcccaguauucagagccggggauuguuuggcgcgauagccggcuucaucgaagggggauggacugguauggucgacggcugguacggguaucaucaccagaaugaacagggauccggcuacgcagcugaucucaaaucuacacaaaacgccauugacgagaucaccaauaaggugaacagcguuauagagaaaaugaauacgcaguuuaccgcuguggguaaggaguucaaccaccuggaaaagcgcauugaaaauuuaaacaaaaaggucgaugacggguuccuggauaucuggacauacaaugccgagcuccuugugcuguuggaaaacgagcgaacucuagacuaucaugauucaaauguaaagaaccuguacgagaagguuagaagucagcucaaaaacaaugcaaaggaaaucggcaacggauguuuugaguucuaucacaagugcgacaauaccuguauggaauccgugaaaaacggcacauacgauuauccuaaguacagcgaggaagccaaacugaauagggaggagauugacggggucaaacuugaaucuacucggaucuaucagauucuggcuauauacucaaccguggcgaguagcuugguccucgugguuucccugggagcaaucucuuuuuggaugugcucgaacgguagcuuacaaugccguauuuguaucuga

SEQ ID NO: 124921 - RNA, 1701 nt, Artificial Sequence; identical to SEQ ID NO: 124685
  derived and/or modified sequence opt3 from hemagglutinin__InfluenzaA__ACR67184

SEQ ID NO: 124922 - RNA, 1701 nt, Artificial Sequence; identical to SEQ ID NO: 124672
  derived and/or modified sequence opt3 from hemagglutinin__InfluenzaA__ACR67185

SEQ ID NO: 124923 - RNA, 1701 nt, Artificial Sequence; identical to SEQ ID NO: 124865
  derived and/or modified sequence opt3 from hemagglutinin__InfluenzaA__ACR67186

SEQ ID NO: 124924 - RNA, 1701 nt, Artificial Sequence; identical to SEQ ID NO: 124672
  derived and/or modified sequence opt3 from hemagglutinin__InfluenzaA__ACR67187

SEQ ID NO: 124925 - RNA, 1701 nt, Artificial Sequence; identical to SEQ ID NO: 124711
  derived and/or modified sequence opt3 from hemagglutinin__InfluenzaA__ACR67188

SEQ ID NO: 124926 - RNA, 1701 nt, Artificial Sequence; identical to SEQ ID NO: 124711
  derived and/or modified sequence opt3 from hemagglutinin__InfluenzaA__ACR67189

SEQ ID NO: 124927 - RNA, 1701 nt, Artificial Sequence
  derived and/or modified sequence opt3 from hemagglutinin__InfluenzaA__ACR67190
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguaaagaaccuguacgaaaaaguucgaagucagcucaagaacaaugcaaaagagaucggcaacggauguuuugaguucuaucauaagugcgacaauaccuguauggaauccgugaagaacggcacauacgauuauccuaaauacagcgaagaggccaagcugaauagagaggaaauugacggggucaaacuugagucuacuaggaucuaucagauucuggcuauauacucaaccguggcgaguagcuugguccucgugguuucccugggagcaaucucuuuuuggaugugcucgaacgguagcuuacaaugccggauuuguaucuga

SEQ ID NO: 124928 - RNA, 1701 nt, Artificial Sequence; identical to SEQ ID NO: 124672
  derived and/or modified sequence opt3 from hemagglutinin__InfluenzaA__ACR67192

SEQ ID NO: 124929 - RNA, 1701 nt, Artificial Sequence
  derived and/or modified sequence opt3 from hemagglutinin__InfluenzaA__ACR67193
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugagugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugagcaaggauccggcuacgcagcugacuugaaaucuacacagaacgccaucgaugagauaaccaauaaggugaacagcguuauugaaaagaugaauacgcaguuuaccgcuguggguaaagaguucaaccaccucgaaaagcggaucgagaaucugaacaaaaaggucgacgauggguucuuagacaucuggacauacaaugccgaacugcucgugcuucuggagaacgagcgcacuuuggauuaucaugacucaaauguuaaaaaccuauacgaaaagguacgaagucagcugaaaaacaaugcaaaggagauuggcaacggauguuuugaguucuaucacaagugcgauaauaccuguauggaauccgugaaaaacggcacauacgacuauccuaaguacagcgaagaggccaaacucaauagagaggaaaucgauggggucaagcuggagucuacuaggauuuaucaaauacuugcuaucuacucaaccguggcgaguagccuggucuuggugguuucccucggagcaauuucuuuuuggaugugcucgaacgguagccugcagugccggaucuguaucuga

SEQ ID NO: 124930 - RNA, 1701 nt, Artificial Sequence; identical to SEQ ID NO: 124672
  derived and/or modified sequence opt3 from hemagglutinin__InfluenzaA__ACR67195

SEQ ID NO: 124931 - RNA, 1701 nt, Artificial Sequence; identical to SEQ ID NO: 124672
  derived and/or modified sequence opt3 from hemagglutinin__InfluenzaA__ACR67197

SEQ ID NO: 124932 - RNA, 1701 nt, Artificial Sequence; identical to SEQ ID NO: 124929
  derived and/or modified sequence opt3 from hemagglutinin__InfluenzaA__ACR67198

SEQ ID NO: 124933 - RNA, 1701 nt, Artificial Sequence; identical to SEQ ID NO: 124672
  derived and/or modified sequence opt3 from hemagglutinin__InfluenzaA__ACR67199

SEQ ID NO: 124934 - RNA, 1701 nt, Artificial Sequence; identical to SEQ ID NO: 124685
  derived and/or modified sequence opt3 from hemagglutinin__InfluenzaA__ACR67244

SEQ ID NO: 124935 - RNA, 1701 nt, Artificial Sequence
  derived and/or modified sequence opt3 from hemagglutinin__InfluenzaA__ACR67254
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacguggggucgggaaucauaauuucugauacuccaguacaugacugcaauaccacaugucaaaccccgaaaggcgcaaucaacacgucccuccccuuccagaauauucacccuaucacuaucgguaagugcccaaaguaugugaaaucaacaaagcugcgccuugcuaccgggcugagaaacguccccaguauucagagcaggggauuguuuggcgccauagcgggcuucaucgaagggggauggacugguaugguggacggcugguacggguaucaucaccagaaugaacaaggauccggcuacgccgcagaucucaaaucuacacagaacgcuauugacgagaucaccaauaagguuaacagcgugauagagaaaaugaauacgcaguuuaccgccgucgguaaggaguucaaccaccuggaaaagcggauugaaaauuuaaacaaaaagguggaugacggguuccuggauaucuggacauacaaugcugagcuccuuguacuguuggaaaacgagcgcacucuagacuaucaugauucaaauguuaaaaaccuguacgagaaggugcgaagucagcucaaaaacaaugccaaggaaaucggcaacggauguuuugaguucuaucacaagugcgacaauaccuguauggaauccgucaaaaacggcacauacgauuauccuaaguacagcgaggaagcaaaacugaauagagaggagauugacggggugaaacuugaaucuacuaggaucuaucaaauucuggccauauacucaaccgucgcuaguagcuuggugcucguugugucccugggagcgaucucuuuuuggaugugcucgaacgguagcuuacagugccggauuuguaucuga

SEQ ID NO: 124936 - RNA, 1701 nt, Artificial Sequence; identical to SEQ ID NO: 124685
  derived and/or modified sequence opt3 from hemagglutinin__InfluenzaA__ACR77438

SEQ ID NO: 124937 - RNA, 1701 nt, Artificial Sequence; identical to SEQ ID NO: 124685
  derived and/or modified sequence opt3 from hemagglutinin__InfluenzaA__ACR77448

SEQ ID NO: 124938 - RNA, 1701 nt, Artificial Sequence
  derived and/or modified sequence opt3 from hemagglutinin__InfluenzaA__ACR77458
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugacaaaugcaacauagccgguuggauccugggcaauccugagugugaaucuuugucaacagcaaguagcugguccuacauuguugagaccucuucgucagauaacgggacuugcuauccaggagacuuuaucgauuacgaagaacucagggagcagcugagcaguguguccucuuucgaacgguuugagauuuucccgaagacaagcuccuggcccaaucacgacucaaacaagggcgucaccgccgcuuguccucaugccggugcaaaaaguuuuuauaagaaucugaucuggcucgugaaaaaggggaacagcuacccaaaauuaucuaaguccuauauaaaugauaagggaaaagaaguacugguucuuuggggcauccaccaccccucaacgagcgcugaccaacagaguuuguaccagaacgccgaugcguacguguucgucggcacuucucgcuauuccaagaaauuuaagccugagauugcaauccgaccaaaagugcgugaccaggaggggagaaugaauuacuauuggacccugguggaacccggagauaagauuacauucgaggccacugguaaccuagucguuccuagguacgcuuuugccauggaacggaacgcaggcagcgggaucauaauuucggacaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgagggcggguggacaggaauggucgaugguugguacggcuaucaucaccagaaugaacaagggagcggauacgcagcugaccucaaauccacccagaacgccauugaugagaucacgaauaaggugaacucuguuauagagaaaaugaauacccaguuuacagcugugggcaaggaguucaaccaccuggagaagcggauugaaaauuuaaacaaaaaggucgacgaugguuuccuggacaucuggacuuacaaugccgagcuccuugugcuguuggaaaacgagcgcacccuagauuaucaugacagcaauguaaagaaccuguacgagaagguucgaucacagcucaaaaacaaugcaaaggaaaucgggaacggcuguuuugaguucuaucacaagugcgauaauacauguauggaaagugugaaaaacggaacuuacgacuauccuaaguacuccgaggaagccaaacugaauagagaggagauugauggcgucaaacuugaaagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 124939 - RNA, 1701 nt, Artificial Sequence; identical to SEQ ID NO: 124685
  derived and/or modified sequence opt3 from hemagglutinin__InfluenzaA__ACR77468

SEQ ID NO: 124940 - RNA, 1701 nt, Artificial Sequence; identical to SEQ ID NO: 124685
  derived and/or modified sequence opt3 from hemagglutinin__InfluenzaA__ACR77478

SEQ ID NO: 124941 - RNA, 1701 nt, Artificial Sequence; identical to SEQ ID NO: 124685
  derived and/or modified sequence opt3 from hemagglutinin__InfluenzaA__ACR77488

SEQ ID NO: 124942 - RNA, 1701 nt, Artificial Sequence; identical to SEQ ID NO: 124685
  derived and/or modified sequence opt3 from hemagglutinin__InfluenzaA__ACR77498

SEQ ID NO: 124943 - RNA, 1701 nt, Artificial Sequence; identical to SEQ ID NO: 124672
  derived and/or modified sequence opt3 from hemagglutinin__InfluenzaA__ACR83525

SEQ ID NO: 124944 - RNA, 1701 nt, Artificial Sequence
  derived and/or modified sequence opt3 from hemagglutinin__InfluenzaA__ACR83538
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauuuugaguaggggacucuuuggcgcgauagccggcuucaucgaagggggauggacagguauggucgacggcugguacggguaucaucaccagaaugaacagggaagcggcuacgcagcugaucugaaauccacccaaaacgccauugacgagaucacgaauaaggugaacucuguuauagagaaaaugaauacccaguuuacagcuguggguaaggaguucaaccacuuagaaaagcggauugaaaaucugaacaaaaaggucgaugacggguuccucgauaucuggacuuacaaugccgagcuucugguguugcuagaaaacgagcgcacccuggacuaucaugauagcaauguuaaaaaccucuacgagaagguacgaucacagcugaaaaacaaugcaaaggaaaucggcaacggauguuuugaguucuaucacaagugcgacaauacauguauggaaagugugaaaaacggcacuuacgauuauccuaaguacuccgaggaagccaaacuuaauagagaggagauugacggggucaagcuggaaagcaccaggaucuaucagauuuuggcuauauacucuacaguggcgucaagucucguccuggugguuagcuuaggagcaaucuccuuuuggaugugcucuaacgguucgcugcaaugccggauuuguaucuga

SEQ ID NO: 124945 - RNA, 1701 nt, Artificial Sequence; identical to SEQ ID NO: 124685
  derived and/or modified sequence opt3 from hemagglutinin__InfluenzaA__ACS14666

SEQ ID NO: 124946 - RNA, 1701 nt, Artificial Sequence; identical to SEQ ID NO: 124685
  derived and/or modified sequence opt3 from hemagglutinin__InfluenzaA__ACS14676

SEQ ID NO: 124947 - RNA, 1701 nt, Artificial Sequence; identical to SEQ ID NO: 124685
  derived and/or modified sequence opt3 from hemagglutinin__InfluenzaA__ACS14686

SEQ ID NO: 124948 - RNA, 1701 nt, Artificial Sequence; identical to SEQ ID NO: 124685
  derived and/or modified sequence opt3 from hemagglutinin__InfluenzaA__ACS14696

SEQ ID NO: 124949 - RNA, 1701 nt, Artificial Sequence; identical to SEQ ID NO: 124685
  derived and/or modified sequence opt3 from hemagglutinin__InfluenzaA__ACS14706

SEQ ID NO: 124950 - RNA, 1701 nt, Artificial Sequence; identical to SEQ ID NO: 124685
  derived and/or modified sequence opt3 from hemagglutinin__InfluenzaA__ACS14716

SEQ ID NO: 124951 - RNA, 1701 nt, Artificial Sequence; identical to SEQ ID NO: 124685
  derived and/or modified sequence opt3 from hemagglutinin__InfluenzaA__ACS14726

SEQ ID NO: 124952 - RNA, 1701 nt, Artificial Sequence; identical to SEQ ID NO: 124685
  derived and/or modified sequence opt3 from hemagglutinin__InfluenzaA__ACS14736

SEQ ID NO: 124953 - RNA, 1701 nt, Artificial Sequence; identical to SEQ ID NO: 124865
  derived and/or modified sequence opt3 from hemagglutinin__InfluenzaA__ACS27189

SEQ ID NO: 124954 - RNA, 1701 nt, Artificial Sequence; identical to SEQ ID NO: 124685
  derived and/or modified sequence opt3 from hemagglutinin__InfluenzaA__ACS27199

SEQ ID NO: 124955 - RNA, 1701 nt, Artificial Sequence; identical to SEQ ID NO: 124685
  derived and/or modified sequence opt3 from hemagglutinin__InfluenzaA__ACS27209

SEQ ID NO: 124956 - RNA, 1701 nt, Artificial Sequence; identical to SEQ ID NO: 124738
  derived and/or modified sequence opt3 from hemagglutinin__InfluenzaA__ACS27219

SEQ ID NO: 124957 - RNA, 1701 nt, Artificial Sequence; identical to SEQ ID NO: 124685
  derived and/or modified sequence opt3 from hemagglutinin__InfluenzaA__ACS27229

SEQ ID NO: 124958 - RNA, 1701 nt, Artificial Sequence
  derived and/or modified sequence opt3 from hemagglutinin__InfluenzaA__ACS27239
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguauguccucuuucgaacgguuugagauuuucccgaagacaagcuccuggcccaaucacgauucaaacaagggugugaccgccgcuuguccucaugcaggggccaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgcugaucaacagaguuuguaccagaacgccgacgcguacguuuucguggggucuucccgcuauagcaagaaauuuaagccugagauugcaauccgaccaaaaguccgugaucaggagggaagaaugaauuacuauuggacucugguggaacccggugacaagauuaccuucgaggccacaggcaaccuaguggucccuagguacgcuuuugccauggaacggaacgcagggucgggaaucauaauuucugauacuccaguucaugacugcaauaccacaugucaaaccccgaaaggcgcuaucaacacgucccuccccuuccagaauauucacccuaucacuaucgguaagugcccaaaguaugugaaaucaacaaagcugcgccuugccaccgggcugagaaacguacccaguauucagagcaggggauuguuuggcgcgauagccggcuucaucgaagggggauggacugguaugguggacggcugguacggguaucaucaccagaaugaacaaggauccggcuacgcagcugaucucaaaucuacacagaacgccauugacgagaucaccaauaaggucaacagcgugauagagaaaaugaauacgcaguuuaccgcuguugguaaggaguucaaccaccuggaaaagcggauugaaaauuuaaacaaaaagguggaugacggguuccuggauaucuggacauacaaugccgagcuccuuguccuguuggaaaacgagcgcacucuagacuaucaugauucaaaugugaaaaaccuguacgagaagguacgaagucagcucaaaaacaaugcaaaggaaaucggcaacggauguuuugaguucuaucacaagugcgacaauaccuguauggaauccguuaaaaacggcacauacgauuauccuaaguacagcgaggaagccaaacugaauagagaggagauugacggggugaaacuugaaucuacuaggaucuaucaaauucuggcuauauacucaaccgucgcgaguagcuuggugcucgucgugucccugggagcaaucucuuuuuggaugugcucgaacgguagcuuacagugccggauuuguaucuga

SEQ ID NO: 124959 - RNA, 1701 nt, Artificial Sequence; identical to SEQ ID NO: 124685
  derived and/or modified sequence opt3 from hemagglutinin__InfluenzaA__ACS27249

SEQ ID NO: 124960 - RNA, 1701 nt, Artificial Sequence; identical to SEQ ID NO: 124685
  derived and/or modified sequence opt3 from hemagglutinin__InfluenzaA__ACS27775

SEQ ID NO: 124961 - RNA, 1701 nt, Artificial Sequence; identical to SEQ ID NO: 124672
  derived and/or modified sequence opt3 from hemagglutinin__InfluenzaA__ACS34705

SEQ ID NO: 124962 - RNA, 1701 nt, Artificial Sequence; identical to SEQ ID NO: 124672
  derived and/or modified sequence opt3 from hemagglutinin__InfluenzaA__ACS34966

SEQ ID NO: 124963 - RNA, 1701 nt, Artificial Sequence
  derived and/or modified sequence opt3 from hemagglutinin__InfluenzaA__ACS34967
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagagucgccuggccaccgggcuuagaaacgugcccagcauucaguccaggggacuguuuggcgcgauagccggcuucaucgaagggggauggacugguauggucgacggcugguacggguaucaucaccagaaugaacaaggaucuggcuacgcagcugauuugaaaagcacacagaaggccauugacgagaucaccaacaaaguuaauucagugauagagaagaugaacacgcaguuuaccgcuguggguaaggaguucaaucaccucgaaaaacggauugaaaaccugaauaagaaagucgaugacggguucuuagauaucuggacauacaacgccgagcugcucgugcuucuggaaaaugagcgcacuuuggacuaucaugauaguaacguaaagaaucuauacgagaaaguucgaucccagcugaagaacaacgcaaaggaaaucggcaauggauguuuugaguucuaucacaaaugcgacaacaccuguauggaaagcgugaagaauggcacauacgauuauccuaaauacucugaggaagccaagcucaacagagaggagauugacggggucaaacuggaaucaacuaggaucuaucaaauucuugcuauauacaguaccguggcgagcucccuggucuuggugguuucucucggagcaaucucguuuuggaugugcagcaaugguucccugcagugccggauuuguaucuga

SEQ ID NO: 124964 - RNA, 1701 nt, Artificial Sequence
  derived and/or modified sequence opt3 from hemagglutinin__InfluenzaA__ACS34968
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagucuucgucaagcgacaacggaaccugcuauccaggcgauuuuaucgacuacgaggagcucagggagcagcugaguuccgugucuagcuucgaacgguuugagauuuucccgaagacuuccucauggcccaaucacgauaguaacaagggugucacagccgcuuguccucaugcaggggccaagagcuuuuauaagaaucugaucuggcucgugaaaaagggaaacucuuacccaaaauuauccaagucauauauaaaugacaagggcaaagaaguacugguucuuuggggcauccaccaccccagcaccagugcugaucaacagucuuuguaccagaacgccgacgcguacguguucgucggguccagccgcuauucgaagaaauuuaagccugagauugcaauccgaccaaaagugcgugaucaggagggaagaaugaauuacuauuggacgcugguggaacccggugacaagauuaucuucgaggccacuggcaaccuagucguuccuagguacgcuuuugccauggaacggaacgcagggucuggaauaauuaucuccgauaccccagugcaugacugcaauacaacuugucaaaccccgaaaggcgcuauuaacacaucacuccccuuccagaauauccacccuaucaccauugguaagugcccaaaguauguaaaaaguacgaagcugcgccuugccacugggcugagaaacgugcccagcauacaguccaggggauuguuuggcgcgaucgccggcuucauugaagggggauggacagguauggucgacggcugguacggguaucaucaccagaaugaacaaggaucuggcuacgcagcugaucucaaaagcacccagaacgccaucgacgagauaacuaauaaggugaacucaguuauugagaaaaugaauacacaguuuaccgcuguggguaaggaguucaaccaccuggaaaagcggaucgaaaauuuaaacaaaaaggucgaugacggguuccuggauaucuggacguacaaugccgagcuccuugugcuguuggaaaacgagcgcacccuagacuaucaugauaguaauguuaaaaaccuguacgagaagguacgaucccagcucaaaaacaaugcaaaggaaauuggcaacggauguuuugaguucuaucacaagugcgacaauacauguauggaaagcgugaaaaacggcacuuacgauuauccuaaguacucugaggaagccaaacugaauagagaggagaucgacggggucaaacuugaaucaaccaggauuuaucaaauacuggcuaucuacaguacaguggcgagcuccuugguccucgugguuucucugggagcaauuucguuuuggaugugcagcaacgguuccuuacagugccggaucuguaucuga

SEQ ID NO: 124965 - RNA, 1701 nt, Artificial Sequence
  derived and/or modified sequence opt3 from hemagglutinin__InfluenzaA__ACS36632
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaaggccauugacgagaucaccaacaaagugaauagcguuauagagaagaugaacacgcaguuuaccgcuguggguaaggaguucaaucaccuggaaaaacggauugaaaacuuaaauaagaaagucgaugacggguuccuggauaucuggacauacaacgccgagcuccuugugcuguuggaaaaugagcgcacucuagacuaucaugauucaaacguaaagaaucuguacgagaaaguucgaagucagcucaagaacaacgcaaaggaaaucggcaauggauguuuugaguucuaucacaaaugcgacaacaccuguauggaauccgugaagaauggcacauacgauuauccuaaauacagcgaggaagccaagcugaacagagaggagauugacggggucaaacuugaaucuacuaggaucuaucaaauucuggcuauauacucaaccguggcgaguagcuugguccucgugguuucccugggagcaaucucuuuuuggaugugcucgaaugguagcuuacagugccggauuuguaucuga

SEQ ID NO: 124966 - RNA, 1701 nt, Artificial Sequence
  derived and/or modified sequence opt3 from hemagglutinin__InfluenzaA__ACS36645
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcagggacgaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggucuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguaaagaaccuguacgagaagguucgaagucagcucaaauccaacgccaaggaaaucggcaauggauguuuugaguucuaucacaagugcgacaacacauguauggaaagcgugaaaaauggcacuuacgauuauccuaaguacucugaggaagcaaaacugaacagagaggagauugacgggaucaaacuugaaucaaccaggauuuaucaaauacuggccaucuacaguacagucgcuagcuccuuggugcucgucgugucucugggagcgauuucguuuuggaugugcagcaaugguuccuuacagugccggaucuguaucuga

SEQ ID NO: 124967 - RNA, 1701 nt, Artificial Sequence
  derived and/or modified sequence opt3 from hemagglutinin__InfluenzaA__ACS45035
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcauuuaccagaacgccgacacuuacguguucgucgggaguucucgcuauuccaagaaauuuaagccagagaucgcgauucgacccaaagugcgugaucaggagggaagaaugaauuacuauuggaccuugguggaaccuggugacaagaucacauucgaggcaacuggcaaccuggucguuccaagguacgccuuugcuauggaacggaacgccgggagcggaauaauuaucucggauaccccggugcaugacugcaauacaaccugucaaacgcccaaaggcgcaauuaacacuucucuaccuuuccagaauauccacccaaucacaauugguaagugccccaaguauguaaaauccaccaagcuccgccuggcuacugggcuuagaaacauaccuucaauccagaguaggggacuguuuggcgccauugcgggcuucaucgaagggggauggacagguaugguggacggcugguacggguaucaucaccagaaugaacaaggaagcggcuacgccgcagauuugaaauccacccagaacgcuauagacgagauuacgaauaaggucaacucugugaucgagaaaaugaauacccaguuuacagccguugguaaggaguucaaccaccucgaaaagcggaucgaaaaucugaacaaaaagguggaugacggguucuuagauauuuggacuuacaaugcugagcugcucguccuucuggaaaacgagcgcaccuuggacuaucaugauagcaaugugaaaaaccuauacgagaagguacgaucacagcugaaaaacaaugccaaggaaaucggcaacggauguuuugaguucuaucacaagugcgacaauacauguauggaaaguguuaaaaacggcacuuacgauuauccaaaguacuccgaggaagcaaaacucaauagagaggagauugacggggugaagcuggaaagcaccaggauauaucaaauccuugccauuuacucuacagucgcuucaagucugguguuggucgugagccucggagcgaucuccuuuuggaugugcucuaacgguucgcugcagugccggaucuguauuuga

SEQ ID NO: 124968 - RNA, 1701 nt, Artificial Sequence; identical to SEQ ID NO: 124685
  derived and/or modified sequence opt3 from hemagglutinin__InfluenzaA__ACS50084

SEQ ID NO: 124969 - RNA, 1701 nt, Artificial Sequence; identical to SEQ ID NO: 124927
  derived and/or modified sequence opt3 from hemagglutinin__InfluenzaA__ACS50095

SEQ ID NO: 124970 - RNA, 1701 nt, Artificial Sequence
  derived and/or modified sequence opt3 from hemagglutinin__InfluenzaA__ACS54258
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacuauuacccuaaguauuccgaggaagccaaacugaauagagaggagauugauggggucaaacuugaaagcaccaggaucuaccaaauucuggcuauauacucuacaguggcgucaaguuugguccucgugguuagccugggagcaaucuccuuuuggaugugcucuaacgguucguuacagugccggauuuguaucuga

SEQ ID NO: 124971 - RNA, 1701 nt, Artificial Sequence; identical to SEQ ID NO: 124700
  derived and/or modified sequence opt3 from hemagglutinin__InfluenzaA__ACS54259

SEQ ID NO: 124972 - RNA, 1701 nt, Artificial Sequence; identical to SEQ ID NO: 124672
  derived and/or modified sequence opt3 from hemagglutinin__InfluenzaA__ACS54260

SEQ ID NO: 124973 - RNA, 1701 nt, Artificial Sequence; identical to SEQ ID NO: 124685
  derived and/or modified sequence opt3 from hemagglutinin__InfluenzaA__ACS54261

SEQ ID NO: 124974 - RNA, 1701 nt, Artificial Sequence; identical to SEQ ID NO: 124685
  derived and/or modified sequence opt3 from hemagglutinin__InfluenzaA__ACS54263

SEQ ID NO: 124975 - RNA, 1701 nt, Artificial Sequence; identical to SEQ ID NO: 124685
  derived and/or modified sequence opt3 from hemagglutinin__InfluenzaA__ACS54301

SEQ ID NO: 124976 - RNA, 1701 nt, Artificial Sequence; identical to SEQ ID NO: 124672
  derived and/or modified sequence opt3 from hemagglutinin__InfluenzaA__ACS66821

SEQ ID NO: 124977 - RNA, 1701 nt, Artificial Sequence
  derived and/or modified sequence opt3 from hemagglutinin__InfluenzaA__ACS68822
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaaggucucagggagcagcugagcaguguguccucuuucgagcgguuugaaauuuucccgaagacaagcuccuggcccaaucacgauucaaacaagggggucaccgccgcuuguccucaugcaggagccaaaaguuuuuauaagaaucugaucuggcucgugaaaaagggcaacagcuacccaaaauuaucuaaguccuauauaaaugacaagggcaaagagguacugguucuuugggggauccaccaccccucaacgagcgcugaucaacagaguuuguaccagaacgccgacgcguacguguucgucggaacuucucgcuauuccaagaaauuuaagccugaaauugcaauccgaccaaaagugcgugaucaggaggguagaaugaauuacuauuggacccugguggagcccggcgacaagauuacauucgaagccacugggaaccuagucguuccuagguacgcuuuugccauggagcggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgaaggagguuggacaggcauggucgacgggugguacggauaucaucaccagaaugagcaaggcagcgguuacgcagcugaucucaaauccacccagaacgccauugacgaaaucacgaauaaggugaacucuguuauagagaaaaugaauacccaguuuacagcuguggggaaggaguucaaccaccuggaaaagcggauugagaauuuaaacaaaaagaucgaugacggcuuccuggauaucuggacuuacaaugccgaacuccuuguccuguuggagaacgaacgcacccuagacuaucaugauagcaaugugaaaaaccuguacgagaagguacgaucacagcucaaaaacaaugcaaaggagauuggaaacggcuguuuugaguucuaucacaagugcgacaauacauguauggaaaguguuaaaaacgggacuuacgauuauccuaaguacuccgaagaggccaaacugaauagagaagagaucgacggagugaaacuugagagcaccaggauuuaucaaauacuggcuaucuacucuacagucgcgucaaguuuggugcucgucgugagccugggugcaauuuccuuuuggaugugcucuaacggcucguuacagugccggaucuguaucuga

SEQ ID NO: 124978 - RNA, 1701 nt, Artificial Sequence; identical to SEQ ID NO: 124685
  derived and/or modified sequence opt3 from hemagglutinin__InfluenzaA__ACS75821

SEQ ID NO: 124979 - RNA, 1701 nt, Artificial Sequence; identical to SEQ ID NO: 124685
  derived and/or modified sequence opt3 from hemagglutinin__InfluenzaA__ACS77926

SEQ ID NO: 124980 - RNA, 1701 nt, Artificial Sequence; identical to SEQ ID NO: 124685
  derived and/or modified sequence opt3 from hemagglutinin__InfluenzaA__ACS77936

SEQ ID NO: 124981 - RNA, 1701 nt, Artificial Sequence; identical to SEQ ID NO: 124778
  derived and/or modified sequence opt3 from hemagglutinin__InfluenzaA__ACS77946

SEQ ID NO: 124982 - RNA, 1701 nt, Artificial Sequence; identical to SEQ ID NO: 124685
  derived and/or modified sequence opt3 from hemagglutinin__InfluenzaA__ACS77956

SEQ ID NO: 124983 - RNA, 1701 nt, Artificial Sequence; identical to SEQ ID NO: 124685
  derived and/or modified sequence opt3 from hemagglutinin__InfluenzaA__ACS77966

SEQ ID NO: 124984 - RNA, 1701 nt, Artificial Sequence; identical to SEQ ID NO: 124685
  derived and/or modified sequence opt3 from hemagglutinin__InfluenzaA__ACS77976

SEQ ID NO: 124985 - RNA, 1701 nt, Artificial Sequence; identical to SEQ ID NO: 124927
  derived and/or modified sequence opt3 from hemagglutinin__InfluenzaA__ACS77986

SEQ ID NO: 124986 - RNA, 1701 nt, Artificial Sequence
  derived and/or modified sequence opt3 from hemagglutinin__InfluenzaA__ACS77996
augaaggccacccuggugguccuccuuuacacauucgcuacugcaaacgccgacacgcugugcaucggcuaucacgcgaauaacagcaccgauacaguugacacuguguuggagaaaaauguaaccgugacacauuccgucaacuuacuggaagauaagcacaaugggaaacuauguaagcucagaggaguggcuccccugcaucuugguaaaugcaacauugccggcuggauacuggggaauccugagugugaaucuuugucaaccgcaaguagcugguccuacaucguugagacuucuucgucagacaacggaacaugcuauccaggcgauuuuauugacuacgaggagcucagggagcagcugagcaguguguccucuuucgaacgguuugagaucuucccgaagaccagcuccuggcccaaucacgauucaaacaagggugucacggccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacuagcgcugaucaacagaguuuguaccagaacgccgacgcguacguguucgucgggaccucucgcuauuccaagaaauuuaagccugagaucgcaauucgaccaaaagugcgugaucaggagggaagaaugaauuacuauuggacacugguggaacccggugacaagaucacuuucgaggccaccggcaaccuagucguuccuagguacgcuuuugccauggaacggaacgcagggagcggaauuaucauaucggauacaccagugcaugacugcaauaccacgugucaaacuccgaaaggcgcuauuaacacaucucuccccuuccagaauauccacccuauuaccaucgguaagugcccaaaguauguaaaauccacuaagcugcgccuugccacagggcugagaaacgugcccucaauccagaguaggggauuguuuggcgcgauugccggcuucauagaagggggauggaccgguauggucgacggcugguacggguaucaucaccagaaugaacaaggaagcggcuacgcagcugaucucaaauccacgcagaacgccaucgacgagauuaccaauaaggugaacucuguuaucgagaaaaugaauacacaguuuacugcuguggguaaggaguucaaccaccuggaaaagcggauagaaaauuuaaacaaaaaggucgaugacggguuccuggauauuuggaccuacaaugccgagcuccuugugcuguuggaaaacgagcgcacacuagacuaucaugauagcaauguaaagaaccuguacgagaagguucgaucacagcucaaaaacaaugcaaaggaaaucggcaacggauguuuugaguucuaucacaagugcgacaauacuuguauggaaagugugaaaaacggcaccuacgauuauccuaaguacuccgaggaagccaaacugaauagagaggagaucgacggggucaaacuugaaagcacaaggauuuaucaaauccuggcuauuuacucuaccguggcgucaaguuugguccucgugguuagccugggagcaauauccuuuuggaugugcucuaacgguucguuacagugccggaucuguauuuga

SEQ ID NO: 124987 - RNA, 1701 nt, Artificial Sequence; identical to SEQ ID NO: 124685
  derived and/or modified sequence opt3 from hemagglutinin__InfluenzaA__ACS78006

SEQ ID NO: 124988 - RNA, 1701 nt, Artificial Sequence; identical to SEQ ID NO: 124685
  derived and/or modified sequence opt3 from hemagglutinin__InfluenzaA__ACS78016

SEQ ID NO: 124989 - RNA, 1701 nt, Artificial Sequence
  derived and/or modified sequence opt3 from hemagglutinin__InfluenzaA__ACS78026
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagaucagcuccuggcccaaucacgauucaaaccgcggugucacagccgcuuguccucaugcaggggccaagaguuuuuauaaaaaucugauauggcucgugaagaaaggaaacagcuacccaaaguuaaucaaaucuuauauuaaugacaagggcaaggaaguacugguucuuuggggcauccaccaccccuccaccucagcugaucaacagagcuuguaccagaacgccgacgcguacguguucgucgggaguucucgauauuccaaaaaguuuaaaccugagauugcaauccguccaaaggugagagaucaggagggaaggaugaauuacuauuggacgcugguggaacccggugacaaaauaacuuucgaggccaccggcaaccuagucguuccucgguacgcuuuugccauggaacgcaacgcagggagcggaauuaucauuucggauacaccagugcaugacugcaauacuaccugucaaacaccgaagggcgcuaucaacaccucucuccccuuccagaauauccacccuauuacgauagguaaaugcccaaaguauguaaaguccacuaaacugagacuugccacagggcugaggaacgugcccucaauccagagucggggauuguuuggcgcgauugccggcuucaucgaagggggauggaccgguauggucgacggcugguacggguaucaucaccagaaugaacaaggaagcggcuacgcagcugaucucaaguccacucagaacgccauagacgagauuacaaauaaagugaacucuguuaucgagaagaugaauacccaguuuacggcuguggguaaagaguucaaccaccuggaaaagcgcaucgaaaauuuaaacaagaaagucgaugacggguuccuggauauuuggaccuacaaugccgagcuccuugugcuguuggaaaacgagcgaacacuagacuaucaugauagcaauguaaagaaccuguacgagaaaguuagaucacagcucaagaacaaugcaaaagaaaucggcaacggauguuuugaguucuaucacaagugcgacaauacuuguauggaaagugugaagaacggcaccuacgauuauccuaaauacuccgaggaagccaagcugaauagggaggagauugacggggucaaacuugaaagcacacggauauaucaaauccuggcuauuuacucuacuguggcgucaaguuugguccucgugguuagccugggagcaaucuccuuuuggaugugcucuaacgguucguuacagugccguaucuguauuuga

SEQ ID NO: 124990 - RNA, 1701 nt, Artificial Sequence; identical to SEQ ID NO: 124927
  derived and/or modified sequence opt3 from hemagglutinin__InfluenzaA__ACS78036

SEQ ID NO: 124991 - RNA, 1701 nt, Artificial Sequence; identical to SEQ ID NO: 124927
  derived and/or modified sequence opt3 from hemagglutinin__InfluenzaA__ACS78046

SEQ ID NO: 124992 - RNA, 1701 nt, Artificial Sequence; identical to SEQ ID NO: 124700
  derived and/or modified sequence opt3 from hemagglutinin__InfluenzaA__ACS92569

SEQ ID NO: 124993 - RNA, 1701 nt, Artificial Sequence; identical to SEQ ID NO: 124700
  derived and/or modified sequence opt3 from hemagglutinin__InfluenzaA__ACS92579

SEQ ID NO: 124994 - RNA, 1701 nt, Artificial Sequence; identical to SEQ ID NO: 124685
  derived and/or modified sequence opt3 from hemagglutinin__InfluenzaA__ACS92589

SEQ ID NO: 124995 - RNA, 1701 nt, Artificial Sequence
  derived and/or modified sequence opt3 from hemagglutinin__InfluenzaA__ACS92612
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccauccacgauucaaauaagggugucaccgccgcuuguccucaugcaggggccaaaaguuuuuauaagaaccugauauggcucgugaaaaagggaaauagcuacccaaaauuaucuaaguccuauaucaacgacaagggcaaagaaguacugguucuuuggggcauucaccaccccucaacgagcgcugaucaacagaguuuguaccagaaugccgacgcguacguguucgucgggucuucccgcuauagcaagaaauuuaagccugagaucgcaauucgaccaaaagugcgugaucaggagggaagaaugaacuacuauuggacucugguggaacccggugacaagaucaccuucgaggccacaggcaaucuagucguuccuagguacgcuuuugccauggaacggaacgcagggucgggaauaauuaucucugauacuccagugcaugacugcgacaccacaugucaaaccccgaaaggcgcuauuaacacgucccuccccuuccagaauauccacccuaucacuauugguaagugcccaaaguauguaaaaucaacaaagcugcgccuugccaccgggcugagaaacauacccaguauccagagcaggggauuguuuggcgcgauugccggcuucaucgaagggggauggacugguaugguggauggcugguacggguaucaucaccagaaugaacaaggauccggcuacgcagcugaccucaaaucuacacagaacgccauagaugagauuaccaauaaggucaacagcgugaucgagaaaaugaauacgcaguuuaccgcuguugguaaggaguucaaccaccuggaaaagcggaucgaaaauuuaaacaaaaagguggacgauggguuccuggacauuuggacauacaaugccgagcuccuuguccuguuggaaaacgagcgcacucuagauuaucaugacucaaaugugaaaaaccuguacgagaagguacgaagucagcucaaaaauaacgcaaaggaaaucggcaacggauguuuugaguucuaucacaagugcgauaauaccuguauggaauccguuaaaaacggcacauacgacuauccuaaguacagcgaggaagccaaacugaauagagaggagauugauggggugaaacuugaaucuacuaggauauaucaaauccuggcuauuuacucaaccgucgcgaguagcuuggugcucgucgugucccugggagcaaucucuuuuuggaugugcucgaacgguagcuuacagugccggaucuguauuuga

SEQ ID NO: 124996 - RNA, 1701 nt, Artificial Sequence; identical to SEQ ID NO: 124685
  derived and/or modified sequence opt3 from hemagglutinin__InfluenzaA__ACT10307

SEQ ID NO: 124997 - RNA, 1701 nt, Artificial Sequence; identical to SEQ ID NO: 124685
  derived and/or modified sequence opt3 from hemagglutinin__InfluenzaA__ACT10314

SEQ ID NO: 124998 - RNA, 1701 nt, Artificial Sequence
  derived and/or modified sequence opt3 from hemagglutinin__InfluenzaA__ACT11057
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaagugggcaacggauguuuugaguucuaucacaagugcgacaauaccuguauggaauccgucaaaaacggcacauacgauuauccuaaguacagcgaggaagccaaacucaauagagaggagauugacggggugaagcuggaaucuacuaggaucuaucaaauucuugcuauauacucaaccgucgcgaguagccugguguugguugugucccucggagcaaucucuuuuuggaugugcucgaacgguagccugcagugccggauuuguaucuga

SEQ ID NO: 124999 - RNA, 1704 nt, Artificial Sequence
  derived and/or modified sequence opt3 from hemagglutinin__InfluenzaA__ACT15312
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaucuccugagcaggauuaaucacuucgagaaaauccagauuaucccuaagaacuccuggucugaccaugaggcuucgggagucucaagcgccuguccauaccagggccggaguuccuuuuuccgcaaugugguauggcugacuaaaaagaacaaugcauaucccacaauaaaacgaucuuacaacaacaccaaucaagaagaucucuuaguucugugggguauucaccacccuaacgacgccgcugagcagacacgucuuuaucagaauccaaccacuuacaucagcguggggacauccaccuugaaccagagacugguccccaagauugcaacgaggucaaaggugaauggacaaaguggccggauggaauuuuucuggacuauccuaaaaagcaacgaugccaucaauuuugagucuaacggcaauuucauugcuccugaaaacgccuacaagauagugaaaaagggggacuccaccaucaugaaaucagagcucgaauauggaaauugcaacacaaagugucagacuccaauuggugcgaucaauagcaguaugccguuucauaacauacacccccugaccauuggcgagugcccuaaauacgucaagucuaaucgccuuguucuggcaacaggguugagaaacuccccacagggagagaggcggcgcaagaaacgaggccucuucggugccaucgcuggguuuaucgaaggaggcuggcagggcaugguggaugggugguauggauaccaucacagcaacgagcaagguucgggcuaugccgcagacaaggaaucuacccagaaagcuauugacgggguaacgaauaaggugaacuccaucauugauaaaaugaauacucaguucgaggccgucggaagagaauuuaacaaucuggagaggcggauagagaacuuaaauaagaagauggaagacggcuuccuggauguguggacauacaacgcggagcuccuuguucugauggaaaaugagcguaccuuggacuuccacgauucaaacgugaaaaaucuauaugacaagguccgccugcaacucagagauaacgccaaagaacuggguaauggguguuuugaguucuaccauaggugcgacaacgaguguauggaaagugugcggaauggcacuuacgauuauccccaguacagcgaggaagcacgacuuaagcgcgaggagaucuccggaguaaaacuggaaucuauuggcacauaucagaucuugagcaucuacucaaccguugcuaguucccucgcccuggcuauuaugguggccggguuauuucuguggaugugcagcaacggaucucuacagugcagaauauguaucuga

SEQ ID NO: 125000 - RNA, 1704 nt, Artificial Sequence
  derived and/or modified sequence opt3 from hemagglutinin__InfluenzaA__ACT15314
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaagaacaaugcauaucccacaaucaaacgaucuuacaacaacaccaaucaagaagauuuacugguucuuugggguauacaccacccuaacgacgccgcugagcagacacguuuguaucagaauccaaccacuuacauuagcguggggacauccacccugaaccagaggcuaguccccaagaucacgacuagaucaaaggugaauggacaaaguggccggauggaauuuuucuggaccauucucaaaagcaacgaugcaaucaauuuugagucuaacggcaauuucaucgccccugaaaacgcuuacaagauugugaaaaagggggacuccacaauaaugaaaucagagcuggaauauggaaauugcaacacuaagugucagaccccaaucggugccauuaauagcaguaugccguuucauaacauccacccccuuacaauaggcgagugcccuaaauacgucaagucuaaucgccugguuuuggcgaccgggcucagaaacuccccacagggagagaggcggcgcaagaaacgaggccuguucggugcaauugccggguuuaucgaaggaggcuggcagggcaugguggaugggugguauggauaccaucacagcaacgagcaagguucgggcuaugcugccgacaaggaaucuacgcagaaagcaaucgacgggguaacuaauaaggugaacuccauuaucgauaaaaugaauacacaguucgaggcugucggaagagaauuuaacaauuuagagaggcggauugagaaccugaauaagaagauggaagacggcuuccucgauguguggaccuacaacgccgagcuucugguuuugauggaaaaugagcguacucuagacuuccacgauucaaacgugaaaaaucuguaugacaagguccgccuccaacugagagauaacgcgaaagaacuugguaauggguguuuugaguucuaccauaggugcgacaacgaguguauggaaagugugcggaauggcacauacgauuauccccaguacagcgaggaagcccgacugaagcgcgaggagauauccggaguaaaauuggaaucuaucggcaccuaucagauucucagcaucuacucaacgguugcaaguucccuggcuuuagccaucaugguggcugggcuguuucuauggaugugcagcaacggaucucuccagugcagaauuuguauauga

SEQ ID NO: 125001 - RNA, 1704 nt, Artificial Sequence
  derived and/or modified sequence opt3 from hemagglutinin__InfluenzaA__ACT15316
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaaggauaacgcauaucccacaaucaaacgaucuuacaauaacaccaaccaagaagacuuacugguucuuugggguauacaccacccuaaugaugccgcugagcagacacguuuguaucagaacccaaccacuuacauuagcguggggacauccacccugaaucagagacuaauccccaagauugcaacgaggucaaaggucaacggacaaaguggccggauggaauuuuucuggacuauccucaaaagcaaugacgccaucaacuuugagucuaauggcaacuucauugcuccugaaaaugccuacaagauagugaaaaagggggauuccaccaucaugaaaucagagcuggaauauggaaacugcaauacaaagugucagacuccaauuggugcgaucaacagcaguaugccguuucauaauauacacccccuuaccauuggcgagugcccuaaauacgugaagucuaaccgccuggucuuggcaacagggcucagaaauuccccacagggagagaggcggcgcaagaaacgaggccuguucggugccaucgcuggguuuaucgaaggaggcuggcagggcaugguugacgggugguauggauaccaucacagcaacgagcaagguucgggcuaugccgcagacaaggaaucuacccagaaagcuauugauggggugacgaacaagguaaauuccaucauugacaaaaugaacacucaguucgaggccgugggaagagaauuuaauaacuuagagaggcggauagagaaucugaacaagaagauggaagauggcuuccucgacgucuggacauacaaugcggagcuucugguguugauggaaaacgagcguacccuagauuuccacgacucaaauguuaaaaaccuguaugauaaggugcgccuccaacugagagacaaugccaaagaacuugguaacggguguuuugaguucuaccauaggugcgauaaugaguguauggaaaguguccggaacggcacuuacgacuauccccaguacagcgaggaagcacgacugaagcgcgaggagaucuccggagugaaauuggaaucuauuggcacauaucagauccucagcaucuacucaaccguagcuaguucccuggccuuagcuauuaugguugccgggcuguuucuauggaugugcagcaauggaucucuccagugcagaauauguaucuga

SEQ ID NO: 125002 - RNA, 1704 nt, Artificial Sequence
  derived and/or modified sequence opt3 from hemagglutinin__InfluenzaA__ACT15320
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggaaugucaagcgccuguccauaccagggccggaguuccuuuuuccgcaaugucguguggcucacuaaaaaggauaacgcauaucccacaaucaaacgaucuuacaauaacaccaaccaagaagacuuacugguacuuugggguauacaccacccuaaugaugccgcugagcagacacguuuguaucagaacccaaccacuuacauuagcguugggacauccacccugaaucagaggcuagugcccaagaucgcaacgagaucaaaggucaacggacaaaguggccggauggaauuuuucuggacuauucucaaaagcaaugacgccaucaacuuugagucuaauggcaacuucaucgcuccugaaaaugccuacaagauugugaaaaagggggauuccaccauaaugaaaucagagcuggaauauggaaacugcaauacaaagugucagacuccaaucggugcgauuaacagcaguaugccguuucauaauauccacccccuuaccauaggcgagugcccuaaauacgugaagucuaaccgccuggucuuggcaacagggcucagaaauuccccacagggagagaggcggcgcaagaaacgaggccuguucggugccauugcuggguuuaucgaaggaggcuggcagggcaugguugacgggugguauggauaccaucacagcaacgagcaagguucgggcuaugccgcagacaaggaaucuacccagaaagcuaucgauggggugacgaacaagguaaauuccauuaucgacaaaaugaacacucaguucgaggccgugggaagagaauuuaauaacuuagagaggcggauugagaaucugaacaagaagauggaagauggcuuccucgacgucuggacauacaaugcggagcuucugguguugauggaaaacgagcguacccuagauuuccacgacucaaauguuaaaaaccuguaugauaaggugcgccuccaacugagagacaaugccaaagaacuugguaacggguguuuugaguucuaccauaggugcgauaaugaguguauggaaaguguccggaacggcacuuacgacuauccccaguacagcgaggaagcacgacugaagcgcgaggagauauccggagugaaauuggaaucuaucggcacauaucagauucucagcaucuacucaaccguagcuaguucccuggccuuagcuaucaugguugccgggcuguuucuauggaugugcagcaauggaucucuccagugcagaauuuguauauga

SEQ ID NO: 125003 - RNA, 1704 nt, Artificial Sequence
  derived and/or modified sequence opt3 from hemagglutinin__InfluenzaA__ACT15322
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaaggauaacgcauaucccacaaucaaacgaucuuacaauaacaccaaccaagaagacuuacugguucuuugggguauacaccacccuaaugaugccgcugagcagacacguuuguaucagaacccaaccacuuacauuagcguggggacauccacccugaaucagaggcuaguccccaagaucgcaacgagaucaaaggugaacggacaaaguggccggauggaauuuuucuggacuauucucaaaagcaaugacgccaucaacuuugagucuaauggcaacuucaucgcuccugaaaaugccuacaagauugugaaaaagggggauuccaccauaaugaaaucagagcuggaauauggaaacugcaauacaaagugucagacuccaaucggugcgauuaacagcaguaugccguuucauaauauccacccccuuaccauaggcgagugcccuaaauacgucaagucuaaccgccugguuuuggcaacagggcucagaaauuccccacagggagagaggcggcgcaagaaacgaggccuguucggugccauugcuggguuuaucgaaggaggcuggcagggcaugguggacgggugguauggauaccaucacagcaacgagcaagguucgggcuaugccgcagacaaggaaucuacccagaaagcuaucgaugggguaacgaacaaggucaauuccauuaucgacaaaaugaacacucaguucgaggccgugggaagagaauuuaauaacuuagagucaaggauugagaaucugaacaagaagauggaagauggcuuccucgacguguggacauacaaugcggagcuucugguuuugauggaaaacgagcggacccuagauuuccacgacaguaaugugaaaaaccuguaugauaagguccgucuccaacugcgcgacaaugccaaagaacuugguaacggguguuuugaguucuaccauagaugcgauaaugaguguauggaaagcgugaggaacggcacuuacgacuauccccaguacuccgaggaagcacggcugaagcgagaggagauaucuggaguaaaauuggaaagcaucggcacauaucagauucucucaaucuacaguaccguugcuuccagccuggccuuagcuaucaugguggccgggcuguuucuauggaugugcucuaauggaucacuccagugccgcauuuguauauga

SEQ ID NO: 125004 - RNA, 1704 nt, Artificial Sequence
  derived and/or modified sequence opt3 from hemagglutinin__InfluenzaA__ACT15326
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaaggauaacgcauaucccacaaucaaacgaucuuacaauaacaccaaccaagaagacuuacugguucuuugggguauacaccacccuaaugaugccgcugagcagacacguuuguaucagaacccaaccacuuacauuagcguggggacauccacccugaaucagagacuaauccccaagauugcaacgaggucaaaggucaacggacaaaguggccggauggaauuuuucuggacuauccucaaaccuaaugacgccaucaacuuugagagcaauggcaacuucauugcuccagaaaaugccuacaagauagugaaaaagggggauucuaccaucaugaaauccgagcuggaauauggaaacugcaauacaaagugucagacuccgauuggugcgaucaacucaagcaugcccuuucauaauauacacccucuuaccauuggcgagugcccaaaauacgugaagaguaaccgccuggucuuggcaacagggcucagaaauucuccccagggagagaggcggcgcaagaaacgaggccuguucggugccaucgcuggguuuaucgaaggaggcuggcagggcaugguugacgggugguauggauaccaucacuccaacgagcaagguagcggcuaugccgcagacaaggaaucgacccagaaagcuauugauggggugacgaacaagguaaauucuaucauugacaaaaugaacacucaguucgaggccgugggaagagaauuuaauaacuuagagaggcggauagagaaucugaacaagaagauggaagauggcuuccucgacgucuggacauacaaugcggagcuucugguguugauggaaaacgagcguacccuagauuuccacgacuccaauguuaaaaaccuguaugauaaggugcgccuccaacugagagacaaugccaaagaacuugguaacggguguuuugaguucuaccauaggugcgauaaugaguguauggaaucaguccggaacggcacuuacgacuauccucaguacagugaggaagcacgacugaagcgcgaggagaucagcggagugaaauuggaauccauuggcacauaucagauccucucuaucuacagcaccguagcuucaagucuggccuuagcuauuaugguugccgggcuguuucuauggaugugcuccaauggaagccuccagugcagaauauguaucuga

SEQ ID NO: 125005 - RNA, 1704 nt, Artificial Sequence
  derived and/or modified sequence opt3 from hemagglutinin__InfluenzaA__ACT15328
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaaggauaacgcauaucccacaaucaaacgaucuuacaauaacaccaaccaagaagacuuacugguucuuugggguauacaccacccuaaugaugccgcugagcagacacguuuguaucagaacccaaccacuuacauuagcguggggacauccacccugaaucagaggcuaguccccaagaucgcaacgagaucaaaggugaacggacaaaauggccggauggaauuuuucuggacuauucucaaaaguaacgacgccaucaauuuugagagcaacggcaauuucaucgcuccugaaaacgccuacaagauugugaaaaagggggauucuaccauaaugaaauccgagcuggaauauggaaauugcaacacaaagugucagacuccaaucggugcgauuaauucaagcaugccguuucauaacauccacccccuuaccauaggcgagugcccuaaauacgucaagaguaaucgccugguuuuggcaacagggcucagaaacucuccacagggagagaggcggcgcaagaaacgaggccuguucggugccauugcuggguuuaucgaaggaggcuggcagggcaugguggacgggugguauggauaccaucacuccaacgagcaagguagcggcuaugccgcagacaaggaaucgacccagaaagcuaucgaugggguaacgaauaaggugaacucuauuaucgacaaaaugaauacucaguucgaggccgucggaagagaauuuaacaauuuagagaggcggauugagaaccugaauaagaagauggaagauggcuuccucgacguguggacauacaacgcggagcuucugguuuugauggaaaaugagcguacccuagauuuccacgacuccaacgugaaaaaucuguaugauaagguccgccuccaacugagagacaacgccaaagaacuugguaauggguguuuugaguucuaccauaggugcgauaacgaguguauggaaucagugcggaauggcacuuacgacuauccccacuacagugaggaagcacgacugaagcgcgaggagauaagcggaguaaaauuggaauccaucggcacauaucagauucucucuaucuacagcaccguugcuucaagucuggccuuagcuaucaugguggccgggcuguuucuauggaugugcuccaacggaagccuccagugcagaauuuguauauga

SEQ ID NO: 125006 - RNA, 1704 nt, Artificial Sequence
  derived and/or modified sequence opt3 from hemagglutinin__InfluenzaA__ACT15330
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaaggauaacgcauaucccacaaucaaacgaucuuacaauaacaccaaccaagaagacuuacugguucuuugggguauacaccacccuaaugaugccgcugagcagacacguuuguaucagaacccaaccacuuacauuagcguggggacauccacccugaaucagaggcuaguccccaagaucgcaacgagaucaaaggugaacggacaaaguggccggauggaauuuuucuggacuauucucaaaagcaaugacgccaucaacuuugagucuaauggcaacuucaucgcuccugaaaaugccuacaagauugugaaaaagggggauuccaccauaaugaaaucagagcuggaauauggaaacugcaauacaaagugucagacuccaaucggugcgauuaacagcaguaugccguuucauaauauccacccccuuaccauaggcgagugcccuaaauacgucaagucuaaccgccugguuuuggcaacagggcucagaaauuccccacagggagagaggcggcgcaagaaacgaggccuguucggugccauugcuggguuuaucgaaggaggcuggcagggcaugguggacgggugguauggauaccaucacagcaacgagcaagguucgggcuaugccgcagacaaggaaucuacccagaaagcuaucgaugggguaacgaacaaggucaauuccauuaucgacaaaaugaacacucaguucgaggccgugggaagagaauuuaauaacuuagagaggcggauugagaaucugaacaagaagauggaagauggcuuccucgacguguggacauacaaugcggagcuucugguuuugauggaaaacgagcguacccuagauuuccacgacucaaaugugaaaaaccuguaugauaagguccgccuccaacugagagacaaugccaaagaacuugguaacggguguuuugaguucuaccauaggugcgauaaugaguguauggaaagugugcggaacggcacuuacgacuauccccacuacagcgaggaagcacgacugaagcgcgaggagauauccggaguaaaauuggaaucuaucggcacauaucagauucucagcaucuacucaaccguugcuaguucccuggccuuagcuaucaugguggccgggcuguuucuauggaugugcagcaauggaucucuccagugcagaauuuguauauga

SEQ ID NO: 125007 - RNA, 1707 nt, Artificial Sequence
  derived and/or modified sequence opt3 from hemagglutinin__InfluenzaA__ACT15332
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccggggacuuuaacgauuaugaggaacucaagcaucugcugagcaggaucaaucacuucgagaaaauucagaucauuccuaaguccucuuggucggaccaugaagcuaguagcggagucaguuccgccuguccauaccagggccggucuagcuuuuuccgcaacgugguauggcucaucaaaaaggauaaugcauaucccacaauaaaacgauccuacaacaauacuaaccaagaggacuuacugguucuuugggguauucaccacccuaaugaugccgcugagcagacccguuuguaucauaacccaacaaccuacaucucaguggggacuucaacacugaaccagaggcuaguccccaagauugcaaccagaagcaagaucaauggacagucuggccggauggaauuuuucuggacgauccucaaaccuaacgacgccauuaauuuugaguccaacggcaauuucauagcuccagaaaacgccuacaagaucgugaaaaagggggacucaacuauuaugaaaagcgagcuggaauauggaaauugcaacaccaagugucaaacaccgaucggugcgauaaauaguucuaugcccuuucacaacauucauccucuuacuaucggcgagugcccaaaauacgugaaguccagccgccuggucuuggcaaccgggcucagaaauucgccccagggaaagucuaggcggaaaaagcgcggccuguucggugccaucgcuggguuuauugagggaggcuggcagggcaugguugaugggugguauggauaccaccacuccaacgaacaggguucaggcuaugccgcagacaaagagaguacacaacgagcuaucgauggggugaccaauaagguaaacagcauuauagacaaaaugaauacgcaguucgaagccgugggaagagaguuuaacaacuuagaaaggcggaucgagaaucugaacaagaagauggaggauggcuuccucgacgucuggacuuacaaugcggaacuucugguguugauggagaacgaacguacacuagauuuccaugacuccaauguuaaaaaccuguaugauaaggugcgccuccagcugagagacaaugccaaagagcuugguaacggguguuuugaguucuaccacaggugcgauaaugaauguauggagucuguccggaacggcaccuacgacuauccucaauacagcgaagaggcacgacugaagcgcgaagagauuucaggagugaaauuggagaguaucggcaucuaucagauucucuccauauacagcacuguagcuucuucacuggccuuagcuaucaugguugccgggcuguuucuauggaugugcaguaauggaagccuccagugcagaauuuguaucuga

SEQ ID NO: 125008 - RNA, 1704 nt, Artificial Sequence
  derived and/or modified sequence opt3 from hemagglutinin__InfluenzaA__ACT15336
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaaggauaacgcauaucccacaaucaaacgaucuuacaauaacaccaaccaagaagacuuacugguucuuugggguauacaccacccuaaugaugccgcugagcagacacguuuguaucagaacccaaccacuuacauuagcguggggacauccacccugaaucagaggcuaguccccaagaucgcaacgagaucaaaggugaacggacaaaguggccggauggaauuuuucuggacuauucucaaaagcaaugacgccaucaacuuugagucuaauggcaacuucaucgcuccugaaaaugccuacaagauugugaaaaagggggauuccaccauaaugaaaucagagcuggaauauggaaacugcaauacaaagugucagacuccaaucggugcgauuaacagcaguaugccguuucauaauauccacccccuuaccauaggcgagugcccuaaauacgucaagucuaaccgccugguuuuggcaacagggcucagaaauuccccacagggagagaggcggcgcaagaaacgaggccuguucggugccauugcuggguuuaucgaaggaggcuggcagggcaugguggacgggugguauggauaccaucacagcaacgagcaagguucgggcuaugccgcagacaaggaaucuacccagaaagcuaucgaugggguaacgaacaaggucaauuccauuaucgacaaaaugaacacucaguucgaggccgugggaagagaauuuaauaacuuagagaggcggauugagaaucugaacaagaagauggaagauggcuuccucgacguguggacauacaaugcggagcuucugguuuugauggaaaacgagcguacccuagauuuccacgacucaaaugugaaaaaccuguaugauaagguccgccuccaacugagagacaaugccaaagaacuugguaacggguguuuugaguucuaccauaggugcgauaaugaguguauggaaagugugcggaacggcacuuacgacuauccccaguacagcgaggaagcacgacugaagcgcgaggagauauccggaguaaaauuggaaucuaucggcacauaucagauucucagcaucuacucaaccguugcuaguucccuggccuuagcuaucaugguggccgggcuguuucuauggaugugcagcaauggaucucuccagugcagaauuuguauauga

SEQ ID NO: 125009 - RNA, 1704 nt, Artificial Sequence
  derived and/or modified sequence opt3 from hemagglutinin__InfluenzaA__ACT15338
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaagaacaaugcauaucccacaaucaaacgaucuuacaacaacaccaaucaagaagauuuacugguucuuugggguauacaccacccuaacgacgccacagagcagacccguuuguaucagaauccaacuacauacauuagcguggggaccuccacgcugaaccagagacuaauccccaagauugcuacuaggucaaaggucaauggacaaaguggccggauggaauuuuucuggaccauccucaaaagcaacgaugcaaucaauuuugagucuaacggcaauuucauugccccugaaaacgcuuacaagauagugaaaaagggggacuccacaaucaugaaaucagagcuggaauauggaaauugcaacacuaagugucagaccccaauuggugccaucaauagcaguaugccguuucauaacauacacccccuuacaauuggcgagugcccuaaauacgugaagucuaaucgccuggucuuggcgaccgggcucagaaacuccccacaggagggaaggcggcgcaagaaacgaggccuguucggugcaaucgccggguuuaucgaaggaggcuggcagggcaugguugaugggugguauggauaccaucacagcaacgagcaagguucgggcuaugcugccgacaaggaaucuacgcagaaagcaauugacggggugacuaauaagguaaacuccaucauugauaaaaugaauacacaguucgaggcugugggaagagaauuuaacaauuuagagaggcggauagagaaccugaauaagaagauggaagacggcuuccucgaugucuggaccuacaacgccgagcuucugguguugauggaaaaugagcguacucuagacuuccacgauucaaacguuaaaaaucuguaugacaaggugcgccuccaacugagagauaacgcgaaagaacuugguaauggguguuuugaguucuaccauaggugcgacaacgaguguauggaaaguguccggaauggcacauacgauuauccccaguacagcgaggaagcccgacugaagcgcgaggagaucuccggagugaaauuggaaucuauuggcaccuaucagauccucagcaucuacucaacgguagcaaguucccuggcuuuagccauuaugguugcugggcuguuucuauggaugugcagcaacggaucucuccagugcagaauauguaucuga

SEQ ID NO: 125010 - RNA, 1704 nt, Artificial Sequence
  derived and/or modified sequence opt3 from hemagglutinin__InfluenzaA__ACT15340
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaagaacaaugcauaucccacaaucaaacgaucuuacaacaacaccaaucaagaagauuuacugguucuuugggguauacaccacccuaacgacgccgaggaacagacacguuuguaucagaauccaaccacuuacauuagcguggggacauccacccugaaccagaggcuaguccccaagaucgcuacgagaucaaaggugaauggacaaaguggccggauggaguuuuucuggacuauucucaaaagcaacgaugcaaucaauuuugaaucuaacggcaauuucaucgccccugagaacgcuuacaagauugugaaaaagggggacuccaccauaaugaaaucagaacuggaguauggaaauugcaacacaaagugucagacuccaaucggugccauuaauagcaguaugccguuucauaacauccacccccuuaccauaggcgagugcccuaaauacgucaagucuaaucgccugguuuuggcgacagggcucagaaacuccccacagggagaaaggcggcgcaagaaacgaggccuguucggugcaauugccggguuuaucgagggaggcuggcagggcaugguggaugggugguauggauaccaucacagcaacgaacaagguucgggcuaugcugccgacaaggagucuacccagaaagcaaucgacgggguaacgaauaaggugaacuccauuaucgauaaaaugaauacucaguucgaagcugucggaagagaguuuaacgccuuagagaggcggauugaaaaucugaacaagaagauggaggacggcuuccucgauguguggacauacaaugcggaacuucugguuuugauggagaacgaacguacccuagacuuccacgauucaaaugugaaaaaccuguaugacaagguccgccuccaacugagagauaaugccaaagagcuugguaacggguguuuugaguucuaccauaggugcgacaaugaauguauggagagugugcggaacggcacuuacgauuauccccaguacagcgaagaggcacgacugaagcgcgaggaaauauccggaguaaaauuggagucuaucggcacauaucagauucucagcaucuacucaaccguugcuaguucccuggccuuagcuaucaugguggccgggcuguuucuauggaugugcagcaauggaucucuccagugcagaauuuguauauga

SEQ ID NO: 125011 - RNA, 1704 nt, Artificial Sequence
  derived and/or modified sequence opt3 from hemagglutinin__InfluenzaA__ACT15342
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggagcuuuaaugauuaugaggaacucaagcaucugcuguccaggaucaaccacuucgagaaaauucagaucauuccuaaaaauucuuggucggaccaugaggcuucaggagucagcagugccuguccauaccagggccgguccuccuuuuuccgcaacgugguauggcucacuaaaaaggauaaugcauaucccacaaucaaacgaagcuacaacaauaccaaccaagaagacuuacugguucuuugggguauacaccacccuaacgaugccgcugagcagacacguuuguaucagaauccaaccacuuacauuuccguggggacaucaacccugaaccagaggcuaguccccaagaucgcaacgagaaguaaggugaauggacaaagcggccggauggaauuuuucuggacuauucucaaaccuaacgacgccaucaauuuugagucuaacggcaauuucaucgcuccagaaaacgccuacaagauugugaaaaagggggauuccaccauaaugaaaucagagcuggaauauggaaauugcaacacaaagugucagacuccgaucggugcgauuaauagcaguaugcccuuucauaacauccacccucuuaccauaggcgagugcccaaaauacgucaagucuaaucgccugauuuuggcaacagggcucagaaacucuccccagggagagaggcggcgcaagaaacgaggccuguucggugccaucgcuggguuuaucgaaggaggcuggcagggcaugguugacgggugguauggauaccaucacagcaaugagcaagguucgggcuaugccgcagacaaggaaucuacccagaaagcuauugauggggugacgaacaagguaaacuccaucauugacaaaaugaauacucaguucgaggccgugggaagagaauuuaacaauuuagagaggcggauagagaaccugaauaagaagauggaagauggcuuccucgacgucuggacauacaacgcggagcuucugguguugauggaaaaugagcguacccuagauuuccacgacucaaacguuaaaaaucuguaugauaaggugcgccuccaacugagagacaacgccaaagaacuugguaauggguguuuugaguucuaccauaggugcgauaacgaguguauggaaaguguccggaauggcacuuacgacuauccucaguacagcgaggaagcacgacugaagcgcgaggagaucuccggagugaaauuggaaucuauuggcacauaucagauccucagcaucuacucaaccguagcuaguucccuggccuuagcuauuaugguugccgggcuguuucuauggaugugcagcaacggaucucuccagugcagaauauguaucuga

SEQ ID NO: 125012 - RNA, 1704 nt, Artificial Sequence; identical to SEQ ID NO: 125008
  derived and/or modified sequence opt3 from hemagglutinin__InfluenzaA__ACT15343

SEQ ID NO: 125013 - RNA, 1704 nt, Artificial Sequence
  derived and/or modified sequence opt3 from hemagglutinin__InfluenzaA__ACT15345
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcaguuguccauaccagggccgguccucuuucuuccgcaaugugguauggcucacuaaaaaggauaacgccuaucccacaaucaaacgaagcuacaauaacaccaaccaagaagacuuacugguucuuugggguauacaccacccuaaugaugcagccgagcagacacguuuguaucagaacccaaccacuuacauuuccguggggacaucaacccugaaucagaggcuaguccccaagaucgcuacgagaaguaaggugaacggacaaagcggccggauggaauuuuucuggacuauucucaaaucuaaugacgcaaucaacuuuggcuccaaugggaacuucaucgccccugagaaugcuuacaagauugugaaaaagggagauucaaccauaaugaaaagcgaacuggaguaugguaacugcaauacaaagugucagacuccaaucggcgccauuaacaguucuaugccguuucauaauauccacccccuuaccauaggggaaugcccuaaauacgucaaguccaaccgccugguuuuggcgacaggacucagaaauagcccacagggcgagaggcggcgcaagaaacgaggucuguucggggcaauugccggauuuaucgagggcggcuggcaggggaugguggacggaugguaugguuaccaucacucgaacgaacaaggcucuggguaugcugccgacaaggaguccacccagaaagcaaucgauggaguaacgaacaaggucaauucaauuaucgacaaaaugaacacucaguucgaagcugugggcagagaguuuaauaacuuagaaaggcggauugagaaucugaacaagaagauggaggaugguuuccucgacguguggacauacaaugccgaacuucugguuuugauggagaacgaacguacccuagauuuccacgacaguaaugugaaaaaccuguaugauaagguccgccuccaacugagagacaaugcgaaagagcuugggaacggcuguuuugaauuuuaccauaggugcgauaaugaguguauggagagcgugcggaacggaacuuacgacuauccccaguacuccgaagaggcccgacugaagcgcgaagagauaucuggcguaaaauuggagagcaucgggacauaucagauucucucaaucuacaguaccguugcauccagccuggcuuuagccaucaugguggcuggacuguuucuauggaugugcucuaaugguucacuccagugcagaauuuguauauga

SEQ ID NO: 125014 - RNA, 1707 nt, Artificial Sequence
  derived and/or modified sequence opt3 from hemagglutinin__InfluenzaA__ACT15347
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccggggacuuuaacgauuaugaggaacucaagcaucugcugagcaggaucaaucacuucgagaaaauucagaucauuccuaaguccucuuggucggaccaugaagcuaguagcggagucaguuccgccuguccauaccagggccggucuagcuuuuuccgcaacgugguauggcucaucaaaaaggauaaugcauaucccacaauaaaacgauccuacaacaauacuaaccaagaggacuuacugguucuuugggguauucaccacccuaaugaugccgcugagcagacccguuuguaucauaacccaacaaccuacaucucaguggggacuucaacacugaaccagaggcuaguccccaagauugcaaccagaagcaaggugaauggacagucuggccggauggaauuuuucuggacgauccucaaaccuaacgacgccaucaauuuugaguccaacggcaauuucauugcuccagaaaacgccuacaagauagugaaaaagggggacucaacuaucaugaaaagcgagcuggaauauggaaauugcaacaccaagugucaaacaccgauuggugcgaucaauaguucuaugcccuuucacaacauacauccucuuacuauuggcgagugcccaaaauacgucaaguccagccgccugguuuuggcaaccgggcucagaaauucgccccagggaaagaacaggcggaaaaagcgcggccuguucggugccaucgcuggguuuaucgagggaggcuggcagggcaugguggaugggugguauggauaccaccacucuaaugaacaggguuccggcuaugccgcagacaaagagucaacacaacgagcuauugaugggguaaccaacaaggugaauaguaucauugacaaaaugaacacgcaguucgaagccgucggaagagaguuuaacaauuuagaaaggcggauagagaaccugaauaagaagauggaggauggcuuccucgacguguggacuuacaacgcggaacuucugguuuugauggagaaugaacguacacuagauuuccaugacagcaacgugaaaaaucuguaugauaagguccgccuccagcugagagacaacgccaaagagcuugguaauggguguuuugaguucuaccacaggugcgauaacgaauguauggaguccgugcggaauggcaccuacgacuauccucaauacucugaagaggcacgacugaagcgcgaagagaucagcggaguaaaauuggagucaauuggcaucuaucagauccucaguauuuacuccacuguugcuagcucucuggccuuagcuauaaugguggccgggcuguuucuauggaugugcucaaacggaagucuccagugcagaaucuguauuuga

SEQ ID NO: 125015 - RNA, 1704 nt, Artificial Sequence
  derived and/or modified sequence opt3 from hemagglutinin__InfluenzaA__ACT15349
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaaggauaacgcauaucccacaaucaaacgaucuuacaauaacaccaaccaagaagacuuacugguucuuugggguauacaccacccuaaugaugccacagagcagacccguuuguaucagaacccaacuacauacauuagcguggggaccuccacgcugaaucagagacuaauccccaagauugcuacuaggucaaaggucaacggacaaaguggccggauggaauuuuucuggaccauccucaaaagcaaugacgcaaucaacuuugagucuaauggcaacuucauugccccugaaaaugcuuacaagauagugaaaaagggggauuccacaaucaugaaaucagagcuggaauauggaaacugcaauacuaagugucagaccccaauuggugccaucaacagcaguaugccguuucauaauauacacccccuuacaauuggcgagugcccuaaauacgugaagucuaaccgccuggucuuggcgaccgggcucagaaauuccccacaggaggaaaggcggcgcaagaaacgaggacuguucggcgcaaucgccgguuuuaucgaagggggauggcagggcaugguugacggcugguauggguaccaucacagcaacgaacaaggaucggguuaugcugccgacaaggagucuacgcagaaagcaauugauggcgugacuaacaagguaaauuccaucauugacaaaaugaacacacaguucgaagcuguggggagagaguuuaauaacuuagagaggcggauagaaaaucugaacaagaagauggaggauggauuccucgacgucuggaccuacaaugccgaacuucugguguugauggagaacgaacguacucuagauuuccacgacucaaauguuaaaaaccuguaugauaaggugcgccuccaacugagagacaaugcgaaagagcuuggcaacgguuguuuugaguucuaccauaggugcgauaaugaauguauggagaguguccggaacgggacauacgacuauccccaguacagcgaagaggcccgacugaagcgcgaggaaaucuccggcgugaaauuggagucuauuggaaccuaucagauccucagcaucuacucaacgguagcaaguucccuggcuuuagccauuaugguugcuggccuguuucuauggaugugcagcaaugggucucuccagugcagaauauguaucuga

SEQ ID NO: 125016 - RNA, 1707 nt, Artificial Sequence
  derived and/or modified sequence opt3 from hemagglutinin__InfluenzaA__ACT15351
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccggggacuuuaacgauuaugaggaacucaagcaucugcugagcaggaucaaucacuucgagaaaauucagaucauuccuaaguccucuuggucggaccaugaagcuaguagcggagucaguuccgccuguccauaccagggcgguucuagcuuuuuccggaacgugguauggcucaucaaaaaggauaaugcauaucccacaauaaaacgcuccuacaacaauacuaaccaagaggacuuacugguucuuugggggauucaccacccuaaugaugccgcugagcagacccgauuguaucauaacccaacaaccuacaucucagugggaacuucaacacugaaccagcgucuaguccccaagauugcaaccagaagcaaggugaauggccagucuggcaggauggaauuuuucuggacgauccucaaaccuaacgacgccaucaauuuugaguccaacgggaauuucauugcuccagaaaacgccuacaagauagugaaaaagggagacucaacuaucaugaaaagcgagcuggaauaugguaauugcaacaccaagugucaaacaccgauuggcgcgaucaauaguucuaugcccuuucacaacauacauccucuuacuauuggggagugcccaaaauacgucaaguccagccggcugguuuuggcaaccggacuccgcaauucgccccagggcaagucuagaaggaaaaagcggggucuguucggggccaucgcuggauuuaucgagggcggcuggcaggggaugguggauggaugguaugguuaccaccacuccaacgaacagggcucaggguaugccgcagacaaagagaguacacaacgcgcuauugauggaguaaccaauaaggugaacagcaucauugacaaaaugaauacgcaguucgaagccgucggccgagaguuuaacaaguuagaaagaaggauagagaaccugaauaagaaaauggaggaugguuuccucgacguguggacuuacaacgcggaacuucugguuuugauggagaaugaacggacacuagauuuccaugacuccaacgugaagaaucuguaugauaaaguccgucuccagcugcgcgacaacgccaaggagcuugggaauggcuguuuugaguucuaccacagaugcgauaacgaauguauggagucugugaggaauggaaccuacgacuauccucaauacagcgaagaggcacggcugaaacgagaagagaucucaggcguaaaguuggagaguauugggaucuaucagauccucuccauuuacagcacuguugcuucuucacuggccuuagcuauaaugguggccggacuguuucuauggaugugcaguaacgguagccuccagugccgcaucuguauuuga

SEQ ID NO: 125017 - RNA, 1704 nt, Artificial Sequence
  derived and/or modified sequence opt3 from hemagglutinin__InfluenzaA__ACT15353
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuauguaaccuggauggagucaaaccccuaauucucagagacugcucaguggccgguuggcugcuuggcaauccuaugugugaugaguuccugaacguuccagaauggaguuauaucguggagaagauaaauccggcgaacgacuugugcuaccccgggaauuuuaacgauuaugaggaacucaagcaucugcugagcaggaucaaucacuucgagaaaauucagaucauuccuaagaacuccuggucugaccaugaggcuucgggagucucaagcgccuguccauaccagggccggaguuccuuuuuccgcaaugugguauggcucacuaaaaagaacucugcauaucccacaaucaaacgaagcuacaauaacaccaaccaagaagauuuacugguucuuugggguauacaccacccuaaugacgccgcugagcagacacguuuguaucagaacccaaccacuuacauuuccguggggacaucaacccugaaucagaggcuaguccccaagaucgcaacgagaaguaaggugaacggacaaagcggccggauggaauuuuucuggacuauucucaaaucuaaugaugccaucaacuuugaguccaauggcaacuucaucgcuccugaaaaugccuacaagauugugaaaaagggggacucaaccauaaugaaaagcgagcuggaauauaguaacugcaauacaaagugucagacuccaaucggagcgauuaacucuuccaugccguuucauaauauccacccccuuaccauaggugagugcccuaaauacgucaagagcaaccgccugguuuuggcaacaggccucagaaauucgccacagggggagaggcggcgcaagaaacgaggacuguucggcgccauugcugguuuuaucgaagggggauggcagggcaugguggauggcugguauggguaccaucacucuaacgagcaaggauccgguuaugccgcagacaaggaaucaacccagaaagcuaucgacggcguaacgaacaaggugaauaguauuaucgauaaaaugaacacucaguucgaggccgucgggagagaauuuaauaacuuagagaggcggauugagaaucugaacaagaagauggaagacggauuccucgauguguggacauacaaugcggagcuucugguuuugauggaaaacgagcguacccuagacuuccacgauagcaaugugaaaaaccuguaugacaagguccgccuccaacugagagauaaugccaaagaacuuggcaacgguuguuuugaguucuaccauaggugcgacaaugaguguauggaauccgugcggaacgggacuuacgauuauccccaguacucugaggaagcacgacugaagcgcgaggagauaagcggcguaaaauuggaaucaaucggaacauaucagauucucaguaucuacuccaccguugcuagcucucuggccuuagcuaucaugguggccggccuguuucuauggaugugcucaaaugggagucuccagugcagaauuuguauauga

SEQ ID NO: 125018 - RNA, 1707 nt, Artificial Sequence
  derived and/or modified sequence opt3 from hemagglutinin__InfluenzaA__ACT15355
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccggggacuuuaacgauuaugaggaacucaagcaucugcugagcaggaucaaucacuucgagaaaauucagaucauuccuaaguccucuuggucggaccaugaagcuaguagcggagucaguuccgccuguccauaccagggccggucuagcuuuuuccgcaacgugguauggcucaucaaaaaggauaaugcauaucccacaauaaaacgauccuacaacaauacuaaccaagaggacuuacugguucuuugggguauucaccacccuaaugaugccgcugagcagacccguuuguaucauaacccaacaaccuacaucucaguggggacuucaacacugaaccagaggcuaguccccaagauugcaaccagaagcaaggugaauggacagucuggccggauggaauuuuucuggacgauccucaaaccuaacgacgccaucaauuuugaguccaacggcaauuucauugcuccagaaaacgccuacaagauagugaaaaagggggacucaacuaucaugaaaagcgagcuggaauauggaaauugcaacaccaagugucaaacaccgauuggugcgaucaauaguucuaugcccuuucacaacauacauccucuuacuauuggcgagugcccaaaauacgucaaguccagccgccugguuuuggcaaccgggcucagaaauucgccccagggaaagucuaggcggaaaaagcgcggccuguucggugccaucgcuggguuuaucgagggaggcuggcagggcaugguggaugggugguauggauaccaccacuccaacgaacaggguucaggcuaugccgcagacaaagagaguacacaacgagcuauugaugggguaaccaauaaggugaacagcaucauugacaaaaugaauacgcaguucgaagccgucggaagagaguuuaacaacuuagaaaggcggauagagaaucugaacaagaagauggaggauggcuuccucgacguguggacuuacaaugcggaacuucugguuuugauggagaacgaacguacacuagauuuccaugacuccaaugugaaaaaccuguaugauaagguccgccuccagcugagagacaaugccaaagagcuugguaacggguguuuugaguucuaccacaggugcgauaaugaauguauggagucugugcggaacggcaccuacgacuauccucaauacagcgaagaggcacgacugaagcgcgaagagaucucaggaguaaaauuggagaguauuggcaucuaucagauccucuccauuuacagcacuguugcuucuucacuggccuuagcuauaaugguggccgggcuguuucuauggaugugcaguaauggaagccuccagugcagaaucuguauuuga

SEQ ID NO: 125019 - RNA, 1704 nt, Artificial Sequence
  derived and/or modified sequence opt3 from hemagglutinin__InfluenzaA__ACT15357
auggagaagaucgugcugcuccuugccauugucagccugguuaaauccgaccagauaugcaucggcuaccacgcuaacaauucuaccgaacaaguggauacaauuauggagagaaacguaacugugacgcaugcacaggacaucuuggaaaagacccacaaugggaaauuauguaaccuggauggagucaagccccuaauucucagggacugcucaguggccgguuggcugcuuggcaauccuaugugugaugaguuccugaacguuccagaauggaguuauaucguggagaaaauaaauccggcgaacgacuugugcuaccccgggaauuuuaacgauuaugaggaacucaagcaucugcugagccggaucaaucacuucgagaagauucagaucauuccuaaaaacuccuggucugaccaugaggcuucgggagucucaagcgccuguccauaccagggccgcaguuccuuuuuccgaaaugugguauggcucacacaaaaggauaacgcauaucccacuaucaaacguucuuacaauaacaccaaccaggaagacuuacugguucuuugggguauacaccacccuaaugaugccgcugagcagacaagauuguaucagaacccaaccacuuacauuagcguggggacauccacccugaaucaaaggcuaauccccaagauugcaacgcggucaaaagucaacggacagaguggccgcauggaauuuuucuggacuauccucaagagcaaugacgccaucaacuuugagucuaauggcaacuucauugcuccugaaaaugccuacaagauagugaaaaagggggauuccaccaucaugaaaucagagcuggaauauggaaacugcaauacaaagugucagacuccaauuggugcgaucaacagcaguaugccguuucauaauauacacccccuuaccauuggcgagugcccuaaauacgugaagucuaacagacuggucuuggcaacagggcuccgaaauuccccacagggagagcggcgcaggaaaaagagaggccuguucggugccaucgcuggguuuaucgaaggaggcuggcaaggcaugguugacgggugguauggauaccaucacagcaacgagcaggguucgggcuaugccgcagacaaggaaucuacccagaaagcuauugauggggugacgaacaagguaaauuccaucauugacaaaaugaacacucaauucgaggccgugggaagggaauuuaauaacuuagagcggcguauagagaaucugaacaagaaaauggaagauggcuuccucgacgucuggacauacaaugcggagcuucugguguugauggaaaacgagcgcacccuagauuuccacgacucaaauguuaagaaccuguaugauaaggugagacuccagcugagggacaaugccaaagaacuugguaacggguguuuugaguucuaccaucggugcgauaaugaguguauggaaaguguccgaaacggcacuuacgacuauccccaguacagcgaggaagcacgccugaagagagaggagaucuccggagugaaauuggaaucuauuggcacauaucagauccucagcaucuacucaaccguagcuaguucccuggccuuagcuauuaugguugccgggcuguuucuauggaugugcagcaauggaucucuccaaugcaggauauguaucuga

SEQ ID NO: 125020 - RNA, 1701 nt, Artificial Sequence
  derived and/or modified sequence opt3 from hemagglutinin__InfluenzaA__ACT20200
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaaaccagcucaaaaauaacgcaaaggaaaucggcaauggauguuuugaguucuaucacaagugcgacaacaccuguauggaaagugugaaaaauggcacauacgauuauccuaaguacuccgaggaagccaaacugaacagagaggagauugacggggucaaacuugaaagcacuaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 125021 - RNA, 1701 nt, Artificial Sequence
  derived and/or modified sequence opt3 from hemagglutinin__InfluenzaA__ACT21466
augaagaccaucauugcccugagcuacauacucugccuuguguucgcucagaaacugcccggcaacgacaauuccacagcaacuccuuguuuggggcaccaugccgucccaaacggaacguuaguuaagaccaucacaaaugaucaaauugaggugacuaacgcgaccgaacugguacagucuucaaguacagguaaaaucugcgacagcccgcacaggauucuagauggcaagaauuguacccucaucgacgcucugcuuggggauccccauugcgacggauuuaaaaacaaggagugggaucuguucguggaaagauccacugccuauucuaauuguuacccuuaugacgucccagauuacgcaucguugcggucacucguggccagcaguggcacacuggaguuuaccaacgaagguuucaauuggacggggguugcucaggacggaacuuccuaugcaugcaagcgcggcucugugaaauccuuuuucagccgacugaacuggcuccacaaguuagaguacaaauaucccgcccugaaugucaccaugccuaacaaugauaaguuugacaaacuuuacauauggggcgugcaucacccaucaacagauagugaccagacuagcuuguacguacaggcuucugggcguguuaccguguccacaaagagaucacagcagaccgucauccccaacauuggaagcaggccuugggugcgggguaucaguucucgcauuuccaucuauuggacgauagugaagccaggcgacauucugcuaaucaauagcacugggaaccucauugccccgagaggauacuucaaaaucaggucgggcaagucuuccaucaugcggucagaugcgcccauugacaacuguaauagugagugcauaacaccuaacgguagcaucccaaaugauaaacccuuucagaacgucaaucgcauuaccuauggggcauguccucgauacguuaagcaaaacacucugaaacuugccacaggaaugagaaaugugccagaaaagcagaccaggggcaucuucggcgcuauagccggguuuauugagaacggaugggaagguaugguagacggcugguauggguuccggcaccaaaauuccgagggaacgggccaggcagcugaucugaaaucuacccaagccgcgaucaaccagaucaaugguaaguugaaccgucucauugagaagacaaaugaaaaauuucaucagaucgagaaggaguucagcgaaguggaagggcgcauucaagaccuggagaaauacgucgaggauacuaagauagacuuauggucauauaacgccgaacugcucguggcacuugagaaucagcacaccaucgaucugacagacagugaaaugaacaaauuguucgagaagacuagaaagcagcuaagggaaaacgcugaggauaugggcaauggaugcuuuaaaauuuaccauaagugugacaacgccugcaucggcuccauccggaaugggaccuacgaccacgauguuuaucgagacgaggcucugaacaaucgcuuccagauuaaaggaguggaacucaagagcgguuacaaagauuggauacuguggaucucuuuugccauuucaugcuuccuucugugugucguguugcucggcuuuaucaugugggcaugccaaaaggggaacauuagauguaauaucugcauauga

SEQ ID NO: 125022 - RNA, 1701 nt, Artificial Sequence
  derived and/or modified sequence opt3 from hemagglutinin__InfluenzaA__ACT21467
augaagaccaucauugcccugagcuacauacucugccuuguguucgcucagaaacugcccggcuccgacaacucuacagcaacuuuguguuuagggcaccaugccgucccuaauggaacgcugguuaagaccaucacaaacgaucaaauugaggugacuaaugcgaccgaacuuguacagucaaguagcacagguaaaaucugcgacuccccacacaggauucucgauggcaagaacuguacccugaucgacgcucuacugggggauccgcauugcgacggauuuaaaaauaaggagugggauuuguucguggaaagaucuacugccuauucgaacuguuaccccuaugacgucccugauuacgcaucacuccggagccugguggccaguuccggcacacuggaguuuaccaaugaagguuucaacuggacggggguugcucaggacggaacuucuuaugcaugcaagcgcggcagcgugaaauccuuuuucucacgacucaauugguuacacaagcuggaguacaaauauccagcccuuaacgucaccaugcccaauaacgauaaguuugacaaauuguacauauggggcgugcaucacccuaguacagauagcgaccagacuucucuguacguacaggcuuccgggcguguuaccgugucaacaaagagaagccaacagaccgucaucccaaauauuggaaguaggcccugggugcgggguaucucuucccgcauuagcguguauuggacgaucgucaagccuagagacauacuacucauuaacucgacuggcaaucugaucgccccaaggggguacuucaaaauucggucuggaaaguccucaaucaugcgcagugaugcgccgaucgacaacuguaacagcgagugcauuacacccaauggcuccauaccuaacgauaaaccauuucagaauguuaaccgaaucaccuauggugcaugucccagauacgugaagcaaaauacucuuaaacuggccacagggaugaggaacguaccugaaaagcagacccggggaauuuucggcgcuaucgccggcuuuauagagaaugggugggaaggaaugguggacgguugguauggcuuccgucaccagaacucugaggggacgggacaggcagcugauuugaaaagcacccaagccgcgauuaaucgcaucaacggcaagcucaauagacugaucgagaagacaaacgaaaaauuucaucagauugagaaggaguucucagaagucgaagguaggauccaggacuuagagaaauacguggaggauacuaagauugaccuguggaguuauaaugccgaacuccuuguugcacuggagaaccaacacaccauagauuugacagacuccgaaaugaauaaacuauucgagaagacucggaagcagcugcgagaaaacgcugaggauauggggaacggcugcuuuaaaaucuaccauaagugugacaaugccugcauuggaagcauccgcaacggcaccuacgaccacgauguguauagagacgaggcucucaauaacagguuccagaucaaaggggucgaacugaagucuggauacaaagauuggauucuuuggauaucauuugccaucaguugcuuccuguugugugugguacuccuggguuuuauuaugugggcaugccagaagggcaauauccgguguaacauuugcaucuga

SEQ ID NO: 125023 - RNA, 1701 nt, Artificial Sequence
  derived and/or modified sequence opt3 from hemagglutinin__InfluenzaA__ACT21468
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacugguacagucuucaaguacagguaaaaucugcgacagcccacacaggauucucgauggcaagaauuguacccugaucgacgcccuucugggggauccgcauugcgacggauuuaaaaacaaggagugggauuuguucguggaaagauccacugcuuauucuaauuguuaccccuaugacgucccugauuacgcaucgcuccggucacugguggccagcaguggcacacuggaguuuaccaacgaagguuucaauuggacggggguugcucaggacggaacuuccuaugcaugcaagcgcggcucugugaaauccuuuuucagccgacucaacugguuacacaagcuggaguacaaauauccagcccuuaaugucaccaugcccaacaaugauaaguuugacaaauuguacauauggggcgugcaucacccuucaacagauagugaccagacuagccuguacguacaggcuucugggcguguuaccguguccacaaagagaucacagcagaccgucaucccaaacauuggaagcaggcccugggugcgggguaucaguucucgcauuuccaucuauuggacgauagugaagccuggcgacauucuacucaucaauagcacugggaaccugauugccccaagaggauacuucaaaaucaggucgggcaagucuuccaucaugcggucagaugcgccgauugacaacuguaauagugagugcauaacacccaacgguagcaucccuaaugauaaaccauuucagaacgucaaucgcauuaccuauggggcauguccccgauacguuaagcaaaacacucuuaaacuggccacaggaaugagaaaugugccugaaaagcagaccaggggcaucuucggcgcuauagccggguuuauugagaacggaugggaagguaugguagacggcugguauggguuccggcaccaaaauuccgagggaacgggccaggcagcugauuugaaaucuacccaagccgcgaucaaccagaucaaugguaagcucaaccgucugauugagaagacaaaugaaaaauuucaucagaucgagaaggaguucagcgaaguggaagggcgcauucaagacuuagagaaauacgucgaggauacuaagauagaccuguggucauauaacgccgaacuccuuguggcacuggagaaucagcacaccaucgauuugacagacagugaaaugaacaaacuauucgagaagacuagaaagcagcugagggaaaacguugaggauaugggcaauggaugcuuuaaaauuuaccauaagugugacaacgcuugcaucggcuccauccggaaugggaccuacgaccacgauguguaucgagacgaggcccucaacaaucgcuuccagauuaaaggagucgaacuaaagagcgguuacaaagauuggauacuuuggaucucuuuugcuauuucaugcuuccuguugugugugguacuccugggcuuuaucaugugggccugccaaaaggggaacauuagauguaauaucugcauauga

SEQ ID NO: 125024 - RNA, 1701 nt, Artificial Sequence
  derived and/or modified sequence opt3 from hemagglutinin__InfluenzaA__ACT21469
augaagaccaucauugcccugagcuacauauccagacucguguucgcucagaaacuucccggcaacgacaauucuacagcaacucugugcuuggggcaccaugccgucccuaacggaacguuaguuaagaccaucacaaaugaucaaauugaggugacuaacgcgaccgaacugguacagucaaguagcacagguaggaucugugacuccccacaccggauucuagauggcgagaauugcacccucaucgacgcucugcuuggggauccgcauugugacggauuucagaacaaagaaugggaucuguucguggagcgcucuaaggccuauucgaauugcuaccccuaugacgucccugauuacgcaucauugcgaagccucguggccaguuccggcacucuggaauuuaacaaugagucuuucaacuggacagguguugcucaggacgggaccagcuaugcauguaaacguagauccauaaagucauuuuucaguaggcugaauuggcuccaccaauuaaaguacaaauauccagcccugaacgugacgaugcccaauaacgauaaguuugacaaacuuuacaucuggggaguccaucacccuagcacugauucugaccagaccuccuuguacgcucaggccucaggccgggugacaguaagcacuaagcgcagucagcaaaccguuauuccaaauaucggcucuagacccugggugaggggagucuccagccggauuucgaucuauuggacaauagugaaaccuggggacauucugcuaaucaacucuaccgguaaccucauugcgccacgcggcuacuucaagauccgauccgggaagucaaguaucaugagaagcgaugcaccgauuggaaaaugcaauuccgaguguauaacgcccaacggcucuaucccuaaugacaagccauuucagaacgugaauaggauuacuuauggugccugcccccgguacgucaaacagaacacacugaaacuugcuaccgggaugcguaauguuccugaaaagcagacucgcggaaucuucggcgccauagcaggcuuuauugagaacgggugggaaggaaugguggaugguugguauggcuucagacaccaaaauagcgaggggacaggacaggcugccgaccugaagucaacccaggcggccaucaaccaaaucaauggcaaauugaacaggcucauugagaagacgaaugaaaaguuucaucagaucgagaaagaguucagugaaguagaaggucggauucaggaucuggagaaguacguggaggacaccaaaauagauuuaugguccuauaacgcagaacugcucgucgcucuugagaaucagcacacaaucgaccugacugauagcgaaaugaacaaguuguucgagcgaacccgcaaacaacuaagagaaaacgccgaggacauggggaauggcuguuuuaagauuuaccauaagugcgauaacgcuuguaucggaucuaucaggaauggcacauacgaccacgacguguaucgggaugaggcccugaacaaucgcuuccagauuaaagggguugaacucaagucaggauacaaagacuggauacuguggaucaguuuugcaauuagcugcuuccuucugugcguggucuugcucgguuuuaucaugugggccugucagaagggcaacauuagaugcaauaucuguauauga

SEQ ID NO: 125025 - RNA, 1701 nt, Artificial Sequence
  derived and/or modified sequence opt3 from hemagglutinin__InfluenzaA__ACT21471
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcgagaauuguacccucaucgacgcucugcuuggggauccgcauugcgacggauuucagaacaaagaaugggaucuguucguggagcggucuaaggccuauucgaauuguuaccccuaugacgucccugauuacgcaucauugcgcagccucguggccaguuccggcacucuggaauuuaacaaugagucuuucaacuggacagguguugcucaggacgggaccagcuaugcaugcaaacgacguuccauaaagucauuuuucaguagacugaauuggcuccaccaauuaaaguacaaauauccagcccugaacgugacgaugcccaauaacgauaaguuugacaaacuuuacaucuggggaguccaucacccuagcacugauucugaccagaccuccuuguacgcucaggccucaggcagggugacaguaagcacuaagcggagucagcaaaccguuauuccaaauaucggcucucgccccugggugagaggggucuccagcaggauuucgaucuauuggacaauagugaaaccuggagacauucugcuaaucaacucuaccgguaaccucauugcgccacggggcuacuucaagauccgcuccgggaagucaaguaucaugcgaagcgaugcaccgauuggaaaauguaauuccgagugcauaacgcccaacggcucuaucccuaaugacaagccauuucagaacgugaauagaauuacuuauggugccugucccagguacgucaaacagaacacacugaaacuugcuaccgggaugcggaauguuccugaaaagcagacucguggaaucuucggcgccauagcaggcuuuauugagaacgggugggaaggaaugguggaugguugguauggcuuccgccaccaaaauagcgaggggacaggacaggcugccgaccugaagucaacccaggcggccaucaaccaaaucaauggcaaauugaacagacucauugagaagacgaaugaaaaguuucaucagaucgagaaagaguucagugaaguagaagguaggauucaggaucuggagaaguacguggaggacaccaaaauagauuuaugguccuauaacgcagaacugcucgucgcucuugagaaucagcacacaaucgaccugacugauagcgaaaugaacaaguuguucgagcggacccgaaaacaacuacgcgaaaacgccgaggacauggggaauggcugcuuuaagauuuaccauaagugugauaacgcuugcaucggaucuaucagaaauggcacauacgaccacgacguguauagggaugaggcccugaacaaucgguuccagauuaaagggguugaacucaagucaggauacaaagacuggauacuguggaucaguuuugcaauuagcugcuuccuucuguguguggucuugcucgguuuuaucaugugggccugccagaagggcaacauucgcuguaauaucugcauauga

SEQ ID NO: 125026 - RNA, 1701 nt, Artificial Sequence
  derived and/or modified sequence opt3 from hemagglutinin__InfluenzaA__ACT21472
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcgagaauuguacccucaucgacgcucugcuuggggauccgcauugcgacggauuucagaacaaagaaugggaucuguucguggagcggucuaaggccuauucgaauuguuaccccuaugacgucccugauuacgcaucauugcgcagccucguggccaguuccggcacucuggaauuuaacaaugagucuuucaacuggacagguguugcucaggacgggaccagcuaugcaugcaaacgacguuccauaaagucauuuuucaguacgcugaauuggcuccaccaauuaaaguacaaauauccagcccugaacgugacuaugcccaauaacgauaaguuugacaaacuuuacaucuggggaguccaucacccuagcaccgauucugaccagacauccuuguacgcucaggccucaggcagagugacuguaagcaccaagaggagucagcaaacaguuauuccaaauaucggcucucggcccugggugcgcggggucuccagcagaauuucgaucuauuggaccauagugaaaccuggagacauucugcuaaucaacucuacggguaaccucauugcgccaaggggcuacuucaagauccgguccgggaagucaaguaucaugcgcagcgaugcaccgauuggaaaauguaauuccgagugcauaacucccaacggcucuaucccuaaugacaagccauuucagaacgugaaucgaauuacauauggugccugucccagauacgucaaacagaacacccugaaacuugcuacugggaugaggaauguuccugaaaagcagacacggggaaucuucggcgccauagcaggcuuuauugagaacgggugggaaggaaugguggaugguugguauggcuuccgucaccaaaauagcgaggggaccggacaggcugccgaccugaagucaacgcaggcggccaucaaccaaaucaauggcaaauugaaccgccucauugagaagaccaaugaaaaguuucaucagaucgagaaagaguucagugaaguagaagguaggauucaggaucuggagaaguacguggaggacacaaaaauagauuuaugguccuauaacgcagaacugcucgucgcucuugagaaucagcacacuaucgaccugaccgauagcgaaaugaacaaguuguucgagagaacacggaaacaacuacgagaaaacgccgaggacauggggaauggcugcuuuaagauuuaccauaagugugauaacgcuugcaucggaucuauccgcaauggcacuuacgaccacgacguguauagagaugaggcccugaacaauagguuccagauuaaagggguugaacucaagucaggauacaaagacuggauacuguggaucaguuuugcaauuagcugcuuccuucuguguguggucuugcucgguuuuaucaugugggccugccagaagggcaacauucgguguaauaucugcauauga

SEQ ID NO: 125027 - RNA, 1701 nt, Artificial Sequence
  derived and/or modified sequence opt3 from hemagglutinin__InfluenzaA__ACT21507
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauagaacccucauagacgcucugcuuggagauccgcagugugacggcuuucaaaacaaaaagugggaucuguucguggaaagguccaaagccuauucuaauugcuaccccuaugacgucccugauuacgcaucguugcggucacucguggccagcagugguacucuggaguuuaacaaugaauccuucaacuggacagggguuacccagaauggaacgucuagcgcuuguaagggccgcuccaacaauucauuuuucagucgacugaacuggcucacucauuuaaaguuuaaauauccagcacugaaugugaccaugcccaacaacgagaaguucgacaaacuuuacaucuggggcguccaccauccugggacagauaaugaccagauuagcuuguaugcccaggcuucuggacguaucacuguguccaccaagagaucacaacagacaguaauuccaaacaucgguagcaggccccggguucgcgauauaccuaguagaauuucuaucuacuggaccauugugaaaccaggcgacauccugcuaaucaauuccacggggaaccucauugccccgaggggauacuuuaagauacggagcggcaagucgucuaucaugcgcuccgacgcgcccauugguaaaugcaauucagaguguaucacuccuaacgggaguauaccaaaugauaagcccuuccagaacgucaaucgaauuacauauggagcaugcccuagauacgugaaacagaacacccugaaacuugccacuggcaugaggaaugugccagaaaagcaaacacggggcaucuuuggggcuaucgccggauucauugagaacgguugggaaggcauggucgacgggugguauggauuucgucaccagaauagcgagggcaucggucaggcagcugaucugaaguccacccaagccgcgauuaaccagauaaaugggaaauugaaccgccucaucggcaagacgaacgagaaguuccaccagauugaaaaagaguucucugaaguugagggaagaauccaggaccuggaaaaguacguggaggauaccaggaucgacuuauggagcuauaaugccgagcugcucguagcacuugaaucacaacauacaauugaucugacugacagugagaugaacaaauuguuugaacggaccaagaaacagcuacgagagaaugcugaagauaugggcaacggguguuucaagauauaccacaagugcgacaaugccuguaucggauccauucgcaacgguacauaugaucaugacguguacagagacgaggcucugaauaaaagguuucagaucaagggcgucgagcucaaaagcggguacaaggauuggauucuguggaucucuuucgccauaucaugcuuucuucugugcguggcauugcucggauucaucaugugggccugucagaaaggcaacauucggugcaauaucuguauuuga

SEQ ID NO: 125028 - RNA, 1701 nt, Artificial Sequence
  derived and/or modified sequence opt3 from hemagglutinin__InfluenzaA__ACT21508
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacaggacacccugaaacuugccacuggaaugaggaacgugccagaaaagcaaacacggggcaucuuuggcgcuaucgccggguucauugagaauggaugggaagguauggucgauggcugguauggguuucgucaccagaacagcgagggaaucggccaggcagcugaccugaaguccacccaagccgcgauuaaucagauaaacgguaaauugaaucgccucaucgggaagacgaacgagaaguuccaccagauugaaaaagaguucucugaaguugagggcagaauccaggaucuggaaaaguacguggaggacaccaaaaucgauuuauggagcuauaacgccgagcugcucguagcacuugaaaaucaacauacaauugaccugacugauucagagaugaacaaguuguuugaaaggaccaaaaagcagcuacgggagaaugcugaagacaugggaaacggcugcuucaagauauaccacaaaugugauaaugccugcaucgggaguauucgaaacggaacauaugaccaugacguguaccgcgaugaggcucugaauaacagauuucagaucaagggugucgagcucaaauccggcuacaaggacuggauucuguggaucagcuucgccauaucuugcuuucuucuguguguggcauugcucggguucaucaugugggccugccagaaaggaaauauuagguguaacaucugcauuuga

SEQ ID NO: 125029 - RNA, 1701 nt, Artificial Sequence
  derived and/or modified sequence opt3 from hemagglutinin__InfluenzaA__ACT21509
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacauccugcuaaucaauuccacgggcaaccucauugccccgaggggguacuuuaagauacggagcggaaagucgucuaucaugcgcuccgacgcgcccauuggcaaauguaauucagagugcaucacuccuaacgguaguauaccaaaugauaagcccuuccagaacgucaaucgaauuacauauggggcauguccuagauacgugaaacagaacacccugaaacuugccacuggaaugaggaaugugccagaaacacaaacccggggcaucuuuggcgcuaucgccggguucauugagaacggaugggaagguauggucgacggcugguauggguuucgucaccagaauagcgagggaacgggccaggcagcugaucugaaguccacccaagccgcgaucaaccagauuaaugguaagcccaaccgcuugauagggaaaacaaacgagaaguuccaccagaucgaaaaggaguucucugaaguugagggcaggauucaggaccucgaaaaauacguggaggauacuaagaucgaccuguggagcuauaaugccgaguuacugguagcacucgaaaaccaacauaccaucgaucuuacagacucagagaugaauaaacuguuugaaaagacuaaaaagcaguugagagagaacgcugaagauaugggaaauggcugcuucaagauuuaccacaaaugugacaacgccugcauagggaguauccggaaugagaccuaugaucaugacguguaccgagacgaggcucuaaacaaucgcuuucagauuaagggagucgaacugaaauccgguuacaaggauuggauccucuggauuagcuucgccaucucuugcuuucugcuuuguguggcacuguugggcuucauaaugugggccugccagaaagggaacaucagauguaauauuugcaucuga

SEQ ID NO: 125030 - RNA, 1701 nt, Artificial Sequence
  derived and/or modified sequence opt3 from hemagglutinin__InfluenzaA__ACT21510
augaagaccaucauugcccugagcuacauacucugccccguguucgcucagaaacuuccuggcaacgacaauuccacagcaacucuguguuuggggcaccaugccgucccaaacggaacgaucguuaagaccauuacaaaugaucaaaucgaggugacuaacgcgaccgaauuaguacagucuucaaguacagguggcauuugcgacagcccgcaccagauccuggauggggagaauuguacccuaauagacgcucuccugggagauccccagugcgacggcuuucaaaacaaaaagugggaucuuuucguggaaagauccaaagccuauucuaauuguuacccuuaugacgucccagauuacgcaucgcugaggucauugguggccagcagugguacucucgaguuuaacaaugaauccuucaacuggacagggguuacccagaauggaacgucuagcgcuugcaagcggcgcuccaacaauucauuuuucagucgacugaacuggcugacucaucucaaguuuaaauaucccgcauuaaaugugaccaugccuaacaacgagaaguucgacaaacuguacaucuggggcguccaccauccaggcacagauaaugaccagauuagccuuuaugcccaggcuucugggcguaucacuguguccaccaagagaucacaacagacaguaauucccaacaucggaagcaggccucggguucgcgauauaccaaguagaauuucuaucuacuggaccauugugaaaccgggugacaucuugcugaucaauuccacgggcaaccuaauugcccccaggggguacuuuaagauacggagcggaaagucgucuaucaugcgcuccgacgcgccuauuggcaaauguaauucagagugcaucacuccaaacgguaguauacccaaugauaagccuuuccaggacgucaaccgaauuacauauggggcauguccaagauacgugaaacagaauacccucaagcuggccacuggaaugaggaacgugcccgaaaaacaaacacggggcaucuuuggcgcuaucgccggguucauugagaauggaugggaagguauggucgauggcugguauggguuucgucaccagaacagcgagggaaucggccaggcagcugaccuuaaguccacccaagccgcgauuaaucagauaaacgguaaacugaaucgcuugaucgggaagacgaacgagaaguuccaccagauugaaaaagaguucucugaaguugagggcagaauccaggaucucgaaaaguacguggaggacaccaaaaucgaucuguggagcuauaacgccgaguuacugguagcacucgaaaaucaacauacaauugaccuuacugauucagagaugaacaagcuguuugaaaggaccgagaaacaguugcgggaaaaugcugaggacaugggaaacggcugcuucaagauauaccacaagugugauaaugccgggaucggaaguauucgaaacgguacauaugaccaugacguguaccgcgaugaggcucuaaauaacagauuucagaucaaaggcgucgaacugaaguccggguacaaagacuggauucucuggaucagcuucgccauaucuugcuuucugcuuugcguggcacuguugggauucaucaugugggccugucagaagggcaauauuaggugcaacaucuguauuuga

SEQ ID NO: 125031 - RNA, 1701 nt, Artificial Sequence; identical to SEQ ID NO: 124929
  derived and/or modified sequence opt3 from hemagglutinin__InfluenzaA__ACT21572

SEQ ID NO: 125032 - RNA, 1701 nt, Artificial Sequence; identical to SEQ ID NO: 124685
  derived and/or modified sequence opt3 from hemagglutinin__InfluenzaA__ACT22031

SEQ ID NO: 125033 - RNA, 1701 nt, Artificial Sequence; identical to SEQ ID NO: 124685
  derived and/or modified sequence opt3 from hemagglutinin__InfluenzaA__ACT22032

SEQ ID NO: 125034 - RNA, 1701 nt, Artificial Sequence; identical to SEQ ID NO: 124685
  derived and/or modified sequence opt3 from hemagglutinin__InfluenzaA__ACT22033

SEQ ID NO: 125035 - RNA, 1701 nt, Artificial Sequence; identical to SEQ ID NO: 124685
  derived and/or modified sequence opt3 from hemagglutinin__InfluenzaA__ACT22034

SEQ ID NO: 125036 - RNA, 1701 nt, Artificial Sequence; identical to SEQ ID NO: 124700
  derived and/or modified sequence opt3 from hemagglutinin__InfluenzaA__ACT22035

SEQ ID NO: 125037 - RNA, 1701 nt, Artificial Sequence
  derived and/or modified sequence opt3 from hemagglutinin__InfluenzaA__ACT22036
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucauaaagaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggucuucccgcuauagcaagaaauuuaagccugagaucgcaauucgaccaaaaguccgugaucaggagggaagaaugaauuacuauuggacucugguggaacccggugacaagaucaccuucgaggccacaggcaaccuaguggucccuagguacgcuuuugccauggaacggaacgcagggucgggaauaauuaucucugauacuccaguucaugacugcaauaccacaugucaaaccccgaaaggcgcuauuaacacgucccuccccuuccagaauauccacccuaucacuauugguaagugcccaaaguaugugaaaucaacaaagcugcgccuugccaccgggcugagaaacguacccaguauacagagcaggggauuguuuggcgcgaucgccggcuucauugaagggggauggacugguaugguggacggcugguacggguaucaucaccagaaugaacaaggauccggcuacgcagcugaucucaaaucuacacagaacgccaucgacgagauaaccaauaaggucaacagcgugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauucaaaugugaaaaaccuguacgagaagguacgaagucagcucaaaaacaaugcaaaggaaauuggcaacggauguuuugaguucuaucacaagugcgacaauaccuguauggaauccguuaaaaacggcacauacgauuauccuaaguacagcgaggaagccaaacugaauagagaggagaucgacggggugaaacuugaaucuacuaggauuuaucaaauacuggcuaucuacucaaccgucgcgaguagcuuggugcucgucgugucccugggagcaauuucuuuuuggaugugcucgaacgguagcuuacagugccggaucuguaucuga

SEQ ID NO: 125038 - RNA, 1701 nt, Artificial Sequence
  derived and/or modified sequence opt3 from hemagglutinin__InfluenzaA__ACT22037
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggagagugugaaaaacggcacuuacgacuauccuaaguacuccgaagaggccaaacugaauagagaggaaauugauggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 125039 - RNA, 1701 nt, Artificial Sequence
  derived and/or modified sequence opt3 from hemagglutinin__InfluenzaA__ACT22038
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgaacgcugaucaacagagcuuguaccagaaugccgacgcguacguguucgucgggaguucucgcuauuccaagaaauuuaagccugagauugcaauccgaccaaaagugcgugaucaggagggaagaaugaacuacuauuggacucugguggaacccggugacaagauuaccuucgaggccacaggcaaccuagucguuccuagguacgcuuuugccauggaacggaaugcagggagcggaaucauaauuucggauacuccagugcaugacugcaacaccacaugucaaaccccgaaaggcgcuaucaauacgucucuccccuuccagaacauucacccuaucacuaucgguaagugcccaaaguauguaaaauccacaaagcugcgccuugccaccgggcugagaaaugugcccucaauucagaguaggggauuguuuggcgcgauagccggcuucaucgaagggggauggacugguauggucgacggcugguacggguaucaucaccagaacgaacaaggaagcggcuacgcagcugaucucaaauccacacagaaugccauugacgagaucaccaacaagguaaauucuguuauagagaaaaugaacacgcaguuuaccgcuguggguaaggaguucaaucaccuggaaaagcggauugaaaacuuaaauaaaaaggucgaugacggguuccuggauaucuggacauacaacgccgagcuccuugugcuguuggaaaaugagcgcacucuagacuaucaugauagcaacgugaaaaaccuguacgagaagguucgaucacagcucaaaaauaacgcaaaggaaaucggcaauggauguuuugaguucuaucacaagugcgacaacaccuguauggaaagugugaaaaauggcacauacgauuauccuaaguacuccgaggaagccaaacugaacagagaggagauugacggggucaaacuugaaagcacuaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 125040 - RNA, 1701 nt, Artificial Sequence
  derived and/or modified sequence opt3 from hemagglutinin__InfluenzaA__ACT22055
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuacgcaagucuuauauaaaugacaagggcaaagaaguacugguucuuuggggcauccaccaccccuccacgucagcugaucaacagagcuuguaccagaacgccgacgcguacguguucgucgggaccagucgauauucuaagaaauuuaagccugagauugcaauccguccaaaagugagagaucaggagggaaggaugaauuacuauuggacucugguggaacccggugacaagauuacauucgaggccacuggcaaccuagucguuccucgguacgcuuuugccauggaacgcaacgcaggguccggaaucauaauuagcgauaccccagugcaugacugcaauacaaccugucaaacgccgaaaggcgcuaucaacacuucgcuccccuuccagaauauucacccuaucacaaucgguaagugcccaaaguauguaaaaucuaccaagcugagacuugccacugggcugaggaacgugcccuccauucagucacggggauuguuuggcgcgauagccggcuucaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguuuacagcuguggguaaggaguucaaccaccuggaaaagcgcauugaaaauuuaaacaaaaaggucgaugacggguuccuggauaucuggacuuacaaugccgagcuccuugugcuguuggaaaacgagcgaacccuagacuaucaugauucuaauguaaagaaccuguacgagaagguuagaagccagcucaaaaacaaugcaaaggaaaucggcaacggauguuuugaguucuaucacaagugcgacaauacauguauggaaucagugaaaaacggcacuuacgauuauccuaaguacagugaggaagccaaacugaauagggaggagauugacggggucaaacuugaauccacccggaucuaucaaauucuggcuauauacagcacaguggcgucuucauugguccucgugguuagucugggagcaaucagcuuuuggaugugcuccaacgguucuuuacagugccguauuuguaucuga

SEQ ID NO: 125041 - RNA, 1701 nt, Artificial Sequence; identical to SEQ ID NO: 124998
  derived and/or modified sequence opt3 from hemagglutinin__InfluenzaA__ACT22504

SEQ ID NO: 125042 - RNA, 1701 nt, Artificial Sequence; identical to SEQ ID NO: 124927
  derived and/or modified sequence opt3 from hemagglutinin__InfluenzaA__ACT33122

SEQ ID NO: 125043 - RNA, 1701 nt, Artificial Sequence
  derived and/or modified sequence opt3 from hemagglutinin__InfluenzaA__ACT33123
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacaguuccggauuugcaucuga

SEQ ID NO: 125044 - RNA, 1701 nt, Artificial Sequence; identical to SEQ ID NO: 124685
  derived and/or modified sequence opt3 from hemagglutinin__InfluenzaA__ACT33125

SEQ ID NO: 125045 - RNA, 1701 nt, Artificial Sequence
  derived and/or modified sequence opt3 from hemagglutinin__InfluenzaA__ACT36505
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugauugaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 125046 - RNA, 1701 nt, Artificial Sequence
  derived and/or modified sequence opt3 from hemagglutinin__InfluenzaA__ACT36649
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaggaguuggagcuacauuguugagaccuccucuucggacaacggaacuugcuauccaggcgauuuuaucgacuacgaggagcuccgggagcagcuuaauucagugagcaguuucgaacgcuuugagauuuucccgaagacauccucuuggcccaaccacgauagcaauaagggugucaccgccgcuuguccucaugcaggggccaaauccuuuuauaagaaccugaucuggcucgugaaaaagggaaauucauacccaaaauuaaguaagagcuauauaaacgacaagggcaaagaaguacugguucuuuggggcauccaccaccccucuacguccgcugaucaacagucauuguaccagaaugccgacgcguacguguucgucgggagcagucgauauucuaagaaauuuaagccugagauugcaauccguccaaaagugagagaucaggagggaaggaugaacuacuauuggacucugguggaacccggugacaagauuaccuucgaggccacaggcaaccuagucguuccucgguacgcuuuugccauggaacgcaaugcaggguccggaaucauaauuagcgauacuccagugcaugacugcaacaccacaugucaaaccccgaaaggcgcuaucaauacgucgcuccccuuccagaacauucacccuaucacuaucgguaagugcccaaaguauguaaaaucuacaaagcugagacuugccaccgggcugaggaaugugcccuccauucagucacggggauuguuuggcgcgauagccggcuucaucgaagggggauggacugguauggucgacggcugguacggguaucaucaccagaacgaacaaggaaguggcuacgcagcugaucucaaaagcacacagaaugccauugacgagaucaccaacaagguuaauuccgugauagagaaaaugaacacgcaguuuaccgcuguggguaaggaguucaaucaccuggaaaagcgcauugaaaacuuaaauaaaaaggucgaugacggguuccuggauaucuggacauacaacgccgagcuccuugugcuguuggaaaaugagcgaacucuagacuaucaugauucuaacguaaaaagccuguacgagaagguuagaucacagcucaaaaacaaugcaaaggaaaucggcaacggauguuuugaguucuaucacaagugcgacaauaccuguauggaaagugugaaaaacggcacauacgauuauccuaaguacuccgaggaagccaaacugaauagggaggagauugacggggucaagcuggaaagcacucggaucuaucaaauucuggcuauauacucuaccguggcgucaaguuugguccucgugguuagccugggagcaaucuccuuuuggaugugcucuaacgguucguuacagugccguauuuguaucuga

SEQ ID NO: 125047 - RNA, 1701 nt, Artificial Sequence; identical to SEQ ID NO: 124685
  derived and/or modified sequence opt3 from hemagglutinin__InfluenzaA__ACT36650

SEQ ID NO: 125048 - RNA, 1701 nt, Artificial Sequence; identical to SEQ ID NO: 124685
  derived and/or modified sequence opt3 from hemagglutinin__InfluenzaA__ACT36652

SEQ ID NO: 125049 - RNA, 1701 nt, Artificial Sequence; identical to SEQ ID NO: 124683
  derived and/or modified sequence opt3 from hemagglutinin__InfluenzaA__ACT36653

SEQ ID NO: 125050 - RNA, 1701 nt, Artificial Sequence
  derived and/or modified sequence opt3 from hemagglutinin__InfluenzaA__ACT36655
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaucuucccgcuauagcaagaaauuuaagccugagauugcaauccgaccaaaagugcgugaccaggaggguagaaugaauuacuauuggacucugguggaacccggcgauaagauuaccuucgaggccacagggaaccuagucguuccuagguacgcuuuugccauggaacggaacgcaggaucgggcaucauaauuucugacacuccagugcaugauugcaauaccacaugucaaaccccgaaaggugcuaucaacacgucccuccccuuccagaauauucacccuaucacuaucgggaagugcccaaaguauguaaaaucaacaaagcugcgccuugccaccggacugagaaacgugcccaguauucagagcaggggcuuguuuggcgcgauagccggguucaucgagggagguuggacuggcauggucgacgggugguacggauaucaucaccagaaugaacaaggcuccgguuacgcagcugaccucaaaucuacacagaacgccauugaugagaucaccaauaaggugaacagcguuauagagaaaaugaauacgcaguuuaccgcuguggggaaggaguucaaccaccuggagaagcggauugaaaauuuaaacaaaaaggucgacgauggcuuccuggacaucuggacauacaaugccgagcuccuugugcuguuggaaaacgagcgcacucuagauuaucaugacucaaauguaaagaaccuguacgagaagguucgaagucagcucaaaaacaaugcaaaggaaaucggaaacggcuguuuugaguucuaucacaagugcgauaauaccuguauggaauccgugaaaaacgggacauacgacuauccuaaguacagcgaggaagccaaacugaauagagaggagauugauggagucaaacuugaaucuacuaggaucuaucaaauucuggcuauauacucaaccguggcgaguagcuugguccucgugguuucccugggugcaaucucuuuuuggaugugcucgaacggcagcuuacagugccggauuuguaucuga

SEQ ID NO: 125051 - RNA, 1701 nt, Artificial Sequence; identical to SEQ ID NO: 124672
  derived and/or modified sequence opt3 from hemagglutinin__InfluenzaA__ACT36658

SEQ ID NO: 125052 - RNA, 1701 nt, Artificial Sequence; identical to SEQ ID NO: 124711
  derived and/or modified sequence opt3 from hemagglutinin__InfluenzaA__ACT36659

SEQ ID NO: 125053 - RNA, 1701 nt, Artificial Sequence; identical to SEQ ID NO: 124672
  derived and/or modified sequence opt3 from hemagglutinin__InfluenzaA__ACT36661

SEQ ID NO: 125054 - RNA, 1701 nt, Artificial Sequence; identical to SEQ ID NO: 124685
  derived and/or modified sequence opt3 from hemagglutinin__InfluenzaA__ACT36663

SEQ ID NO: 125055 - RNA, 1701 nt, Artificial Sequence; identical to SEQ ID NO: 124685
  derived and/or modified sequence opt3 from hemagglutinin__InfluenzaA__ACT36666

SEQ ID NO: 125056 - RNA, 1701 nt, Artificial Sequence
  derived and/or modified sequence opt3 from hemagglutinin__InfluenzaA__ACT52687
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcguggacaggaggguagaaugaauuacuauuggacucugguggaacccggcgauaagauuaccuucgaggccacagggaaccuagucguuccuagguacgcuuuugccauggaacggaacgcaggaucgggcaucauaauuucugacacuccagugcaugauugcaauaccacaugucaaaccccgaaaggugcuaucaacacgucccuccccuuccagaauauucacccuaucacuaucgggaagugcccaaaguauguaaaaucaacaaagcugcgccuugccaccggacugagaaacgugcccaguauucagagcaggggcuuguuuggcgcgauagccggguucaucgagggagguuggacuggcauggucgacgggugguacggauaucaucaccagaaugaacaaggcuccgguuacgcagcugaccucaaaucuacacagaacgccauugaugagaucaccaauaaggugaacagcguuauagagaaaaugaauacgcaguuuaccgcuguggggaaggaguucaaccaccuggagaagcggauugaaaauuuaaacaaaaaggucgacgauggcuuccuggacaucuggacauacaaugccgagcuccuugugcuguuggaaaacgagcgcacucuagauuaucaugacucaaauguaaagaaccuguacgagaagguucgaagucagcucaaaaacaaugcaaaggaaaucggaaacggcuguuuugaguucuaucacaagugcgauaauaccuguauggaauccgugaaaaacgggacauacgacuauccuaaguacagcgaggaagccaaacugaauagagaggagauugauggagucaaacuugaaucuacuagguuuuaucaaauccuggcuauuuacucaaccguggcgaguagcuugguccucgugguuucccugggugcaauaucuuucuggaugugcucgaacggcagcuuacagugccggaucuguauuuga

SEQ ID NO: 125057 - RNA, 1701 nt, Artificial Sequence; identical to SEQ ID NO: 124672
  derived and/or modified sequence opt3 from hemagglutinin__InfluenzaA__ACT54606

SEQ ID NO: 125058 - RNA, 1701 nt, Artificial Sequence; identical to SEQ ID NO: 124685
  derived and/or modified sequence opt3 from hemagglutinin__InfluenzaA__ACT66146

SEQ ID NO: 125059 - RNA, 1701 nt, Artificial Sequence; identical to SEQ ID NO: 124927
  derived and/or modified sequence opt3 from hemagglutinin__InfluenzaA__ACT66155

SEQ ID NO: 125060 - RNA, 1701 nt, Artificial Sequence
  derived and/or modified sequence opt3 from hemagglutinin__InfluenzaA__ACT66162
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacaccugagcaguguguccucuuucgagcgguuugaaauuuucccgaaaacaagcuccuggcccaaucaugauucaaacaagggugucaccgccgcuuguccucacgcaggggccaagaguuuuuauaaaaaucugaucuggcucgugaagaaaggaaacagcuacccaaaguuaucuaaauccuauauaaaugacaagggcaaggagguacugguucuuuggggcauccaccaucccucaacgagcgcugaucagcaaaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcacgacugcaauaccacaugucagaccccgaagggcgcuaucaacacgucccuccccuuccaaaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguaaagaaccuguacgaaaaaguucgaagucagcucaagaacaaugcaaaagagaucggcaacggauguuuugaguucuaucauaagugcgacaauaccuguauggaauccgugaagaacggcacauacgauuauccuaaauacagcgaagaggccaagcugaauagagaggaaauugacggggucaaacuugagucuacuaggaucuaucagauucuggcuauauacucaaccguggcgaguagcuugguccucgugguuucccugggagcaaucucuuuuuggaugugcucgaacgguagcuuacaaugccggauuuguaucuga

SEQ ID NO: 125061 - RNA, 1701 nt, Artificial Sequence; identical to SEQ ID NO: 124685
  derived and/or modified sequence opt3 from hemagglutinin__InfluenzaA__ACT67239

SEQ ID NO: 125062 - RNA, 1701 nt, Artificial Sequence; identical to SEQ ID NO: 124685
  derived and/or modified sequence opt3 from hemagglutinin__InfluenzaA__ACT67255

SEQ ID NO: 125063 - RNA, 1701 nt, Artificial Sequence; identical to SEQ ID NO: 124672
  derived and/or modified sequence opt3 from hemagglutinin__InfluenzaA__ACT68102

SEQ ID NO: 125064 - RNA, 1701 nt, Artificial Sequence
  derived and/or modified sequence opt3 from hemagglutinin__InfluenzaA__ACT68103
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaacccucaaaggcgcuaucaacacgucccugccguuccagaauauucaccccaucacuaucgguaagugcccuaaguauguaaaaucaacaaaacuucgccuggccaccggguugagaaacgugccaaguauucagagcaggggacucuuuggcgcgauagccggcuucaucgaagggggauggacugguauggucgacggcugguacggguaucaucaccagaaugaacaaggauccggcuacgcagcugaucugaaaucuacacagaacgccauugacgagaucaccaauaaggugaacagcguuauagagaaaaugaauacgcaguuuaccgcuguggguaaggaguucaaccacuuagaaaagcggauugaaaaucugaacaaaaaggucgaugacggguuccucgauaucuggacauacaaugccgagcuucugguguugcuagaaaacgagcgcacucuggacuaucaugauucaaauguaaagaaccucuacgagaagguucgaagucagcugaaaaacaaugcaaaggaaaucggcaacggauguuuugaguucuaucacaagugcgacaauaccuguauggaauccgugaaaaacggcacauacgauuaucccaaguacagcgaggaagccaaacuuaauagagaggagauugacggggucaagcuggaaucuacuaggaucuaucaaauuuuggcuauauacucaaccguggcgaguagccucguccuggugguuuccuuaggagcaaucucuuuuuggaugugcucgaacgguagccugcagugccggauuuguaucuga

SEQ ID NO: 125065 - RNA, 1701 nt, Artificial Sequence; identical to SEQ ID NO: 124672
  derived and/or modified sequence opt3 from hemagglutinin__InfluenzaA__ACT68104

SEQ ID NO: 125066 - RNA, 1701 nt, Artificial Sequence
  derived and/or modified sequence opt3 from hemagglutinin__InfluenzaA__ACT68105
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuuccaaguauagcaaaaaguuuaaaccugagauugcaauccgcccaaaggugcgagaucaggagggacguaugaauuacuauuggacucugguggaacccggugacaaaauuaccuucgaggccacaggcaaccuagucguuccuagauacgcuuuugccauggaaaggaacgcagggucgggaaucauaauuucugauacuccagugcaugacugcaauaccacaugucaaaccccgaagggcgcuaucaacacgucccuccccuuccagaauauucacccuaucacuaucgguaagugcccaaaauauguaaagucaacaaaacugcggcuugccaccgggcugcgcaacgugcccaguauucagagcagaggauuguuuggcgcgauagccggcuucaucgaagggggauggacugguauggucgacggcugguacggguaucaucaccagaaugaacaaggauccggcuacgcagcugaucucaagucuacacagaacgccauugacgagaucaccaauaaagugaacagcguuauagagaagaugaauacgcaguuuaccgcuguggguaaggaauuuaaccaccuggagaaaaggauugaaaauuuaaacaagaaagucgaugacggguuccuggauaucuggacauacaaugccgagcuccuugugcuguuggaaaacgagcggacucuagacuaucaugauucaaauguaaagaaccuguacgagaaaguucgcagucagcucaagaacaaugcaaaggaaaucggcaacggauguuucgaguucuaucacaaaugcgacaauaccuguauggaauccgugaagaacggcacauacgauuauccuaaauacagcggggaggccaagcugaaucgagaagagauugacggagucaaacuugagucuacuagaaucuaucaaauucuggcuauauacucaaccguggcgaguagcuugguccucgugguuucccugggugcaaucucuuuuuggaugugcucgaacggcagcuuacagugcaggauuuguaucuga

SEQ ID NO: 125067 - RNA, 1701 nt, Artificial Sequence; identical to SEQ ID NO: 124672
  derived and/or modified sequence opt3 from hemagglutinin__InfluenzaA__ACT68106

SEQ ID NO: 125068 - RNA, 1701 nt, Artificial Sequence; identical to SEQ ID NO: 124672
  derived and/or modified sequence opt3 from hemagglutinin__InfluenzaA__ACT68107

SEQ ID NO: 125069 - RNA, 1701 nt, Artificial Sequence; identical to SEQ ID NO: 124865
  derived and/or modified sequence opt3 from hemagglutinin__InfluenzaA__ACT68108

SEQ ID NO: 125070 - RNA, 1701 nt, Artificial Sequence
  derived and/or modified sequence opt3 from hemagglutinin__InfluenzaA__ACT68109
augaaggccauccuggugguccuccuuuacaccuucgcuacagcaaacacugacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 125071 - RNA, 1701 nt, Artificial Sequence; identical to SEQ ID NO: 124672
  derived and/or modified sequence opt3 from hemagglutinin__InfluenzaA__ACT68110

SEQ ID NO: 125072 - RNA, 1701 nt, Artificial Sequence; identical to SEQ ID NO: 124672
  derived and/or modified sequence opt3 from hemagglutinin__InfluenzaA__ACT68112

SEQ ID NO: 125073 - RNA, 1701 nt, Artificial Sequence; identical to SEQ ID NO: 124672
  derived and/or modified sequence opt3 from hemagglutinin__InfluenzaA__ACT68113

SEQ ID NO: 125074 - RNA, 1701 nt, Artificial Sequence; identical to SEQ ID NO: 124672
  derived and/or modified sequence opt3 from hemagglutinin__InfluenzaA__ACT68115

SEQ ID NO: 125075 - RNA, 1701 nt, Artificial Sequence; identical to SEQ ID NO: 124672
  derived and/or modified sequence opt3 from hemagglutinin__InfluenzaA__ACT68119

SEQ ID NO: 125076 - RNA, 1701 nt, Artificial Sequence
  derived and/or modified sequence opt3 from hemagglutinin__InfluenzaA__ACT79133
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggaagcugguggaacccggugacaaaauuaccuucgaggccacaggcaaccuagucguuccuagguacgcuuuugccauggaacggaacgcagggagcggaaucauaauuucggauacuccagugcaugacugcaauaccacaugucaaaccccgaagggcgcuaucaacacgucucuccccuuccagaauauucacccuaucacuaucgguaagugcccaaaauauguaaaguccacaaaacugcgccuugccaccgggcugagaaacgugcccucaauucagaguaggggauuguuuggcgcgauagccggcuucaucgaagggggauggacugguauggucgacggcugguacggguaucaucaccagaaugaacaaggaagcggcuacgcagcugaucucaaguccacacagaacgccauugacgagaucaccaauaaagugaacucuguuauagagaagaugaauacgcaguuuaccgcuguggguaaggaguucaaccaccuggaaaaacggauugaaaauuuaaacaagaaagucgaugacggguuccuggauaucuggacauacaaugccgagcuccuugugcuguuggaaaacgagcgcacucuagacuaucaugauagcaauguaaagaaccuguacgagaaaguucgaucacagcucaagaacaaugcaaaggaaaucggcaacggauguuuugaguucuaucacaaaugcgacaauaccuguauggaaagugugaagaacggcacauacgauuauccuaaauacuccgaggaagccaagcugaauagagaggagauugacggggucaaacuugaaagcacuaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 125077 - RNA, 1701 nt, Artificial Sequence; identical to SEQ ID NO: 124672
  derived and/or modified sequence opt3 from hemagglutinin__InfluenzaA__ACT79143

SEQ ID NO: 125078 - RNA, 1701 nt, Artificial Sequence; identical to SEQ ID NO: 124711
  derived and/or modified sequence opt3 from hemagglutinin__InfluenzaA__ACT79153

SEQ ID NO: 125079 - RNA, 1701 nt, Artificial Sequence; identical to SEQ ID NO: 124998
  derived and/or modified sequence opt3 from hemagglutinin__InfluenzaA__ACT79163

SEQ ID NO: 125080 - RNA, 1701 nt, Artificial Sequence; identical to SEQ ID NO: 124998
  derived and/or modified sequence opt3 from hemagglutinin__InfluenzaA__ACT79173

SEQ ID NO: 125081 - RNA, 1701 nt, Artificial Sequence
  derived and/or modified sequence opt3 from hemagglutinin__InfluenzaA__ACT79625
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggagaagcggauugaaaauuuaaacaaaaagaucgaugacggguuccuggauaucuggaccuacaaugcugagcuccuuguccuguugaaaaacgaacgcacacuagacuaucaugauagcaaugugaagaaccuguacgagaaaguacgaucacagcucaagaacaaugccaaggagauuggcaacggauguuuugaguucuaucacaaaugcgacaauacuuguauggagaguguuaagaacggcaccuacgauuauccuaaauacuccgaagaggcaaagcugaauagagaagagaucgacggggugaaacuugagagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 125082 - RNA, 1701 nt, Artificial Sequence; identical to SEQ ID NO: 124672
  derived and/or modified sequence opt3 from hemagglutinin__InfluenzaA__ACT79627

SEQ ID NO: 125083 - RNA, 1701 nt, Artificial Sequence
  derived and/or modified sequence opt3 from hemagglutinin__InfluenzaA__ACT82512
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaaccuguacgagaagguacgaucacaguuuaaaaacaaugcaaaggaaaucggcaacggauguuucgaguuuuaucacaagugcgacaauacauguauggaaagugugaaaaacggcacuuacgauuauccuaaguacuccgaggaagccaaacucaauagagaggagauugacggggucaagcuggaaagcaccaggaucuaucaaauucuugcuauauacucuacaguggcgucaagucuggucuuggugguuagccucggagcaaucuccuucuggaugugcucuaacgguucgcugcagugccggauuuguaucuga

SEQ ID NO: 125084 - RNA, 1701 nt, Artificial Sequence; identical to SEQ ID NO: 124685
  derived and/or modified sequence opt3 from hemagglutinin__InfluenzaA__ACT82513

SEQ ID NO: 125085 - RNA, 1701 nt, Artificial Sequence
  derived and/or modified sequence opt3 from hemagglutinin__InfluenzaA__ACT82514
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucgaauaccccagugcaugauugcaacacaaccugucaaacgccgaaaggcucuaucaauacuucccuccccuuccagaacauucacccuaucacaaucgguaagugcccaaaguauguaaaaucaaccaagcugcgccuugcuacugggcugagaaaugugcccaguauucagagcaggggauuguuuggcgccauagcgggcuucaucgaagggggauggacagguauggucgacggcugguacggguaucaucaccagaacgaacaaggauccggcuacgccgcagaccucaaaucuacccagaaugcuauugaugagaucacgaacaaggugaauagcguuauagagaaaaugaacacccaguuuacagccguggguaaggaguucaaucaccuggaaaagcggauugaaaacuuaaauaaaaaggucgacgauggguuccuggacaucuggacuuacaacgcugagcuccuugugcuguuggaaaaugagcgcacccuagauuaucaugacucaaacguaaagaaccuguacgagaagguucgaagucagcucaaaaauaacgccaaggaaaucggcaauggauguuuugaguucuaucacaagugcgauaacacauguauggaauccgugaaaaauggcacuuacgacuauccuaaguacagcgaggaagcaaaacugaacagagaggagauugauggggucaaacuugaaucuaccaggaucuaucaaauucuggccauauacucaacaguggcuaguagcuugguccucgugguuucccugggagcgaucucuuuuuggaugugcucgaaugguagcuuacagugccggauuuguaucuga

SEQ ID NO: 125086 - RNA, 1701 nt, Artificial Sequence; identical to SEQ ID NO: 124685
  derived and/or modified sequence opt3 from hemagglutinin__InfluenzaA__ACT82515

SEQ ID NO: 125087 - RNA, 1701 nt, Artificial Sequence
  derived and/or modified sequence opt3 from hemagglutinin__InfluenzaA__ACT82516
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuaauggucccuagguacgcuuuugccauggaacggaacgcagggucgggaaucauaauuucugauacuccaguucaugacugcaauaccacaugucaaaccccgaaaggcgcuaucaacacgucccuccccuuccacaauauucauccuaucacuaucgguaagugcccaaaguaugugaaaucaacaaagcugcgccuugccaccgggcugagaaacguacccaguauucagagcaggggauuguuuggcgcgauagccggcuucaucgaagggggauggacugguaugguggacggcugguacggguaucaccaccagaaugaacagggauccggcuacgcagcugaucucaaaucuacacaaaacgccauugacgagaucaccaauaaggucaacagcgugauagagaaaaugaauacgcaguuuaccgcuguugguaaggaguucaaccaucuggaaaagcggauugaaaauuuaaacaaaaagguggaugacggguuccuggauaucuggacauacaaugccgagcuccuuguccuguuggaaaacgagcgcacucuagacuaucacgauucaaaugugaaaaaccuguacgagaagguacgaagucagcucaaaaacaaugcaaaggaaaucggcaacggauguuuugaguucuaucauaagugcgacaauaccuguauggaauccguuaaaaacggcacauacgauuauccuaaguacagcgaggaagccaaacugaauagagaggagauugacggggugaaacuugaaucuacuaggaucuaucagauucuggcuauauacucaaccgucgcgaguagcuuggugcucgucgugucccugggagcaaucucuuuuuggaugugcucgaacgguagcuuacaaugccggauuuguaucuga

SEQ ID NO: 125088 - RNA, 1701 nt, Artificial Sequence; identical to SEQ ID NO: 124927
  derived and/or modified sequence opt3 from hemagglutinin__InfluenzaA__ACT83795

SEQ ID NO: 125089 - RNA, 1701 nt, Artificial Sequence; identical to SEQ ID NO: 124927
  derived and/or modified sequence opt3 from hemagglutinin__InfluenzaA__ACT83805

SEQ ID NO: 125090 - RNA, 1701 nt, Artificial Sequence; identical to SEQ ID NO: 124685
  derived and/or modified sequence opt3 from hemagglutinin__InfluenzaA__ACT83815

SEQ ID NO: 125091 - RNA, 1701 nt, Artificial Sequence; identical to SEQ ID NO: 124685
  derived and/or modified sequence opt3 from hemagglutinin__InfluenzaA__ACT83825

SEQ ID NO: 125092 - RNA, 1701 nt, Artificial Sequence; identical to SEQ ID NO: 124685
  derived and/or modified sequence opt3 from hemagglutinin__InfluenzaA__ACT83835

SEQ ID NO: 125093 - RNA, 1701 nt, Artificial Sequence; identical to SEQ ID NO: 124778
  derived and/or modified sequence opt3 from hemagglutinin__InfluenzaA__ACT83845

SEQ ID NO: 125094 - RNA, 1701 nt, Artificial Sequence; identical to SEQ ID NO: 124672
  derived and/or modified sequence opt3 from hemagglutinin__InfluenzaA__ACT83855

SEQ ID NO: 125095 - RNA, 1701 nt, Artificial Sequence; identical to SEQ ID NO: 124685
  derived and/or modified sequence opt3 from hemagglutinin__InfluenzaA__ACT83865

SEQ ID NO: 125096 - RNA, 1701 nt, Artificial Sequence; identical to SEQ ID NO: 124927
  derived and/or modified sequence opt3 from hemagglutinin__InfluenzaA__ACT83875

SEQ ID NO: 125097 - RNA, 1701 nt, Artificial Sequence; identical to SEQ ID NO: 124927
  derived and/or modified sequence opt3 from hemagglutinin__InfluenzaA__ACT85999

SEQ ID NO: 125098 - RNA, 1701 nt, Artificial Sequence; identical to SEQ ID NO: 124927
  derived and/or modified sequence opt3 from hemagglutinin__InfluenzaA__ACT86009

SEQ ID NO: 125099 - RNA, 1701 nt, Artificial Sequence; identical to SEQ ID NO: 124685
  derived and/or modified sequence opt3 from hemagglutinin__InfluenzaA__ACT86019

SEQ ID NO: 125100 - RNA, 1701 nt, Artificial Sequence; identical to SEQ ID NO: 124778
  derived and/or modified sequence opt3 from hemagglutinin__InfluenzaA__ACT86029

SEQ ID NO: 125101 - RNA, 1701 nt, Artificial Sequence; identical to SEQ ID NO: 124685
  derived and/or modified sequence opt3 from hemagglutinin__InfluenzaA__ACT86039

SEQ ID NO: 125102 - RNA, 1701 nt, Artificial Sequence; identical to SEQ ID NO: 124685
  derived and/or modified sequence opt3 from hemagglutinin__InfluenzaA__ACT86059

SEQ ID NO: 125103 - RNA, 1701 nt, Artificial Sequence; identical to SEQ ID NO: 124685
  derived and/or modified sequence opt3 from hemagglutinin__InfluenzaA__ACT86069

SEQ ID NO: 125104 - RNA, 1701 nt, Artificial Sequence; identical to SEQ ID NO: 124685
  derived and/or modified sequence opt3 from hemagglutinin__InfluenzaA__ACT86079

SEQ ID NO: 125105 - RNA, 1701 nt, Artificial Sequence; identical to SEQ ID NO: 124685
  derived and/or modified sequence opt3 from hemagglutinin__InfluenzaA__ACT86089

SEQ ID NO: 125106 - RNA, 1701 nt, Artificial Sequence; identical to SEQ ID NO: 124685
  derived and/or modified sequence opt3 from hemagglutinin__InfluenzaA__ACT86099

SEQ ID NO: 125107 - RNA, 1701 nt, Artificial Sequence; identical to SEQ ID NO: 124927
  derived and/or modified sequence opt3 from hemagglutinin__InfluenzaA__ACT86109

SEQ ID NO: 125108 - RNA, 1701 nt, Artificial Sequence; identical to SEQ ID NO: 124685
  derived and/or modified sequence opt3 from hemagglutinin__InfluenzaA__ACT86119

SEQ ID NO: 125109 - RNA, 1701 nt, Artificial Sequence; identical to SEQ ID NO: 124927
  derived and/or modified sequence opt3 from hemagglutinin__InfluenzaA__ACT86129

SEQ ID NO: 125110 - RNA, 1701 nt, Artificial Sequence; identical to SEQ ID NO: 124685
  derived and/or modified sequence opt3 from hemagglutinin__InfluenzaA__ACT86139

SEQ ID NO: 125111 - RNA, 1701 nt, Artificial Sequence
  derived and/or modified sequence opt3 from hemagglutinin__InfluenzaA__ACU00932
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaauuuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacgagaucacgaacaaaguuaauucugugauagagaagaugaacacccaguuuacagcuguggguaaagaguucaaucaccuggaaaagcggauugaaaacuuaaauaagaaagucgaugacggguuccuggauaucuggacuuacaacgccgagcuccuugugcuguuggaaaaugagcgcacccuagacuaucaugauagcaacguaaagaaccuguacgagaaaguucgaucacagcucaagaauaacgcaaaagaaaucggcaauggauguuuugaguucuaucacaagugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 125112 - RNA, 1701 nt, Artificial Sequence; identical to SEQ ID NO: 124685
  derived and/or modified sequence opt3 from hemagglutinin__InfluenzaA__ACU00942

SEQ ID NO: 125113 - RNA, 1701 nt, Artificial Sequence; identical to SEQ ID NO: 124685
  derived and/or modified sequence opt3 from hemagglutinin__InfluenzaA__ACU00952

SEQ ID NO: 125114 - RNA, 1701 nt, Artificial Sequence
  derived and/or modified sequence opt3 from hemagglutinin__InfluenzaA__ACU12494
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaguccggggagucuuaugcaugcaagcgaggaagcgugaaguccuuuuucucacgucucaacugguuacacgagagugauuacaaauauccagcccugaaugucaccaugcccaacaauggcaaguuugacaaacuuuacaucuggggcgugcaucacccuauuacggauagagaacaaacuagcuuguacguaagggcuucugggcggguuaccguguccacaaagcgcucacagcagacugucaucccaaacauuggaagcagacccugggugaggggucugaguucucggaucuccauauauuggaccauugugaaaccuggcgacauccuacucauuaauagcacagggaaccugaucgccccacgcggauacuucaagauccgaaccggcaagucgucuauuaugagauccgacgcgccgauagguacguguucaagugagugcaucacucccaacgggagcauuccuaaugauaaaccauuucagaacgucaauaggaucacauauggagcauguccccgguacguuaagcaaaacacccuuaaacuggccacuggcaugcguaaugugccugaaaagcagacacgcggcauauucggggcuauugccggauuuaucgagaacgguugggagggcaugguagacgggugguauggauucagacaccagaauagcgaaggcaccggucaggcagcugauuugaaaucuacgcaagccgcgaucgaccagauuaacgggaagcucaauaggcugaucgagaaaaccaacgaaaaguuucaucagauugagaaggaguucagcgaaguggagggccggauacaagauuuagaaaaauacgucgaggacacaaagaucgaucuguggucauauaaugccgaacuccuuguggcacuggagaaccagcacacuauugacuugaccgauagugaaaugaauaaacuauucgagaagacacgaaaacagcugcgcgagaacgcugaagacaugggaaauggcugcuuuaagaucuaccauaagugugauaacgccugcaucggguccauuagaaacggaacuuacgaccacgacguuuauagggaugaggcucucaauaaccgguuccagauaaaagguguggaacugaaguccggcuacaaagacuggauccuuuggauuucuuuugccaucucaugcuuccuguugugugucgugcuccugggguuuauuaugugggcaugccaaaagggaaauauccgcuguaacauaugcaucuga

SEQ ID NO: 125115 - RNA, 1698 nt, Artificial Sequence; identical to SEQ ID NO: 124797
  derived and/or modified sequence opt3 from hemagglutinin__InfluenzaA__ACU12505

SEQ ID NO: 125116 - RNA, 1701 nt, Artificial Sequence
  derived and/or modified sequence opt3 from hemagglutinin__InfluenzaA__ACU12516
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucguggacgcucugcuuggagauccgcagugcgacggcuuucaaaacaaaaagugggaucuguucgucgaaagauccaaagccuauucuaauuguuaccccuaugacgugccugauuacgcaucguugaggucacucguugccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaaugucaccaugcccaacaacgagaaguucgacaaacuuuacauauggggcgugcaccauccuggcacagauaaugaccagaucagcuuguaugcccaggcuucugggcguauuacuguauccaccaagagaucacaacagacaguuaucccaaacauuggaagcaggccccgggugcgcgauaucaguucuagaauauccauuuacuggaccaucgucaaaccuggugacauucugcuaaucaauagcacgggcaaccucaucgccccaaggggguacuuuaagauucggucgggaaagucuuccauaaugcgcucagacgcgccgaucggcaaauguaauagugagugcauuacucccaacgguagcaucccuaaugauaagccauuccagaacgugaaucgaauaacauauggggcaugucccagauacgugaaacagaacacccugaaacuugccacuggaaugaggaaugucccugaaacacaaacccggggcauuuuuggcgcuaucgccggguucaucgagaacggaugggaagguaugguugacggcugguauggguuucgucaccaaaauuccgagggaacgggccaggcagcugaucugaagucuacccaggccgcgauuaaccagaucaaugguaaguugaaccgccucauugggaaaacaaacgagaaguuccaccagauagaaaaggaguucagcgaaguggagggcagaauccaggaccuggaaaaauacguagaggauacuaagauugacuuauggucauauaaugccgagcugcucguggcacuugaaaaccaacauaccaucgaucugacagacagugagaugaauaaauuguuugaaaggacuaagaaacagcuacgggagaacgcugaagauaugggaaauggcugcuucaagaucuaccacaagugugacaacgccugcauuggguccauacgaaauggaaccuaugaucaugacgucuaccgcgacgaggcucugaacaauagauuucagaucaaagguguggagcucaagagcggcuacaaagauuggauucuguggaucucuuucgccauuucaugcuuucuucuguguguugcauugcucggguucaucaugugggccugccagaagggaaacauaagguguaauaucugcauuuga

SEQ ID NO: 125117 - RNA, 1701 nt, Artificial Sequence; identical to SEQ ID NO: 122646
  derived and/or modified sequence opt3 from hemagglutinin__InfluenzaA__ACU12527

SEQ ID NO: 125118 - RNA, 1701 nt, Artificial Sequence; identical to SEQ ID NO: 124388
  derived and/or modified sequence opt3 from hemagglutinin__InfluenzaA__ACU12538

SEQ ID NO: 125119 - RNA, 1701 nt, Artificial Sequence; identical to SEQ ID NO: 123584
  derived and/or modified sequence opt3 from hemagglutinin__InfluenzaA__ACU12549

SEQ ID NO: 125120 - RNA, 1698 nt, Artificial Sequence
  derived and/or modified sequence opt3 from hemagglutinin__InfluenzaA__ACU12560
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccgggaaaaauggcuuguaccccaaccugagcaagucuuaugcaaauaacaaaggcaaggagguacuuguucucuggggagugcaccacccuccaaacaucggagaccagaauacgcuguaccauacugaaaacgccuacgucuccguggugucaagccacuauagucgcaaauucacccccgagauagcuaagcgaccuaagguccgugaucaggaagguagaaucaauuacuauuggacacuucuggagccaggcgacacuauuaucuuugaggcaaacgggaauuugauugccccgagguacgcuuucgcccucucucggggauuuggcuccgguaucauaaacagcaauguucccauggauaaaugugacgcgaagugccagaccccucaaggggcaauuaacucgucucugccauuccagaaugugcaucccguaacaaucggagaauguccuaaauaugugcgcuccgccaaguuaagaauggucaccggccugaggaacauuccaucaauccagagucggggccucuuuggggcuaucgccggauucauugaggguggcuggacggggaugguggauggaugguacggcuaucaccaccagaaugaacaagguagcggguacgcagcugaccagaaauccacucagaacgccauaaauggcaucacaaacaagguuaauucugugauugagaaaaugaacacccaguuuacugcggucggaaaggaguucaacaagcuagaacgccgaauggagaaucugaacaaaaagguggaugacggcuucaucgauauauggacauacaaugccgaauugcuaguacugcucgagaacgaaagaacccuggacuuucaugacagcaauguuaaaaaccuuuaugagaaggugaaaucacaacugaagaauaacgcaaaggaaauugggaauggaugcuucgaguuuuaccacaaauguaacgaugagugcauggaaagugucaagaaugguacguaugacuaccccaaauauuccgaggaaagcaaguugaacagggagaaaaucgauggcgugaagcucgagucuaugggggucuaccagauccuggcuauuuauucaaccguggccaguagcuuaguucugcuagugucccucggagcuaucucuuucuggaugugcucgaauggcagccugcagugucggauuugcauauga

SEQ ID NO: 125121 - RNA, 1698 nt, Artificial Sequence; identical to SEQ ID NO: 124504
  derived and/or modified sequence opt3 from hemagglutinin__InfluenzaA__ACU12571

SEQ ID NO: 125122 - RNA, 1698 nt, Artificial Sequence
  derived and/or modified sequence opt3 from hemagglutinin__InfluenzaA__ACU12582
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggcagauuugcugauuacgaggaacugagggagcaacucucuucggugagcucauucgaacgguuugagauuuucccuaaggagaguuccuggccaaaccauacugucacaggugugucugccagcugcucccacaauggggaaucaaguuuuuaucgcaacuuacuguggcuuaccgggaaaaauggcuuguaccccaaccugagcaagucuuaugcaaauaacaaaggcaaggaggugcuaguucucuggggagugcaucacccuccaaacaucggagaccagaauacgcuguaccacacugaaaacgccuacgucuccguggugucaagccauuauagucgaaaauucacccccgagauagcuaagcguccuaaggucagagaucaggaagguaggaucaauuacuauuggacacuucuggagccaggcgacacuauuaucuuugaggcaaacgggaauuugauugccccgcgguacgcuuucgcccucucucgcggauuuggcuccgguaucauaaacagcaaugcgcccauggauaaaugugacgcaaagugccagaccccucaaggggccauuaacucgucucugccauuccagaauguucaccccgugacaaucggagaauguccuaaauauguaagauccgcuaaguuaaggauggugaccggccugcggaacauuccaucaauccagagucgcggccucuuuggggccaucgcaggauucauugaggguggcuggacggggauggucgauggaugguacggcuaucaucaccagaaugaacaagguagcggguacgcugccgaccagaaauccacucagaacgcgauaaauggcaucacaaacaagguaaauucuguuauugagaaaaugaacacccaguuuacugccgugggaaaggaguucaacaaacuugaacgaagaauggagaaucugaacaaaaaggucgaugacggcuucaucgauauauggacauacaaugcagaauugcuagugcugcucgagaacgaaaggacccuggacuuucacgacagcaauguaaagaaccuuuaugagaagguuaaaucacaacugaagaauaacgcuaaggaaauugggaauggaugcuucgaguuuuaccauaaauguaacgaugagugcauggaaagugugaagaaugguacguaugacuaccccaaauauuccgaggaaagcaaguugaaccgggagaaaaucgauggcgucaagcucgagucuauggggguguaccagauccuggccauuuauucaaccgucgcuaguagcuuagugcugcuaguuucccucggagccaucucuuucuggaugugcucgaauggcagccugcagugucguauuugcauauga

SEQ ID NO: 125123 - RNA, 1698 nt, Artificial Sequence
  derived and/or modified sequence opt3 from hemagglutinin__InfluenzaA__ACU12593
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccucaaggcgccauuaauucgucucugccauuccagaacgugcaccccguaacaaucggugaguguccuaaguaugugagauccgcuaaauuaaggauggucaccgggcugcggaauauuccaucaauccagagucgcggacucuuuggcgccaucgcaggcuucauugaagggggauggacggguaugguggauggcugguacggguaucaucaccagaacgagcaaggaagcggcuacgcugccgaccagaaguccacucagaaugcgauagaugguaucacaaacaaaguuaauucugugauugaaaagaugaacacccaguuuacugccgucgggaaggaguucaauaaacuugagcgaagaauggaaaaccugaacaagaaaguggacgauggcuucaucgacauauggacauacaaugcagaguugcuaguacugcucgaaaacgagaggacccuggacuuucacgauagcaauguuaagaaccuuuaugaaaaagugaagucacaacugaagaauaacgcuaaagagauuggaaauggcugcuucgaguuuuaccauaaguguaacgacgaaugcauggagagugucaaaaaugggacguaugauuaccccaaguauuccgaagagagcaaauugaaccgggagaagaucgacggaaucaagcucgaaucuauggguguguaccagauucuggccaucuauucaaccgucgcuaguagcuuagugcugcuaguuucccucggcgccauuucuuucuggaugugcucgaaugggagccugcagugucguauaugcaucuga

SEQ ID NO: 125124 - RNA, 1701 nt, Artificial Sequence; identical to SEQ ID NO: 124685
  derived and/or modified sequence opt3 from hemagglutinin__InfluenzaA__ACU13090

SEQ ID NO: 125125 - RNA, 1701 nt, Artificial Sequence; identical to SEQ ID NO: 124685
  derived and/or modified sequence opt3 from hemagglutinin__InfluenzaA__ACU13091

SEQ ID NO: 125126 - RNA, 1701 nt, Artificial Sequence; identical to SEQ ID NO: 124685
  derived and/or modified sequence opt3 from hemagglutinin__InfluenzaA__ACU13092

SEQ ID NO: 125127 - RNA, 1701 nt, Artificial Sequence; identical to SEQ ID NO: 124685
  derived and/or modified sequence opt3 from hemagglutinin__InfluenzaA__ACU13093

SEQ ID NO: 125128 - RNA, 1701 nt, Artificial Sequence
  derived and/or modified sequence opt3 from hemagglutinin__InfluenzaA__ACU13094
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcguggacaggaggguagaaugaauuacuauuggacucugguggaacccggcgauaagauuaccuucgaggccacagggaaccuagucguuccuagguacgcuuuugccauggaacggaacgcaggaucgggcaucauaauuucugacacuccagugcaugauugcaauaccacaugucaaaccccgaaaggugcuaucaacacgucccuccccuuccagaauauucacccuaucacuaucgggaagugcccaaaguauguaaaaucaacaaagcugcgccuugccaccggacugagaaacgugcccaguauucagagcaggggcuuguuuggcgcgauagccggguucaucgagggagguuggacuggcauggucgacgggugguacggauaucaucaccagaaugaacaaggcuccgguuacgcagcugaccucaaaucuacacagaacgccauugaugagaucaccaauaaggugaacagcguuauagagaaaaugaauacgcaguuuaccgcuguggggaaggaguucaaccaccuggagaagcggauugaaaauuuaaacaaaaaggucgacgauggcuuccuggacaucuggacauacaaugccgagcuccuugugcuguuggaaaacgagcgcacucuagauuaucaugacucaaauguaaagaaccuguacgagaagguucgaagucagcucaaaaacaaugcaaaggaaaucggaaacggcuguuuugaguucuaucacaagugcgauaauaccuguauggaauccgugaaaaacgggacauacgacuauccuaaguacagcgaggaagccaaacugaauagagaggagauugauggagucaaacuugaaucuacuaggaucuaucaaauucuggcuauauacucaaccguggcgaguagcuugguccucgugguuucccugggugcaaucucuuuuuggaugugcucgaacggcagcuuacagugccggauuuguaucuga

SEQ ID NO: 125129 - RNA, 1701 nt, Artificial Sequence; identical to SEQ ID NO: 124685
  derived and/or modified sequence opt3 from hemagglutinin__InfluenzaA__ACU13095

SEQ ID NO: 125130 - RNA, 1701 nt, Artificial Sequence
  derived and/or modified sequence opt3 from hemagglutinin__InfluenzaA__ACU13096
augaaggccauccuggugguccuccuucacaccuucgcuacagcaaacgccgacacucugugcauuggcuaccaugcgaauaacagcacggauaccguugacacaguguuggagaaaaauguaacugugacccacuccgucaacuuacuggaagauaagcauaaugggaaacuauguaagcucagaggaguggcuccccugcaccuugguaaaugcaacauagccggcuggauccuggggaauccugagugugaaucuuugucaacagcaaguagcugguccuauauuguugagaccucuucgucagacaacggaacuugcuacccaggcgauuuuaucgacuaugaggagcucagggagcagcugagcaguguguccucuuucgaacgguuugagauuuucccgaagacaagcuccuggcccaaucaugauucaaacaagggugucaccgccgcuuguccucacgcaggggccaaaaguuuuuacaagaaucugaucuggcucgugaaaaagggaaacagcuauccaaaauuaucuaaguccuacauaaaugacaagggcaaagaaguacugguucuuuggggcauccaccaucccucaacgagcgcugaucaacagaguuuguaucagaacgccgacgcguacguguucgucgggucuucccgcuacagcaagaaauuuaagccugagauugcaauccgaccaaaagugcgugaucaggagggaagaaugaauuauuacuggacucugguggaacccggugacaagauuaccuucgaggccacaggcaaccuagucguuccuagguaugcuuuugccauggaacggaacgcagggucgggaaucauaauuucugauacuccagugcacgacugcaauaccacaugucaaaccccgaaaggcgcuaucaacacgucccuccccuuccagaauauucauccuaucacuaucgguaagugcccaaaguacguaaaaucaacaaagcugcgccuugccaccgggcugagaaacgugcccaguauucagagcaggggauuguuuggcgcgauagccggcuucaucgaagggggauggacugguauggucgacggcugguauggguaccaccaccagaaugaacaaggauccggcuaugcagcugaucucaaaucuacacagaacgccauugacgagaucaccaauaaggugaacagcguuauagagaaaaugaauacgcaguuuaccgcuguggguaaggaguucaaccaucuggaaaagcggauugaaaauuuaaacaaaaaggucgaugacggguuccuggauaucuggacauacaaugccgagcuccuugugcuguuggaaaacgagcgcacucuagacuaccacgauucaaauguuaaaaaccuguaugagaagguacgaagucagcucaaaaacaaugcaaaggaaaucggcaacggauguuuugaguucuaccauaagugcgacaauaccuguauggaauccgugaaaaacggcacauaugauuacccuaaguauagcgaggaagccaaacugaauagagaggagauugacggggucacucuugaaucuaccaggaucuaccaaauucuggcuauauauucaacaguggcgaguagcuugguccucgugguuucccugggagcaaucucuuuuuggaugugcucgaacgguagcuuacagugccggauuuguaucuga

SEQ ID NO: 125131 - RNA, 1701 nt, Artificial Sequence; identical to SEQ ID NO: 124685
  derived and/or modified sequence opt3 from hemagglutinin__InfluenzaA__ACU13098

SEQ ID NO: 125132 - RNA, 1701 nt, Artificial Sequence
  derived and/or modified sequence opt3 from hemagglutinin__InfluenzaA__ACU13099
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacuccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugagcaaggauccggcuacgcagcugaccucaaaucuacccagaacgccauugaugagaucacgaauaaggugaacagcguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacucaaauguuaaaaaccuguacgaaaagguacgaagucagcucaaaaacaaugcaaaggagaucggcaacggauguuuugaguucuaucacaagugcgauaauacauguauggaguccgugaaaaacggcacuuacgacuaucccaaguacagcgaagaggccaaacugaauagagaggaaauugauggggucaaacuugagucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 125133 - RNA, 1701 nt, Artificial Sequence
  derived and/or modified sequence opt3 from hemagglutinin__InfluenzaA__ACU13129
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagagaaaaugaauacccaguuuacagcugugggugaggaguucaaccaccuggaaaagcggauugaaaauuuaaacaagaaagucgacgauggguuccuggacaucuggacuuacaaugccgagcuccuugugcuguuggagaacgaacgcacccuagauuaucaugacagcaauguaaagaaccuguacgagaaaguucgaucacagcucaagaacaaugcaaaagaaaucggcaacggauguuuugaguucuaucacaagugcgauaauacauguauggaaagugugaagaacggcacuuacgacuauccuaaauacuccgaggaggccaagcugaauagagaagagauugauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 125134 - RNA, 1701 nt, Artificial Sequence; identical to SEQ ID NO: 124685
  derived and/or modified sequence opt3 from hemagglutinin__InfluenzaA__ACU16795

SEQ ID NO: 125135 - RNA, 1701 nt, Artificial Sequence; identical to SEQ ID NO: 124685
  derived and/or modified sequence opt3 from hemagglutinin__InfluenzaA__ACU16858

SEQ ID NO: 125136 - RNA, 1701 nt, Artificial Sequence; identical to SEQ ID NO: 124685
  derived and/or modified sequence opt3 from hemagglutinin__InfluenzaA__ACU16930

SEQ ID NO: 125137 - RNA, 1701 nt, Artificial Sequence; identical to SEQ ID NO: 124685
  derived and/or modified sequence opt3 from hemagglutinin__InfluenzaA__ACU16993

SEQ ID NO: 125138 - RNA, 1701 nt, Artificial Sequence; identical to SEQ ID NO: 124685
  derived and/or modified sequence opt3 from hemagglutinin__InfluenzaA__ACU17059

SEQ ID NO: 125139 - RNA, 1701 nt, Artificial Sequence; identical to SEQ ID NO: 124685
  derived and/or modified sequence opt3 from hemagglutinin__InfluenzaA__ACU17126

SEQ ID NO: 125140 - RNA, 1701 nt, Artificial Sequence; identical to SEQ ID NO: 124776
  derived and/or modified sequence opt3 from hemagglutinin__InfluenzaA__ACU17187

SEQ ID NO: 125141 - RNA, 1701 nt, Artificial Sequence; identical to SEQ ID NO: 124685
  derived and/or modified sequence opt3 from hemagglutinin__InfluenzaA__ACU17258

SEQ ID NO: 125142 - RNA, 1701 nt, Artificial Sequence
  derived and/or modified sequence opt3 from hemagglutinin__InfluenzaA__ACU17389
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccgcuugucaaacaccgaagggcgccaucaacaccucccuccccuuccacaauauucauccuaucacgaucgguaaaugcccaaaguauguaaagucaacuaaacugcgccuugcgacagggcugagaaacgugcccaguauucagagcaggggauuguuuggcgccauagcaggcuucaucgaagggggauggaccgguauggucgacggcugguacggguaucaccaccagaaugagcagggauccggcuacgcugccgaucucaagucuacucaaaacgcuauugacgagaucacaaauaaagugaacagcguuauagaaaagaugaauacccaguuuacggccguggguaaagaguucaaccaucuggaaaagcggauugagaauuuaaacaagaaagucgaugacggguuccuggauaucuggaccuacaaugcagaacuccuugugcuguuggagaacgagcgcacacuagacuaucacgauucaaauguaaagaaccuguacgaaaaaguucgaagucagcucaagaacaaugccaaagagaucggcaacggauguuuugaguucuaucauaagugcgacaauacuuguauggaauccgugaagaacggcaccuacgauuauccuaaauacagcgaagaggcuaagcugaauagagaggaaauugacggggucaaacuugagucuacaaggaucuaucagauucuggcgauauacucaacuguggcaaguagcuugguccucgugguuucccugggagccaucucuuuuuggaugugcucgaacgguagcuuacaaugccggauuuguaucuga

SEQ ID NO: 125143 - RNA, 1701 nt, Artificial Sequence; identical to SEQ ID NO: 124685
  derived and/or modified sequence opt3 from hemagglutinin__InfluenzaA__ACU17450

SEQ ID NO: 125144 - RNA, 1701 nt, Artificial Sequence; identical to SEQ ID NO: 124685
  derived and/or modified sequence opt3 from hemagglutinin__InfluenzaA__ACU17521

SEQ ID NO: 125145 - RNA, 1701 nt, Artificial Sequence; identical to SEQ ID NO: 124672
  derived and/or modified sequence opt3 from hemagglutinin__InfluenzaA__ACU27041

SEQ ID NO: 125146 - RNA, 1698 nt, Artificial Sequence
  derived and/or modified sequence opt3 from hemagglutinin__InfluenzaA__ACU27406
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaaucagagaucaggaggggaggauuaacuacuauuggacacuucuggagccaggagacacuaucauuuuugaagcaaaugguaacuugaucgccccgcgguacgcuuucgcccucucucgcggcuuuggguccggaauaauuaauagcaacgcgcccauggauaagugugacgcaaaaugccagaccccucaaggcgccaucaauucgucucugccauuccagaacguucaccccgugacaauuggugaguguccuaaguauguaagauccgcuaaauuaaggauggugaccgggcugcggaauaucccaucaauccagagucgcggacucuuuggcgccauugcaggcuucauagaagggggauggacggguauggucgauggcugguacggguaucaucaccagaacgagcaaggaagcggcuacgcugccgaccagaaguccacucagaaugcgaucaacgguauuacaaauaaagugaacucuguuaucgaacgaaugaauacccaguuuacugccguggggaaggaguucaacaaacuugagagaaggauggaaaaccugaauaaaaaggucgaugacggcuucauagauauuuggacauacaacgcagaguugcuagugcugcucgaaaaugagcggacccuggacuuucacgacagcaacguuaaaaaucuuuaugaaaagguaaaaucacaacugaagaacaaugcuaaggagaucggaaacggcugcuucgaguuuuaccauaaauguaaugaugaaugcauggagagugugaagaacgggacguaugacuaccccaaauauuccgaagagagcaaguugaaucgugagaaaaucgauggagucaagcucgaaucuauggguguguaccagauucuggccaucuauucaaccgucgcuaguagcuuagugcugcuaguuucccucggcgccauuucuuucuggaugugcucgaacgggagccugcagugucgcauaugcaucuga

SEQ ID NO: 125147 - RNA, 1698 nt, Artificial Sequence
  derived and/or modified sequence opt3 from hemagglutinin__InfluenzaA__ACU27407
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccucaaggcgccauuaauucgucucugccauuccagaacgugcaccccguaacaaucggugaguguccuaaguaugugagauccgcuaaauuaaggauggucaccgggcugcggaauauuccaucaauccagagucgcggacucuuuggcgccaucgcaggcuucauugaagggggauggacggguaugguggauggcugguacggguaucaucaccagaacgagcaaggaagcggcuacgcugccgaccagaaguccacucagaaugcgauaaacgguaucacaaauaaaguuaacucugugauugaaaagaugaauacccaguuuacugccgucgggaaggaguucaacaaacuugagcgaagaauggaaaaccugaauaagaaaguggaugacggcuucaucgauauauggacauacaacgcagaguugcuaguacugcucgaaaaugagaggacccuggacuuucacgacagcaacguuaagaaucuuuaugaaaaagugaagucacaacugaagaacaaugcuaaagagauuggaaacggcugcuucgaguuuuaccauaaguguaaugaugaaugcauggagagugucaaaaacgggacguaugacuaccccaaguauuccgaagagagcaaauugaaucgggagaagaucgauggagugaagcucgaaucuaugggugucuaccagauccuggccauuuauucaaccguggcuaguagcuuaguucugcuagugucccucggcgccaucucuuucuggaugugcucgaacgggagccugcagugucguauuugcauauga

SEQ ID NO: 125148 - RNA, 1701 nt, Artificial Sequence; identical to SEQ ID NO: 124672
  derived and/or modified sequence opt3 from hemagglutinin__InfluenzaA__ACU29949

SEQ ID NO: 125149 - RNA, 1701 nt, Artificial Sequence
  derived and/or modified sequence opt3 from hemagglutinin__InfluenzaA__ACU29979
augaaggccauccuggugguccuccuuuacaccuucgcugcagccaacgcggacacacugugcauuggcuaucacgcuaauaacagcacugauacgguugacaccguguuggagaaaaauguaacagugacucauuccgucaacuuacuggaagauaagcacaaugggaaacuauguaagcucagaggaguggcaccccugcaucuugguaaaugcaacauagccggcuggauccuggggaauccugagugugaaucuuugucaaccgccaguagcugguccuacauuguugagacaucuucgucagacaacggaaccugcuauccaggcgauuuuaucgacuacgaggagcucagggagcagcugagcaguguguccucuuucgaacgguuugagauuuucccgaagacuagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgccgaucaacagaguuuguaccagaacgcggacgcauacguguucgucgggacgucucgcuauuccaagaaauuuaagccugagauugccauccgaccaaaagugcgugaucaggagggaagaaugaauuacuauuggacucugguggaacccggugacaagauuaccuucgaggcuacaggcaaccuagucguuccuagguacgccuuugcaauggaacggaacgcugggagcggaaucauaauuucggauacuccagugcaugacugcaauaccacaugucaaaccccgaaaggcgccaucaacacgucucuccccuuccagaauauucacccuaucacuaucgguaagugcccaaaguauguaaaauccacaaagcugcgccuugcgaccgggcugagaaacgugcccucaauucagaguaggggauuguuuggcgccauagcaggcuucaucgaagggggauggacugguauggucgacggcugguacggguaucaucaccagaaugaacaaggaagcggcuacgcugccgaucucaaauccacacagaacgcuauugacgagaucaccaauaaggugaacucuguuauagagaaaaugaauacgcaguuuaccgccguggguaaggaguucaaccaccuggaaaagcggauugaaaauuuaaacaaaaaggucgaugacggguuccuggauaucuggacauacaaugcagagcuccuugugcuguuggaaaacgagcgcacucuagacuaucaugauagcaauguaaagaaccuguacgagaagguucgaucacagcucaaaaacaaugccaaggaaaucggcaacggauguuuugaguucuaucacaagugcgacaauaccuguauggaaagugugaaaaacggcacauacgauuauccuaaguacuccgaggaagcuaaacugaauagagaggagauugacggggucaaacuugaaagcacuaggaucuaucaaauucuggcgauauacucuaccguggcaucaaguuugguccucgugguuagccugggagccaucuccuuuuggaugugcucuaacgguucguuacagugccggauuuguaucuga

SEQ ID NO: 125150 - RNA, 1701 nt, Artificial Sequence; identical to SEQ ID NO: 124685
  derived and/or modified sequence opt3 from hemagglutinin__InfluenzaA__ACU29989

SEQ ID NO: 125151 - RNA, 1704 nt, Artificial Sequence
  derived and/or modified sequence opt3 from hemagglutinin__InfluenzaA__ACU29999
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacugcagugccggauuuguaucuga

SEQ ID NO: 125152 - RNA, 1704 nt, Artificial Sequence
  derived and/or modified sequence opt3 from hemagglutinin__InfluenzaA__ACU30009
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguaaagaaccuguacgaaaaaguucgaagucagcucaagaacaaugcaaaagagaucggcaacggauguuuugaguucuaucauaagugcgacaauaccuguauggaauccgugaagaacggcacauacgauuauccuaaauacagcgaagaggccaagcugaauagagaggaaauugacggggucaaacuugagucuacuaggaucuaucagauucuggcuauauacucaaccguggcgaguagcuugguccucgugguuucccugggagcaaucucuuuuuggaugugcucggguuacggcagcuuacaaugccggauuuguaucuga

SEQ ID NO: 125153 - RNA, 1701 nt, Artificial Sequence; identical to SEQ ID NO: 125045
  derived and/or modified sequence opt3 from hemagglutinin__InfluenzaA__ACU30019

SEQ ID NO: 125154 - RNA, 1701 nt, Artificial Sequence; identical to SEQ ID NO: 124865
  derived and/or modified sequence opt3 from hemagglutinin__InfluenzaA__ACU30093

SEQ ID NO: 125155 - RNA, 1701 nt, Artificial Sequence
  derived and/or modified sequence opt3 from hemagglutinin__InfluenzaA__ACU30103
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuaccauuggacccugguggaacccggugacaagauuacauucgaggccacuggcaaccuagucguuccuagguaugcuuuugccauggaacggaacgcagggagcggaaucauaauuucggauaccccagugcacgacugcaauacaaccugucaaacgccgaaaggcgcuaucaacacuucucuccccuuccagaauauucauccuaucacaaucgguaagugcccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaccaccagaaugaacaaggaagcggcuaugcagcugaucucaaauccacccagaacgccauugacgagaucacgaauaaggugaacucuguuauagagaaaaugaauacccaguuuacagcuguggguaaggaguucaaccaucuggaaaagcggauugaaaauuuaaacaaaaaggucgaugacggguuccuggauaucuggacuuacaaugccgagcuccuugugcuguuggaaaacgagcgcacccuagacuaccacgauagcaauguaaagaaccuguaugagaagguucgaucacagcucaaaaacaaugcaaaggaaaucggcaacggauguuuugaguucuaccauaagugcgacaauacauguauggaaagugugaaaaacggcacuuaugauuacccuaaguauuccgaggaagccaaacugaauagagaggagauugacggggucaaacuugaaagcaccaggaucuaccaaauucuggcuauauauucuacaguggcgucaaguuugguccucgugguuagccugggagcaaucuccuuuuggaugugcucuaacgguucguuacagugccggauuuguaucuga

SEQ ID NO: 125156 - RNA, 1704 nt, Artificial Sequence
  derived and/or modified sequence opt3 from hemagglutinin__InfluenzaA__ACU30112
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguaaagaaccuguacgaaaaaguucgaagucagcucaagaacaaugcaaaagagaucggcaacggauguuuugaguucuaucauaagugcgacaauaccuguauggaauccgugaagaacggcacauacgauuauccuaaauacagcgaagaggccaagcugaauagagaggaaauugacggggucaaacuugagucuacuaggaucuaucagauucuggcuauauacucaaccguggcgaguagcuugguccucgugguuucccugggagcaaucucuuuuuggaugugcucgcacaugguguuacugcaaugccggauuuguaucuga

SEQ ID NO: 125157 - RNA, 1701 nt, Artificial Sequence
  derived and/or modified sequence opt3 from hemagglutinin__InfluenzaA__ACU30121
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguaaagaaccuguacgaaaaaguucgaaaccagcucaagaauaacgcaaaagagaucggcaauggauguuuugaguucuaucauaagugcgacaacaccuguauggaaagugugaagaauggcacauacgauuauccuaaauacuccgaagaggccaagcugaacagagaggaaauugacggggucaaacuugagagcacuaggaucuaucagauucuggcuauauacucuaccguggcgucaaguuugguccucgugguuagccugggagcaaucuccuuuuggaugugcucuaaugguucguuacaaugccggauuuguaucuga

SEQ ID NO: 125158 - RNA, 1701 nt, Artificial Sequence; identical to SEQ ID NO: 124778
  derived and/or modified sequence opt3 from hemagglutinin__InfluenzaA__ACU31124

SEQ ID NO: 125159 - RNA, 1701 nt, Artificial Sequence; identical to SEQ ID NO: 124717
  derived and/or modified sequence opt3 from hemagglutinin__InfluenzaA__ACU31143

SEQ ID NO: 125160 - RNA, 1701 nt, Artificial Sequence; identical to SEQ ID NO: 124717
  derived and/or modified sequence opt3 from hemagglutinin__InfluenzaA__ACU31144

SEQ ID NO: 125161 - RNA, 1701 nt, Artificial Sequence; identical to SEQ ID NO: 124717
  derived and/or modified sequence opt3 from hemagglutinin__InfluenzaA__ACU31145

SEQ ID NO: 125162 - RNA, 1701 nt, Artificial Sequence; identical to SEQ ID NO: 124865
  derived and/or modified sequence opt3 from hemagglutinin__InfluenzaA__ACU31146

SEQ ID NO: 125163 - RNA, 1701 nt, Artificial Sequence; identical to SEQ ID NO: 124685
  derived and/or modified sequence opt3 from hemagglutinin__InfluenzaA__ACU31147

SEQ ID NO: 125164 - RNA, 1701 nt, Artificial Sequence
  derived and/or modified sequence opt3 from hemagglutinin__InfluenzaA__ACU31148
augaaggccauccuggugauuaugcucuacaccuucgcuacagcaaacgccgacacucuuugcauaggcuaucacgcgaauaacagcacggauaccgucgacacaguucuggagaaaaaugugacuguaacccauuccgugaacuuguuagaagauaagcacaaugggaaacuguguaagcuaagaggagucgcuccccuccaucuggguaaaugcaacaucgccggcuggauucuugggaauccugagugugaaucucugucaacagcaaguagcugguccuacaucguggagaccucuucgucagacaacggaacuugcuauccaggcgauuuuauugacuacgaagaguugagggagcagcucagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcuggucaaaaagggaaacagcuacccaaaacucucuaaguccuauaucaaugacaagggcaaagaaguguuaguacuguggggcauucaccaccccucaacgagcgcugaucaacagagucuuuaccagaacgccgacgcguacguuuucguggggucuucccgcuauagcaagaaauuuaagccugagaucgcaauucgaccaaaaguccgugaucaggagggaagaaugaauuacuauuggacuuugguggaacccggugacaagaucaccuucgaggccacaggcaaccugguggucccuagguacgcuuuugccauggaacggaacgcagggucgggaauaauuaucucugauacuccaguucaugacugcaauaccacaugucaaaccccgaaaggcgcuauuaacacgucccuacccuuccagaauauccacccuaucacuauugguaagugcccaaaguaugugaaaucaacaaagcuccgccuggccaccgggcuuagaaacguacccaguauacagagcaggggacuguuuggcgcgaucgccggcuucauugaagggggauggacugguaugguggacggcugguacggguaucaucaccagaaugaacaaggauccggcuacgcagcugauuugaaaucuacacagaacgccaucgacgagauaaccaauaaggucaacagcgugauugagaaaaugaauacgcaguuuaccgcuguugguaaggaguucaaccaccucgagaagcggaucgaaaaucugaacaaaaagguggaugacggguucuuagauaucuggacauacaaugccgagcugcucguccuucuggaaaacgagcgcacuuuggacuaucaugauucaaaugugaaaaaccuauacgagaagguacgaagucagcugaaaaacaaugcaaaggaaauuggcaacggauguuuugaguucuaucacaagugcgacaauaccuguauggaauccguuaaaaacggcacauacgauuauccuaaguacagcgaggaagccaaacucaauagagaggagaucgacggggugaagcuggaaucuacuaggauuuaucaaauacuugcuaucuacucaaccgucgcgaguagccugguguuggucgugucccucggagcaauuucuuuuuggaugugcucgaacgguagccugcagugccggaucuguaucuga

SEQ ID NO: 125165 - RNA, 1701 nt, Artificial Sequence; identical to SEQ ID NO: 124672
  derived and/or modified sequence opt3 from hemagglutinin__InfluenzaA__ACU31149

SEQ ID NO: 125166 - RNA, 1701 nt, Artificial Sequence; identical to SEQ ID NO: 124672
  derived and/or modified sequence opt3 from hemagglutinin__InfluenzaA__ACU31150

SEQ ID NO: 125167 - RNA, 1701 nt, Artificial Sequence; identical to SEQ ID NO: 124672
  derived and/or modified sequence opt3 from hemagglutinin__InfluenzaA__ACU31151

SEQ ID NO: 125168 - RNA, 1701 nt, Artificial Sequence; identical to SEQ ID NO: 124672
  derived and/or modified sequence opt3 from hemagglutinin__InfluenzaA__ACU31152

SEQ ID NO: 125169 - RNA, 1707 nt, Artificial Sequence
  derived and/or modified sequence opt3 from hemagglutinin__InfluenzaA__ACU46644
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagguaaaccccugauucuaagagauugcagggucgccggcuggcuccuggggaacccuaugugugacgaguuuaucaaugugccagaauggucauauauaguugagaaggcgaacccggugaaugaucuuugcuaccccggagacuucaacgauuaugaggaacugaagcauuugcucagucggaucaaucacuuugagaaaauucagaucauuccuaagagcuccuggucuucgcaugaggcuucacugggcgucagcagugccuguccauaccaggguaaauccucuuucuuucgcaacgugguauggcugaucaagaaaaauagcacauaucccacuauaaagcgauccuacaacaauaccaaccaagaagaccucuuaguucugugguggauucaccacccuaaugaugcagccgagcagacaaaacuuuaucagaacccaaccacuuacaucucaguggggacaaguaccuugaaccagcgucugguccccagaauugcuacgaggagcaaagugaauggacaaucuggccggauggaguucuuuuggacuauccuaaagccuaacgacgcaaucaauuucgaauccaacggcaauuuuauugccccagaauacgcuuauaaaauagugaagaaaggggauucaaccaucaugaaaagcgagcucgaauacggaaacugcaauacaaaaugucagacuccgaugggugccauuaacaguucuaugcccuuccaucacauccauccucugaccauaggcgagugcccaaaguaugucaaguccaaucgccuuguucuggcgacaggguugagaaacagcccccagagggagcggcgccgaaagaagagaggacucuuuggcgcaauugccgguuucaucgaagggggauggcagggcaugguggacggcugguacggguaucaccacucgaaugagcaaggaucugguuacgcugccgacaaagaauccacccagaaggcaaucgauggcguaacgaacaaagucaauucaauuaucgacaagaugaacacucaguuugaggcuguggggagggaguucaaucaucuggaacggcguauugagaacuuaaacaagaaaauggaagauggauuccuggacguguggacauauaaugccgagcuccuuguucugauggaaaacgagcgcaccuuggauuuucacgacaguaaugugaagaaccuauacgauaaagucagacugcaacucagggacaaugcgaaggaacugggcaacgguuguuucgaguuuuaccauaaaugcgaugacgaguguauggaaagcgugcggaaugggacuuaugauuacccucaguauuccgaggaagcccgacuuaagcgcgaggagauaucuggcguaaagcuggaaagcaucggaauuuaccagaucuugucaaucuauaguacaguugcauccagccucgcucuggccauuaugguggcuggcuuaucucuguggaugugcucaaacgggagucuacagugcagaauauguaucuga

SEQ ID NO: 125170 - RNA, 1701 nt, Artificial Sequence
  derived and/or modified sequence opt3 from hemagglutinin__InfluenzaA__ACU56924
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugauagagagggaaggaugaauuacuauuggacccugguggaacccggugacaagauuacauucgaggccacuggcaaccuagucguuccucgguacgcuuuugccauggaacgcaacgcagggagcggaaucauaauuucggauaccccagugcaugacugcaauacaaccugucagacgccgaaaggcgcuaucaacacuucucuccccuuccaaaauauucacccuaucacaaucgguaagugcccaaaguauguaaaauccaccaagcugagacuugccacugggcugaggaacgugcccucaauucagagucggggauuguuuggcgcgauagccggcuucaucgaagggggauggacagguauggucgacggcugguacggguaucaucaccagaaugaacagggaagcggcuacgcagcugaucucaaauccacccaaaacgccauugacgagaucacgaauaaggugaacucuguuauagagaaaaugaauacccaguuuacagcuguggguaaggaguucaaccaccuggaaaagcgcauugaaaauuuaaacaaaaaggucgaugacggguuccuggauaucuggacuuacaaugccgagcuccuugugcuguuggaaaacgagcgaacccuagacuaucaugauagcaauguaaagaaccuguacgagaagguuagaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagggaggagauugacggggucaaacuugaaagcacccggaucuaucagauucuggcuauauacucuacaguggcgucaaguuugguccucgugguuagccugggagcaaucuccuuuuggaugugcucuaacgguucguuacaaugccguauuuguaucuga

SEQ ID NO: 125171 - RNA, 1701 nt, Artificial Sequence; identical to SEQ ID NO: 125038
  derived and/or modified sequence opt3 from hemagglutinin__InfluenzaA__ACU56931

SEQ ID NO: 125172 - RNA, 1701 nt, Artificial Sequence; identical to SEQ ID NO: 124685
  derived and/or modified sequence opt3 from hemagglutinin__InfluenzaA__ACU64792

SEQ ID NO: 125173 - RNA, 1701 nt, Artificial Sequence; identical to SEQ ID NO: 124865
  derived and/or modified sequence opt3 from hemagglutinin__InfluenzaA__ACU64801

SEQ ID NO: 125174 - RNA, 1701 nt, Artificial Sequence; identical to SEQ ID NO: 124865
  derived and/or modified sequence opt3 from hemagglutinin__InfluenzaA__ACU64812

SEQ ID NO: 125175 - RNA, 1701 nt, Artificial Sequence; identical to SEQ ID NO: 124334
  derived and/or modified sequence opt3 from hemagglutinin__InfluenzaA__ACU79871

SEQ ID NO: 125176 - RNA, 1701 nt, Artificial Sequence; identical to SEQ ID NO: 124332
  derived and/or modified sequence opt3 from hemagglutinin__InfluenzaA__ACU79882

SEQ ID NO: 125177 - RNA, 1701 nt, Artificial Sequence; identical to SEQ ID NO: 124345
  derived and/or modified sequence opt3 from hemagglutinin__InfluenzaA__ACU79893

SEQ ID NO: 125178 - RNA, 1701 nt, Artificial Sequence; identical to SEQ ID NO: 124345
  derived and/or modified sequence opt3 from hemagglutinin__InfluenzaA__ACU79904

SEQ ID NO: 125179 - RNA, 1698 nt, Artificial Sequence
  derived and/or modified sequence opt3 from hemagglutinin__InfluenzaA__ACU79937
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucacggcaagcugcucccacaacgggaagucaaguuuuuaccggaaucucuuauggcugacugagaaaaacggacuuuaucccaauuugagcaacucuuacgugaauaacaaggaaaaagaaguacugguucuauggggcgugcaucacccuuccaacaucggcguccagcgcgccauauaccacaccgagaaugcuuaugugucaguggucagcagucauuacucucgacguuucacaccagaaaucgcaaagagacccaaaguuagggggcaggagggacggauuaacuauuacuggacucuccuggagccuggugauaccaucauuuuugaagccaauggcaaccuuaucgcuccaugguaugccuucgcgcugucccgcggguuuggaagcggcauaauuacaucgaaugcaccgaugaacgagugugacgccaagugccagacgccccaaggugcuaucaauucuuccuugccuuuccagaacgugcacccaguaaccauuggggaaugucccaaguacgugagaucaacuaaacucaggauggucacaggacugcggaauaucccuaguauccagagccgcggcuuauuuggcgccauugcaggguucauagagggagguuggaccggcaugauggaugggugguauggauaccaucaccagaacgaacaaggcuccgguuacgcugccgaccagaagucuacucagaaugcgaucaacgggauuacaaauaaagugaacagcguuaucgagaagaugaauacccaguuuacggccgugggcaaagaguucaacaagcuggaacgaagaauggagaaccucaauaaaaaggucgaugacggauuccuugauauauggaccuauaacgcagaacuguuggugcuacuggagaaugaaaggacacucgacuuucacgauucaaacguaaagaaucuguacgagaaaguuaagagucaacuuaaaaacaaugcuaaggagauuggcaacgggugcuucgaauuuuaucauaaauguaauaacgagugcauggaauccgugaagaauggaacuuacgacuauccaaaguacagcgaggagucuaaacugaaccgggaaaagaucgacggugucaaauuggagucaaugggcguguaucagauccucgccauuuacaguaccgucgcuagcucccugguguuacugguuucucuaggggccaucucguucuggaugugcagcaauggaucccuccagugucguauuugcauauga

SEQ ID NO: 125180 - RNA, 1689 nt, Artificial Sequence
  derived and/or modified sequence opt3 from hemagglutinin__InfluenzaA__ACU79948
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcgacuauccuguggcaaaggggaguuacaacaauacauccggagagcagaugcuuaucauuugggguguccaccacccaaacgaugagaccgaacagaggacguuguaucagaaugugggcacuuacguaucuguugggaccagcacacugaacaagcgguccacucccgagaucgccacccgcccuaaagugaauggacaaggcgguagaauggaauuuucauggacacuacucgacaugugggauaccauaaacuucgagaguacggggaaccugauugcuccagaauacggauuuaagaucagcaaaagggggucuuccggcauuaugaagacugagggcacacuugagaauugcgaaaccaaaugucagacuccgcugggagcaaucaacacaaccuugcccuuccauaauguccacccucucacgaucggugagugcccaaaguaugugaaaucagaaaagcugguguuagccaccggccugcggaacgucccccagauugagagccgcgggcucuuuggagcuauagccggcuucaucgaagguggguggcagggcaugguugacggaugguacggcuaucaucacaguaaugaucaagggucuggauacgcggcagacaaggaguccacacagaaagccuuugacgguauuacuaacaaugugaacagcguaaucgagaagaugaauacccaguucgaagcugugggcaaagaguuuucgaaccuugaacgaagacuggagaauuugaacaagaaaauggaagauggguuccuagacgucuggacauauaaugccgagcugcucgugcugauggagaacgaaaggacucuugauuuccacgacucuaauguuaagaaccuguacgauaaggugcggaugcaguugcgugacaacgucaaagagcucggaaauggcuguuuugaguucuaucauaagugcgaugacgaguguaugaacuccgugaaaaaugguaccuacgauuacccuaaguaugaggaagagucaaaacugaaccgcaaugaaauaaaggggguaaaguuaaguagcaugggcguuuaccaaauucuggcaaucuaugcuacaguggccggaucccuaucucucgcgaucaugauggccggcauuagcuuuuggaugugcucaaacgggagucugcagugcagaaucuguauuuga

SEQ ID NO: 125181 - RNA, 1689 nt, Artificial Sequence
  derived and/or modified sequence opt3 from hemagglutinin__InfluenzaA__ACU79959
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcgacuauccuguggcaaaggggaguuacaacaauacauccggagagcagaugcuuaucauuugggguguccaccacccaaacgaugagaccgaacagaggacguuguaucagaaugugggcacuuacguaucuguugggaccagcacacugaacaagcgguccacucccgagaucgccacccgcccuaaagugaauggacaaggcgguagaauggaauuuucauggacacuacucgacaugugggauaccauaaacuucgagaguacggggaaccugauugcuccagaauacggauuuaagaucagcaaaagggggucuuccggcauuaugaagacugagggcacacuugagaauugcgaaaccaaaugucagacuccgcugggagcaaucaacacaaccuugcccuuccauaauguccacccucucacgaucggugagugcccaaaguaugugaaaucagaaaagcugguguuagccaccggccugcggaacgucccccagauugagagccgcgggcucuuuggagcuauagccggcuucaucgaagguggguggcagggcaugguugacggaugguacggcuaucaucacaguaaugaucaagggucuggauacgcggcagacaaggaguccacacagaaagccuuugacgguauuacuaacaaggugaauagcguaaucgagaaaaugaacacccaguucgaagcugugggcaaggaguuuucgaaucuugaacgaagacuggagaacuugaauaaaaagauggaagauggguuccuagacgucuggacauauaacgccgagcugcucgugcugauggagaaugaaaggacucuugauuuccacgacucuaacguuaagaaucuguacgauaaagugcggaugcaguugcgugacaacgucaaggagcucggaaacggcuguuuugaguucuaucauaaaugcgaugacgaguguaugaacuccgugaagaaugguaccuacgauuacccuaaauaugaggaagagucaaagcugaaucgcaacgaaauaaaggggguaaaauuaaguagcaugggcguuuaccaaauucuggcaaucuaugcuacaguggccggaucccuaucucucgcgaucaugauggccggcauuagcuuuuggaugugcucaaaugggagucugcagugcagaaucuguauuuga

SEQ ID NO: 125182 - RNA, 1701 nt, Artificial Sequence
  derived and/or modified sequence opt3 from hemagglutinin__InfluenzaA__ACU79970
augaagaccaucauugcccugagcuacauacagugccucguguucgcucaaaaauuucccggcaacgacaauuccacagcaacucuuugucuggggcaccaugccgucccuaacggaacgaucguuaagaccauuacaaaugaucagaucgaggugacuaacgcgaccgaauugguacagucuucaaguacaggugagauuugcgacagcccacaccagaucuuagauggcgaaaauuguacccugauagacgcucuacucggggauccgcaaugcgacggauuccagaacaaaaauugggaucuguuuguggagagauccaaggccuauucuaacuguuaccccuaugacgucccugauuacgcaucgcuuaggucacugguggccagcaguggcacuuuggaguucaauaacgaauccuuuaauuggacagguguuacccagaacgggacgucuagcgcuugcauccggcgcuccaauaacucauucuuuaguaaacucaauuggcugacucauagcaaguucaaguauccagcacugaacgugaccaugcccaacaaugagaacuuugacaaacucuacauuuggggaguccaccauccuggcacagauaaugaccagaucuucuuauaugcccaagcuagcggccgaauuacuguguccaccaagcguucacagcagacaguaaucccaaacauagggagcagacccaggguucggaauauuccuagucgcaucucuauuuacuggaccaucgugaaaccaggagauauccugcuuauuaacuccacggguaauuugauagccccgagaggcuacuuuaagaucaggagcgggaaaucgucuauuaugcgguccgacgcgcccaucggaaaguguaacucagaaugcauaacuccuaauggcaguauuccaaacgacaagcccuuccagaaugucaaccgcaucacauauggugcauguccucgauacgugaaacaaaauacccugaagcuagccacugggaugagaaacgugccagagaaacagacaaggggaaucuuuggcgcuauugccggcuucaucgaaaaugggugggagggaauggucgaugguugguauggcuuccggcaccagaacagcgaggggauuggacaagcagcugaccucaaguccacccaggccgcgauagaucagaucaacggcaaacugaaucgucuuauugguaagacgaacgaaaaauuucaccagaucgagaaggaguucucugaaguugaagggcgcauccaagaccuggagaaguacguggaggauaccaaaauugacuuguggagcuauaaugccgaacuccugguagcauuagagaaccagcauacaauagaucugacugacucagaaaugaauaagcucuuugagaaaaccaagaaacagcuuagagaaaacgcugaggauaugggcaauggaugcuucaagaucuaccacaagugugacaacgccugcauuggcaguaucaggaaugggacauaugaucaugacguguaccgggacgaggcucugaacaaucgauuucagauuaaaggagucgaauugaaguccgguuacaaagauuggauccuauggauaucuuucgccaucucuugcuuucugcucuguauugcacugcuuggcuucaucaugugggccugccaaaaggggaacauucgcuguaauaucugcauauga

SEQ ID NO: 125183 - RNA, 1698 nt, Artificial Sequence
  derived and/or modified sequence opt3 from hemagglutinin__InfluenzaA__ACU79981
augaaggugaaacugcucguccuucugugcaccuucacagccacuuacgcugacacgaucuguauuggcuaucacgcaaacaauagcaccgauacaguugacacuguguuggagagaaacguaaccgugacacauuccgucaauuuacuggaaaacucucacaaugggaagcuaugccuccugaaaggaauagcgccccuucagcuggguaacuguucaguggccggcuggaucuuggggaauccugagugcgaacuccugauuaguaaggagagcugguccuacaucguugaaaaaccaaacccggagaauggaaccuguuaucccggccauuuugcugauuacgaggaacugagggagcaacucucuucggugagcucauucgaacgguuugagauuuucccuaaggagaguuccuggccaaaccacacugucacaggugugucugccagcugcucccauaauggggaaucaaguuuuuaucgcaacuuacuguggcuuaccggaaagaauggcuuguaccccaaccugagcaaaucuuaugcaaauaacaaggagaaagaaguucuaguacucuggggcgugcaccacccuccaaacaucggggaccagaaggcccuguaccauacggagaaugcuuacgucuccguggugucaagccacuauagucgaaaauucacucccgaaauagcaaagcguccuaaggucagagaucaggagggaaggaucaacuacuauuggacccuucugaaaccaggugacacaauuaucuuugaggccaauggcaacuugauugcuccgcgguacgccuucgcgcucucucgcggguuuggauccggcaucauaaauagcaacgcacccauggauaagugugacgccaaaugccagacuccucaaggugcuauuaauucgucucugccauuccagaacguucaucccgugaccaucggggaauguccuaaguauguaagauccgccaaauuaaggauggugacaggacugcggaauauuccaucaauccagagucgcggccucuuuggcgcaaucgcuggguucauugagggagguuggaccggcauggucgaugggugguacggauaucaccaccagaacgaacaaggcagcgguuacgccgcggaccagaaguccacgcagaaugccauaaacgggaucacuaauaaagugaacucuguuauugagaagaugaauacacaguuuaccgcagugggcaaggaguucaacaaacuugaacgaagaauggagaaccugaauaagaaagucgaugacggauucaucgauauauggacuuacaacgcugaauugcuagugcugcucgagaaugaaaggacacuggacuuucaugacagcaacguaaagaaucuuuaugagaaaguuaagucacaacugaagaacaaugccaaagaaauuggcaacgggugcuucgaguuuuaccacaaguguaaugaugagugcauggaaagugugaaaaacggaaccuaugacuaccccaaguauuccgaggaaagcaaauugaaucgggagaagaucgauggugucaagcucgagucuaugggcguguaccagauccuggcuauuuauucaacggucgccaguagcuuagugcugcuaguuucccucggggcaaucucuuucuggaugugcucgaacggaagccugcagugucguauuugcauauga

SEQ ID NO: 125184 - RNA, 1698 nt, Artificial Sequence
  derived and/or modified sequence opt3 from hemagglutinin__InfluenzaA__ACU79992
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaaaagcgccccuucagcuggguaacuguucuguggccggcuggauauuggggaauccugagugcggacuccugaucucaaaggaaaguuggagcuacauuguugagagaccaaacccggaaaauggcaccuguuaucccggucauuuugcugacuacgaggagcugagggaacaacucuccucugugucgucauucgagcgguuugaaaucuucccuaaggagagcaguuggccaaaccacacugucacagggguguccgccucuugcagccauaauggagaguccucauuuuauaaaaacuuacuguggcuuaccggcaagaauggcuuguaccccaaccugaguaaaagcuaugcaaauaacaaggaaaaagagguucuaguacucuggggagugcaccacccuccaaacauuggggaucagaugacgcuguaccauaaggaaaaugccuacgucucugugguguccucacacuauagccgcaaguucacucccgagaucgcuaaacgaccuaagguccgugaccaggaagguagaauaaacuacuauuggacccuucuggagccaggcgauacaaucauuuuugaggcaaaugggaacuugaucgccccgagguacgcuuucgcccucagucggggauuuggcucugguauuaucaauuccaacgcgcccauggacgaaugugaugcaaaaugccagacuccucaaggggccauaaauagcucgcugccauuccagaacguucaucccgugaccauuggagaguguccuaaguauguacgcucugcuaaauuaagaauggugacaggccugaggaauaucccauccauucagucacggggccucuuuggggccaucgcaggauucaucgaagguggcuggaccgggauggucgacggaugguacggcuaucaccaccagaacgagcaagguaguggguacgcugccgaucaaaagagcacgcagaaugcgauuaacggcauaacuaauaaagugaacuccguuaucgaaaagaugaauacacaguuuaccgccgugggaaaggaguucaacaaacuugagcgccgaauggaaaaccugaauaagaaagucgacgauggcuucauugacguguggacuuacaacgcagaguugcuaguacugcucgaaaaugagagaacacuggacuuucaugauucuaacguuaagaaucuuuaugaaaaagugaagaaccagcugaagaauaacgcuaaagagaucgggaauggaugcuucgaguuuuaccacaaguguaacgacgaaugcauggagagcgucaaaaaugguaccuaugauuaccccaaguauucagaagagaguaaauuguccagggagaagauagacggcgugaagcucgaaagcaugggggucuaccagauucuggccaucuauucuacgguggcuucaaguuuaguucugcuagugagccucggagccaucuccuucuggaugugcucuaacggcucgcugcagugucggauuugcaucuga

SEQ ID NO: 125185 - RNA, 1701 nt, Artificial Sequence; identical to SEQ ID NO: 124450
  derived and/or modified sequence opt3 from hemagglutinin__InfluenzaA__ACU80003

SEQ ID NO: 125186 - RNA, 1698 nt, Artificial Sequence
  derived and/or modified sequence opt3 from hemagglutinin__InfluenzaA__ACU80025
augaaggugaaacugcucguccuucugugcaccuucgccgcuacauacgcagacacuaucuguauuggcuaucacgccaacaauagcacggauaccguugacacaguguuggagaagaacguaacugugacccauuccgucaauuuacuggaaaacucucacaaugggaaacuaugccuccugaagggaauagcgccccuucagcuggguaacuguucaguggcuggcuggaucuuggggaauccugagugcgaacuccugauuaguaaagagagcugguccuacaucguugaaaagccaaacccggagaauggaacauguuaucccggccauuuugccgauuacgaggaacugagagagcaacucucuucggugagcucauucgaaagguuugagauuuucccuaaggagaguuccuggccaaaccacaccgucacuggugugucugcaagcugcucccauaauggggaaucaaguuuuuaucggaacuuacuguggcuuacaggcaaaaauggauuguaccccaaccugagcaagucuuaugccaauaacaaagagaaggaaguucuaguacucuggggcgugcaccacccuccaaacaucggggaccagaaagcucuguaccauaccgagaaugcauacgucuccguggugucaagccacuauagucgcaaguucacgcccgaaauagccaagcgaccuaaaguccgugaucaggagggaagaaucaacuacuauuggacucuucuggagccaggugacaccauuaucuuugaagcuaauggcaacuugauugccccgagguacgcguucgcacucucucggggguuuggauccggcaucauaaauagcaacgcccccauggauaagugugacgcuaaaugccagacaccucaaggugccauuaauucgucucugccauuccagaacguucaucccgugacuaucggggaguguccuaaguauguacgcuccgcaaaauuaagaauggugaccggacugaggaauauuccaucaauccagagucggggccucuuuggcgcuaucgccggguucauugaaggagguuggacaggcauggucgaugggugguacggauaucaccaccagaacgagcaaggcagcgguuacgcggccgaccagaaguccacccagaaugcaauaaacgggaucacgaauaaagugaacucuguuauugaaaagaugaauacucaguuuacagcugugggcaaggaguucaacaaacuugagcgccgaauggaaaaccugaauaagaaagucgaugacggauucaucgauauauggaccuacaacgccgaguugcuagugcugcucgaaaaugagagaacucuggacuuucaugacagcaacguaaagaaucuuuaugaaaaaguuaagucacaacugaagaacaaugcuaaagagauuggcaacgggugcuucgaguuuuaccacaaguguaaugaugaaugcauggagagugugaaaaacggaacauaugacuaccccaaguauuccgaagagagcaaauugaauagggagaagaucgauggugucaagcucgaaucuaugggcguguaccagauccuggccauuuauucaaccgucgcaaguagcuuagugcugcuaguuucccucggggccaucucuuucuggaugugcucgaacggaagccugcagugucggauuugcauauga

SEQ ID NO: 125187 - RNA, 1701 nt, Artificial Sequence
  derived and/or modified sequence opt3 from hemagglutinin__InfluenzaA__ACU80036
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguuccucagaaugcauaacuccuaacggcaguauuccaaaugacaagcccuuucagaacgucaaucgaaucacauauggugcauguccuagauacgugaaacaaaacacccugaaacuugccacugggaugaggaaugugccagagaagcagacacggggaaucuucggcgcuauugccggcuuuaucgaaaacgggugggagggaauggucgaugguugguauggcuuccgucaccagaauagcgaggggcgcggacaagcagcugaccugaaguccacccaggccgcgauugaucagauaaacggcaaauugaauagacucaucgguaagacgaacgaaaaauuccaccagauugagaaggaauuuucugagguugaagggaggauccaagaccuggagaaguacguggaggauaccaaaaucgacuuauggagcuauaacgccgaacugcucguagcacuugagaaucagcauacaauugaucugacugacucagaaaugaacaaguuguucgagaaaaccaagaaacagcuacgggaaaaugcugaggauauaggcaacggaugcuuuaagaucuaccacaagugugacaaugccugcauuggcaguauccgaaacgggacauaugaucaugacguguaccgcgacgaggcucugaauaacagauuccagauuaaaggagucgaacucaaguccgguuacaaagauuggauccuguggaucagcuuugccauaucuugcuuccuucuguguguggcauugcucggcuuuauuaugugggccugccaaaaggggaauaucagguguaacauuugcaucuga

SEQ ID NO: 125188 - RNA, 1698 nt, Artificial Sequence; identical to SEQ ID NO: 124659
  derived and/or modified sequence opt3 from hemagglutinin__InfluenzaA__ACU80047

SEQ ID NO: 125189 - RNA, 1701 nt, Artificial Sequence
  derived and/or modified sequence opt3 from hemagglutinin__InfluenzaA__ACU80058
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuguucuaauugcuaucccuacgacgucccugauuaugcaucguugaggucacucguggccagcagugguacucuggaguuuaacaaugaauccuucaacuggacagggguuacccagaauggaacgucuagcgcuuguaagcggcgcuccaacaauucauuuuucagucgacugaacuggcucacucauuuaaaguuuaaauacccagcacugaaugugaccaugcccaacaacgagaaguucgacaaacuuuauaucuggggcguccaccauccuggcacagauaaugaccagaucuuuuuguacgcccaggcuagcgggcguauuacugugucuaccaagagaucccaacagacaguaauuccaaacaucggaucaaggccccggguucgcaauauaccuagcagaauuaguaucuauuggaccauugugaaaccaggugauauccugcuaaucaacucuacgggcaaucucauugccccgaggggguacuucaagauacgguccggaaagagcucgaucaugcgcucugacgcgcccauuggcaaaugcaacuccgaguguaucacuccuaaugguucaauaccaaacgacaagcccuuucagaaugucaaccgaauuacauacggggcaugcccuagauaugugaaacagaauacccugaagcuggccacuggaaugaggaacgugccagaaaaacaaacacggggcaucuucggcgcuaucgccggguuuauugagaauggaugggaagguauggucgauggcugguacggguuccgucaccagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguauguggaggacaccaaaaucgauuuauggucuuacaacgccgagcugcucguagcacuugaaaaucaacauacaauugaccugacugauagcgagaugaacaaguuguucgaaaggaccaaaaagcagcuacgggagaaugcugaagacaugggaaacggcuguuuuaagauauaucacaaaugcgauaaugccugcaucgggucaauucgaaacggaacauacgaccaugauguguaucgcgacgaggcucugaauaacagauuccagaucaagggugucgagcucaaaaguggcuacaaggacuggauucuguggaucuccuuugccauaagcuguuuccuucugugcguggcauugcucggguuuaucaugugggccugucagaaaggaaauauuaggugcaacaucuguauuuga

SEQ ID NO: 125190 - RNA, 1698 nt, Artificial Sequence; identical to SEQ ID NO: 124504
  derived and/or modified sequence opt3 from hemagglutinin__InfluenzaA__ACU80069

SEQ ID NO: 125191 - RNA, 1698 nt, Artificial Sequence
  derived and/or modified sequence opt3 from hemagglutinin__InfluenzaA__ACU80080
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccucaaggcgccauuaauucgucucugccauuccagaacgugcaccccguaacaaucggugaguguccuaaguaugugagauccgcuaaauuaaggauggucaccgggcugcggaauauuccaucaauccagagucgcggacucuuuggcgccaucgcaggcuucauugaagggggauggacggguaugguggauggcugguacggguaucaucaccagaacgagcaaggaagcggcuacgcugccgaccagaaguccacucagaaugcgauaaacgguaucacaaauaaaguuaacucugugauugaaaagaugaauacccaguuuacugccgucgggaaggaguucaacaaacuugagcgaagaauggaaaaccugaauaagaaaguggaugacggcuucaucgauauauggacauacaacgcagaguugcuaguacugcucgaaaaugagaggacccuggacuuucacgacagcaacguuaagaaucuuuaugaaaaagugaagucacaacugaagaacaaugcuaaagagauuggaaacggcugcuucgaguuuuaccauaaguguaaugaugaaugcauggagagugucaaaaacgggacguaugacuaccccaaguauuccgaagagagcaaauugaaucgggagaagaucgauggaaucaagcucgaaucuauggguguguaccagauucuggccaucuauucaaccgucgcuaguagcuuagugcugcuaguuucccucggcgccauuucuuucuggaugugcucgaacgggagccugcagugucguauaugcaucuga

SEQ ID NO: 125192 - RNA, 1698 nt, Artificial Sequence; identical to SEQ ID NO: 124790
  derived and/or modified sequence opt3 from hemagglutinin__InfluenzaA__ACU80091

SEQ ID NO: 125193 - RNA, 1701 nt, Artificial Sequence; identical to SEQ ID NO: 124553
  derived and/or modified sequence opt3 from hemagglutinin__InfluenzaA__ACU80102

SEQ ID NO: 125194 - RNA, 1701 nt, Artificial Sequence
  derived and/or modified sequence opt3 from hemagglutinin__InfluenzaA__ACU80113
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauccggcgcuccaauaacucauucuuuagucgacugaauuggcugacucauagcaaauucaaguauccagcacucaacgugaccaugcccaacaaugagaacuuugacaaguuauacauuuggggaguccaccauccuggcacagauaaugaccagaucuuccuguaugcccaggcuucuggccguauuacuguguccaccaaaagaucacaacagacaguaaucccaaacauagggagcaggccccggguucgcaauauuccuaguagaaucucuauuuacuggaccaucgugaagccaggagauauccuuuugauuaacuccacggguaaucugauagccccgaggggcuacuuuaaaauccggagcgggaagucgucuauuaugcgcuccgacgcgcccaucggaaaauguaacucagaaugcauaacuccuaauggcaguauuccaaacgacaagcccuuccagaaugucaaccgaaucacauauggugcauguccuagauacgugaagcagaauacccuaaaacucgccacugggaugaggaacgugccagagaagcaaacacggggaaucuuuggcgcuauugccggcuucaucgaaaaugggugggagggaauggucgaugguugguauggcuuccgucaccagaacagcgaggggauuggacaggcagcugaccugaaauccacccaagccgcgauagaucagaucaacggcaaacuuaaucgccugauugguaagacgaacgaaaaguuucaccagaucgagaaagaguucucugaaaucgaagggaggauucaggacuuggagaaguacguugaggauaccaagauagaccucuggagcuauaaugccgaacuguuaguggcacuggagaaccaacauacaaucgaucucacugacucagaaaugaauaaacuuuuugagaagaccaaaaagcagcugagagaaaacgcugaggauaugggcaauggaugcuucaaaauuuaccacaagugugacaacgccugcaucggcaguauucggaaugggacauaugaucaugacguauaccgagacgaggcuuugaacaaucgcuuucagaucaagggaguggaacuaaaauccgguuacaagaacuggauacuguggaucagcuucgccauuucuugcuuucuccuguguaucgcacuucugggcuucauuaugugggccugccagaaagggaauaucagauguaacauaugcauuuga

SEQ ID NO: 125195 - RNA, 1701 nt, Artificial Sequence
  derived and/or modified sequence opt3 from hemagglutinin__InfluenzaA__ACU80135
augaagaccaucauugcccugagcuacauacucugccuuguguucgcucagaaauuucccggcaacgacaauuccacagcaacucuguguuuggggcaccaugccgucccuaacggaacgaugguuaagaccaucacaaaugaucaaauugaggugacuaacgcgaccgaauuaguacagucuucaaguacaggugagaucugcgacagcccacaccagauucuggauggcgaaaauuguacccuaaucgacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauacggcgcuccaauaacucauucuuuagucgacugaauuggcugacucauagcaaauucaaguauccagcacucaacgugaccaugcccaacaaugagaacuuugacaaguuauacaucuggggaguccaccauccuggcacagauaaugaccagauuuuccuguaugcccaggcuucuggccguaucacuguguccaccaaaagaucacaacagacaguaauuccaaacaucgggagcaggccccggguucgcaauauaccuaguagaauuucuaucuacuggaccauugugaagccaggagauauccuuuugaucaacuccacggguaaucugauugccccgaggggcuacuuuaaaauacggagcgggaagucgucuaucaugcgcuccgacgcgcccauuggaaaauguaacucagaaugcaucacuccuaauggcaguauaccaaacgacaagcccuuccagaaugucaaccgaauuacauauggugcauguccuagauacgugaagcagaauacccuaaaacucgccacugggaugaggaacgugccagagaagcaaacacggggaaucuuuggcgcuaucgccggcuucauugaaaaugggugggagggaauggucgaugguugguauggcuuccgucaccagaacagcgaggggaucggacaggcagcugaccugaaauccacccaagccgcgauugaucagauaaacggcaaacuuaaucgccugaucgguaagacgaacgaaaaguuucaccagauugagaaagaguucucugaaguugaagggagaauccaggacuuggagaaguacguggaggauaccaagaucgaccucuggagcuauaaugccgaacuguuaguagcacuggagaaccaacauacaauugaucucacugacucagaaaugaauaaacuuuuugagaagaccaaaaagcagcugagggaaaacgcugaggauaugggcaauggaugcuucaaaauauaccacaagugugacaacgccugcaucggcaguauucggaaugggacauaugaucaugacguguaccgagacgaggcuuugaacaaucgcuuucagaucaagggagucgaacuaaaauccgguuacaaggauuggauucuguggaucagcuucgccauaucuugcuuucuccuguguaucgcacuucugggcuucauuaugugggccugccagaaagggaacaucagauguaauauuugcaucuga

SEQ ID NO: 125196 - RNA, 1701 nt, Artificial Sequence
  derived and/or modified sequence opt3 from hemagglutinin__InfluenzaA__ACU80146
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauagcaaguuuaaguauccagcauuaaaugugaccaugcccaacaacgaggaguucgacaaacuguacauuuggggaguccaccauccuggcacagauaaugaccagaucuuucuuuaugcccaggcuucuggccguauuacuguguccaccaagagaucacaacagacaguaaucccaaacauagggagcaggccccggguucgcaauauuccuaguagaaucucuauuuacuggaccaucgugaaaccaggagauaucuugcugauuaacuccacggguaaucuaauagccccgaggggcuacuucaagauccggagcgggaaaucgucuauuaugcgcuccgacgcgcccaucggaaaguguaacucagaaugcauaacuccuaauggcaguauuccaaacgacaagcccuuucagaaugucaaccgaaucacauauggugcauguccuagauacgugaaacagaauacccucaagcuggccacugggaugaggaacgugccagaaaaacaaacacggggaaucuucggcgcuauugccggcuuuaucgagaaugggugggagggaauggucgaugguugguauggcuuccgucaccagaacagcgaagggauuggacaggcagcugaccuuaaguccacccaagccgcgauagaucagaucaauggcaaacugaaccgcuugauugguaagacgaacgagaaauuccaccagaucgaaaaggaguuuucugaaguugaggggagaauccaggaccucgagaaguacguggaagauaccaaaauugaccuguggagcuauaaugccgaguuacugguagcacucgaaaaccaacauacaauagaucuuacugacucagagaugaauaagcuguucgagaaaaccaagaaacaguugagggaaaacgcugaggauaugggcaauggaugcuuuaagaucuaccacaagugugacaacgccugcauuggcaguauccggaaugggacauaugaucaugacguguaccgagacgaagcucuaaacaaucgcuuccagauuaaaggagucgagcugaaguccgguuacaaagauuggauccucuggaucagcuuugccauaucuugcuuccugcuuuguguggcacuguugggccucauuaugugggccugccagaaggggaacaucagauguaauauuugcaucuga

SEQ ID NO: 125197 - RNA, 1701 nt, Artificial Sequence; identical to SEQ ID NO: 124450
  derived and/or modified sequence opt3 from hemagglutinin__InfluenzaA__ACU80157

SEQ ID NO: 125198 - RNA, 1698 nt, Artificial Sequence; identical to SEQ ID NO: 125186
  derived and/or modified sequence opt3 from hemagglutinin__InfluenzaA__ACU80168

SEQ ID NO: 125199 - RNA, 1701 nt, Artificial Sequence; identical to SEQ ID NO: 124450
  derived and/or modified sequence opt3 from hemagglutinin__InfluenzaA__ACU80179

SEQ ID NO: 125200 - RNA, 1701 nt, Artificial Sequence
  derived and/or modified sequence opt3 from hemagglutinin__InfluenzaA__ACU80190
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauagcaaguuuaaguauccagcauuaaaugugaccaugcccaacaacgaggaguucgacaaacuguacauuuggggaguccaccauccuggcacagauaaugaccagaucuuucuuuaugcccaggcuucuggccguauuacuguguccaccaagagaucacaacagacaguaaucccaaacauagggagcaggccccggguucgcaauauuccuaguagaaucucuauuuacuggaccaucgugaaaccaggagauaucuugcugauuaacuccacggguaaucuaauagccccgaggggcuacuucaagauccggagcgggaaaucgucuauuaugcgcuccgacgcgcccaucggaaaguguaacucagaaugcauaacuccuaauggcaguauuccaaacgacaagcccuuucagaaugucaaccgaaucacauauggugcauguccuagauacgugaaacagaauacccucaagcuggccacugggaugaggaacgugccagaaaaacaaacacggggaaucuucggcgcuauugccggcuuuaucgagaaugggugggagggaauggucgaugguugguauggcuuccgucaccagaacagcgaagggauuggacaggcagcugaccuuaaguccacccaagccgcgauagaucagaucaauggcaaacugaaccgcuugauugguaagacgaacgagaaauuccaccagaucgaaaaggaguuuucugaaguugaggggagaauccaggaccucgagaaguacguggaagauaccaaaauugaccuguggagcuauaaugccgaguuacugguagcacucgaaaaccaacauacaauagaucuuacugacucagagaugaauaagcuguucgagaaaaccaagaaacaguugagggaaaacgcugaggauaugggcaauggaugcuuuaagaucuaccacaagugugacaacgccugcauuggcaguauccggaaugggacauaugaucaugacguguaccgagacgaagcucuaaacaaucgcuuccagauuaaaggaaucgagcugaaguccgguuacaaagauuggauacucuggaucagcuuugccauuucuugcuuccugcuuugugucgcacuguugggcuuuaucaugugggccugccagaaggggaacauuagauguaauaucugcauauga

SEQ ID NO: 125201 - RNA, 1701 nt, Artificial Sequence
  derived and/or modified sequence opt3 from hemagglutinin__InfluenzaA__ACU80201
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucaugacguguaccgcgacgaggcucugaacaauagauuccagaucaaaggagucgaacucaagagugguuacaaagauuggauucuguggaucuccuuugccauaagcugcuuccuucuguguguggcauugcucggcuuuaucaugugggccugccaaaaggggaacauuaaauguaauaucugcauuuga

SEQ ID NO: 125202 - RNA, 1701 nt, Artificial Sequence; identical to SEQ ID NO: 124450
  derived and/or modified sequence opt3 from hemagglutinin__InfluenzaA__ACU80212

SEQ ID NO: 125203 - RNA, 1698 nt, Artificial Sequence
  derived and/or modified sequence opt3 from hemagglutinin__InfluenzaA__ACU80234
augaaggugaaacugcucguccuucugugcaccuucgccgcuacauacgcagacacuaucuguauuggcuaucacgccaacaauagcacggauaccguugacacaguguuggagaagaacguaacugugacccauuccgucaauuuacuggaaaacucucacaaugggaaacuaugccuccugaagggaauagcgccccuucagcuggguaacuguucaguggcuggcuggaucuuggggaauccugagugcgaacuccugauuaguaaagagagcugguccuacaucguugaaaagccaaacccggagaauggaacauguuaucccggccauuuugccgauuacgaggaacugagagagcaacucucuucggugagcucauucgaaagguuugagauuuucccuaaggagaguuccuggccaaaccacaccgucacuggugugucugcaagcugcucccauaauggggaaucaaguuuuuauaaaaacuuacuguggcuuacaggaaagaauggcuuguaccccaaccugagcaaaucuuaugccaauaacaaggagaaagaaguucuaguacucuggggcgugcaccacccuccaaacaucggggaccagaaggcucuguaccauaccgagaaugcauacgucuccguggugucaagccacuauagucggaaguucacgcccgaaauagccaaacgcccuaagguccgagaucaggagggacguaucaacuacuauuggacucuucuggagccaggugacaccauuaucuuugaagcuaauggcaacuugauugccccgagauacgcguucgcacucucuaggggguuuggauccggcaucauaaauagcaacgcccccauggauaaaugugacgcuaagugccagacaccucaaggugccauuaauucgucucugccauuccagaacguucaucccgugacuaucggggaguguccuaaauauguacgguccgcaaaguuacgcauggugaccggacugagaaauauuccaucaauccagaguaggggccucuuuggcgcuaucgccggguucauugaaggagguuggacaggcauggucgaugggugguacggauaucaccaccagaacgagcaaggcagcgguuacgcggccgaccagaaauccacccagaaugcaauaaacgggaucacgaauaaggugaacucuguuauugaaaagaugaauacucaguuuacagcugugggcaaagaguucaacaaacuugagcggcgcauggaaaaccugaauaaaaaggucgaugacggauucaucgauauauggaccuacaacgccgaguugcuagugcugcucgaaaaugagcgaacucuggacuuucaugacagcaacguaaagaaucuuuaugaaaagguuaagucacaacugaaaaacaaugcuaaggagauuggcaacgggugcuucgaguuuuaccacaaauguaaugaugaaugcauggagagugugaagaacggaacauaugacuaccccaaauauuccgaagagagcaaguugaauagagagaagaucgauggugucaaacucgaaucuaugggcguguaccagauccuggccauuuauucaaccgucgcaaguagcuuagugcugcuaguuucccucggggccaucucuuucuggaugugcucgaacggaagccugcaguguaggauuugcauauga

SEQ ID NO: 125204 - RNA, 1701 nt, Artificial Sequence
  derived and/or modified sequence opt3 from hemagglutinin__InfluenzaA__ACU80245
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauccggcgcuccaauaacucauucuuuagucgacugaauuggcugacucauagcaaauucaaguauccagcacucaacgugaccaugcccaacaaugagaacuuugacaaguuauacauuuggggaguccaccauccuggcacagauaaugaccagaucuuccuguaugcccaggcuucuggccguauuacuguguccaccaaaagaucacaacagacaguaaucccaaacauagggagcaggccccggguucgcaauauuccuaguagaaucucuauuuacuggaccaucgugaagccaggagauauccuuuugauuaacuccacggguaaucugauagccccgaggggcuacuuuaaaauccggagcgggaagucgucuauuaugcgcuccgacgcgcccaucggacgauguaacucagaaugcauaacuccuaauggcaguauuccaaacgacaaacccuuccagaaugucaacagaaucacauauggugcauguccuagguacgugaagcagaauacccuaaagcucgccacugggaugcggaacgugccagagaaacaaacacguggaaucuuuggcgcuauugccggcuucaucgaaaaugggugggagggaauggucgaugguugguauggcuuccgccaccagaacagcgaggggauuggacaggcagcugaccugaaguccacccaagccgcgauagaucagaucaacggcaaacuuaauagacugauugguaagacgaacgaaaaauuucaccagaucgagaaggaguucucugaaguugaagggaggauccaggacuuggagaaauacguggaggauaccaagauugaccucuggagcuauaaugccgaacuguuaguagcacuggagaaccaacauacaauagaucucacugacucagaaaugaauaaacuuuuugagaagaccaagaaacagcugcgggaaaacgcugaggauaugggcaauggaugcuucaagaucuaccacaaaugugacaacgccugcauuggcaguauccgaaaugggacauaugaucaugacguguaccgcgacgaggcuuugaacaauagauuucagauuaagggagucgaacuaaaguccgguuacaaagauuggauccuguggaucagcuucgccauaucuugcuuucuccuguguauugcacuucugggcuucaucaugugggccugccagaaggggaacauuagguguaauaucugcauauga

SEQ ID NO: 125205 - RNA, 1701 nt, Artificial Sequence; identical to SEQ ID NO: 124553
  derived and/or modified sequence opt3 from hemagglutinin__InfluenzaA__ACU80256

SEQ ID NO: 125206 - RNA, 1698 nt, Artificial Sequence; identical to SEQ ID NO: 124504
  derived and/or modified sequence opt3 from hemagglutinin__InfluenzaA__ACU80267

SEQ ID NO: 125207 - RNA, 1698 nt, Artificial Sequence; identical to SEQ ID NO: 125186
  derived and/or modified sequence opt3 from hemagglutinin__InfluenzaA__ACU80278

SEQ ID NO: 125208 - RNA, 1701 nt, Artificial Sequence; identical to SEQ ID NO: 124450
  derived and/or modified sequence opt3 from hemagglutinin__InfluenzaA__ACU80289

SEQ ID NO: 125209 - RNA, 1701 nt, Artificial Sequence; identical to SEQ ID NO: 124553
  derived and/or modified sequence opt3 from hemagglutinin__InfluenzaA__ACU80300

SEQ ID NO: 125210 - RNA, 1701 nt, Artificial Sequence
  derived and/or modified sequence opt3 from hemagglutinin__InfluenzaA__ACU80311
augagaaccaucauugcccugagcuacauacucugccuuguguucgcucagaaguuucccggcaacgacaauuccacagcaacucuguguuuggggcaccaugccgucccuaacggaacgaucguuaaaaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaagaauugggaucuuuuuguggagagguccaaagccuauucuaacuguuaccccuaugacgucccugauuacgcaucgcugcggucauugguggccagcaguggcacucucgaguucaauaacgaauccuuuaauuggacagguguuacccagaacgggacgucuagcgcuugcauccgccgauccaauaacucauucuuuagucgucugaauuggcugacucauagcaaguucaaauauccagcacucaacgugaccaugcccaacaaugagaacuuugacaaguuauacauuuggggaguccaccauccuggcacagauaaugaccagaucuuccuguaugcccaggcuucuggcagaauuacuguguccaccaagaggucacaacagacaguaaucccaaacauagggagccggccccgcguuagaaauauuccuaguaggaucucuauuuacuggaccaucgugaaaccaggagauauccuuuugauuaacuccacggguaaucugauagccccgcggggcuacuuuaagauccgcagcgggaaaucgucuauuaugcgauccgacgcgcccaucggaaaguguaacucagaaugcauaacuccuaauggcaguauuccaaacgacaaacccuuccagaaugucaacagaaucacauauggugcauguccuagguacgugaagcagaauacccuaaagcucgccacugggaugcggaacgugccagagaaacaaacacguggaaucuuuggcgcuauugccggcuucaucgaaaaugggugggagggaauggucgaugguugguauggcuuccgccaccagaacagcgaggggauuggacaggcagcugaccugaaguccacccaagccgcgauagaucagaucaacggcaaacuuaauagacugauugguaagacgaacgaaaaauuucaccagaucgagaaggaguucucugaaguugaagggaggauccaggacuuggagaaauacguggaggauaccaagauugaccucuggagcuauaaugccgaacuguuaguagcacuggagaaccaacauacaauagaucucacugacucagaaaugaauaaacuuuuugagaagaccaagaaacagcugcgggaaaacgcugaggauaugggcaauggaugcuucaagaucuaccacaaaugugacaacgccugcauuggcaguauccgaaaugggacauaugaucaugacguguaccgcgacgaggcuuugaacaauagauuucagauuaagggagucgaacuaaaguccgguuacaaagauuggauccuguggaucagcuucgccauaucuugcuuucuccuguguauugcacuucugggcuucaucaugugggccugccagaaggggaacauuagguguaauaucugcauauga

SEQ ID NO: 125211 - RNA, 1701 nt, Artificial Sequence; identical to SEQ ID NO: 124553
  derived and/or modified sequence opt3 from hemagglutinin__InfluenzaA__ACU80322

SEQ ID NO: 125212 - RNA, 1701 nt, Artificial Sequence; identical to SEQ ID NO: 124450
  derived and/or modified sequence opt3 from hemagglutinin__InfluenzaA__ACU80333

SEQ ID NO: 125213 - RNA, 1701 nt, Artificial Sequence; identical to SEQ ID NO: 124553
  derived and/or modified sequence opt3 from hemagglutinin__InfluenzaA__ACU80344

SEQ ID NO: 125214 - RNA, 1701 nt, Artificial Sequence; identical to SEQ ID NO: 124553
  derived and/or modified sequence opt3 from hemagglutinin__InfluenzaA__ACU80355

SEQ ID NO: 125215 - RNA, 1701 nt, Artificial Sequence; identical to SEQ ID NO: 124553
  derived and/or modified sequence opt3 from hemagglutinin__InfluenzaA__ACU80366

SEQ ID NO: 125216 - RNA, 1701 nt, Artificial Sequence
  derived and/or modified sequence opt3 from hemagglutinin__InfluenzaA__ACU80377
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauccggcgcuccaauaacucauucuuuagucgacugaauuggcugacucauagcaaauucaaguauccagcacucaacgugaccaugcccaacaaugagaacuuugacaaguuauacauuuggggaguccaccauccuggcacagauaaugaccagaucuuccuguaugcccaggcuucuggccguauuacuguguccaccaaaagaucacaacagacaguaaucccaaacauagggagcaggccccggguucgcaauauuccuaguagaaucucuauuuacuggaccaucgugaagccaggagauauccuuuugauuaacuccacggguaaucugauagccccgaggggcuacuuuaaaauccggagcgggaagucgucuauuaugcgcuccgacgcgcccaucggaaaauguaacuucgaaugcauaacuccuaauggcucaauuccaaacgacaagcccuuucagaaugucaaccgaaucacauauggugcauguccuagauacgugaagcagaauacccuaaaacucgccacugggaugaggaacgugccagagaagcaaacacggggaaucuucggcgcuauugccggcuucaucgaaaaugggugggagggaauggucgaugguugguauggcuuucgucaccagaacagugaggggauuggacaggcagcugaccugaaaagcacccaagccgcgauagaucagaucaacggcaaacuuaaucgccugauugguaagacgaacgaaaaguuccaccagaucgagaaagaauuuuccgagguugaagggagaauccaggacuuggagaaguacguggaggauaccaagauugaccucuggucuuauaaugccgaacuguuaguagcacuggagaaccaacauacaauagaucucacugacagcgaaaugaauaaacuuuucgagaagaccaggaaacagcugcgggaaaacgcugaggauaugggcaauggaugcuuuaagaucuaccacaaaugugacaacgccugcauuggcucaauccgaaaugggacauaugaucaugacguguaccgcgacgaggcuuugaacaauagauuccagauuaagggagucgaacuaaagagugguuacaaagauuggauccuguggauauccuuugccaugagcugcuuccuccuguguaucgcacuucugggcuuuauuaugugggccugccagaaggggaacaucagguguaauauuugcaucuga

SEQ ID NO: 125217 - RNA, 1701 nt, Artificial Sequence; identical to SEQ ID NO: 124553
  derived and/or modified sequence opt3 from hemagglutinin__InfluenzaA__ACU80388

SEQ ID NO: 125218 - RNA, 1701 nt, Artificial Sequence; identical to SEQ ID NO: 124450
  derived and/or modified sequence opt3 from hemagglutinin__InfluenzaA__ACU80399

SEQ ID NO: 125219 - RNA, 1698 nt, Artificial Sequence
  derived and/or modified sequence opt3 from hemagglutinin__InfluenzaA__ACU80410
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaccaccagaacgagcaaggcagcgguuacgccgcggaccagaaguccacgcagaaugccauaaacgggaucacuaauaaagugaacucuguuauugaaaagaugaauacacaguuuaccgcagugggcaaggaguucaacaaacuugagcgccgaauggaaaaccugaauaagaaagucgaugacggauucaucgauauauggacuuacaacgcugaguugcuagugcugcucgaaaaugagagaacacuggacuuucaugacagcaacguaaagaaucuuuaugaaaaaguuaagaaccaacugaagaauaacgccaaagagauuggcaaugggugcuucgaguuuuaccacaaguguaacgaugaaugcauggagucagugaaaaauggaaccuaugacuaccccaaguauagugaagaguccaaauugaacagggagaagaucgauggugucaagcucgaaagcaugggcguguaccagauccuggcuauuuauucuacggucgccucaaguuuagugcugcuaguuagccucggggcaaucuccuucuggaugugcucuaauggaucgcugcagugucggauuugcauauga

SEQ ID NO: 125220 - RNA, 1701 nt, Artificial Sequence
  derived and/or modified sequence opt3 from hemagglutinin__InfluenzaA__ACU80424
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauccggcgcuccaauaacucauucuuuagucgacugaauuggcugacucauagcaaauucaaguauccagcacucaacgugaccaugcccaacaaugagaacuuugacaaguuauacauuuggggaguccaccauccuggcacagauaaugaccagaucuuccuguaugcccaggcuucuggccguauuacuguguccaccaaaagaucacaacagacaguaaucccaaacauagggagcaggccccggguucgcaauauuccuaguagaaucucuauuuacuggaccaucgugaagccaggagauauccuuuugauuaacuccacggguaaucugauagccccgaggggcuacuuuaaaauccggagcgggaagucgucuauuaugcgcuccgacgcgcccaucggaaaauguaacuucgaaugcauaacuccuaauggcucaauuccaaacgacaagcccuuucagaaugucaaccgaaucacauauggugcauguccuagauacgugaagcagaauacccuaaaacucgccacugggaugaggaacgugccagagaagcaaacacggggaaucuucggcgcuauugccggcuucaucgaaaaugggugggagggaauggucgaugguugguauggcuuucgucaccagaacagugaggggauuggacaggcagcugaccugaaaagcacccaagccgcgauagaucagaucaacggcaaacuuaaucgccugauugguaagacgaacgaaaaguuccaccagaucgagaaagaauuuuccgagguugaagggagaauccaggacuuggagaaguacguggaggauaccaagauugaccucuggucuuauaaugccgaacuguuaguagcacuggagaaccaacauacaauagaucucacugacagcgaaaugaauaaacuuuucgagaagaccaggaaacagcugcgggaaaacgcugaggauaugggcaauggaugcuuuaagaucuaccacaaaugugacaacgccugcauuggcucaauccgaaaugggacauaugaucaugacguguaccgcgacgaggcuuugaacaauagauuccagauuaagggagucgaacuaaagagugguuacaaagauuggauccuguggauauccuuugccaucagcugcuuccuccuguguauugcacuucugggcuuuaucaugugggccugccagaaggggaacauuagguguaauaucugcauauga

SEQ ID NO: 125221 - RNA, 1701 nt, Artificial Sequence; identical to SEQ ID NO: 125220
  derived and/or modified sequence opt3 from hemagglutinin__InfluenzaA__ACU80435

SEQ ID NO: 125222 - RNA, 1698 nt, Artificial Sequence
  derived and/or modified sequence opt3 from hemagglutinin__InfluenzaA__ACU80446
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaaacgcuguaccauacugagaaugccuacgucuccguggugucaagccacuauagucgcaaguucacccccgaaauagcuaagcgaccuaaaguccgugaucaggagggaagaaucaacuacuauuggacacuucuggagccaggugacacuauuaucuuugaagcaaauggcaacuugauugccccgagguacgcuuucgcccucucucggggguuuggauccggcaucauaaauagcaacgcgcccauggauaagugugacgcaaaaugccagaccccucaaggugccauuaauucgucucugccauuccagaacguucaucccgugacaaucggggaguguccuaaguauguacgcuccgcuaaauuaagaauggugaccggacugaggaauauuccaucaauccagagucggggccucuuuggcgccaucgcaggguucauugaaggagguuggacgggcauggucgaugggugguacggauaucaccaccagaacgagcaaggcagcgguuacgcugccgaccagaaguccacucagaaugcgauaaacgggaucacaaauaaagugaacucuguuauugaaaagaugaauacccaguuuacugccgugggcaaggaguucaacaaacuugagcgccgaauggaaaaccugaauaagaaagucgaugacggauucaucgauauauggacauacaacgcagaguugcuagugcugcucgaaaaugagagaacccuggacuuucaugacagcaacguaaagaaucuuuaugaaaaaguuaagucacaacugaagaacaaugcuaaagagauuggcaacgggugcuucgaguuuuaccacaaguguaaugaugaaugcauggagagugugaaaaacggaacguaugacuaccccaaguauuccgaagagagcaaauugaauagggagaagaucgauggugucaagcucgaaucuauggagguguaccagauccuggccauuuauucaaccgucgcuaguagcuuagugcugcuaguuucccucggcgccaucucuuucuggaugugcucgaacgggagccugcagugucggauuugcauauga

SEQ ID NO: 125223 - RNA, 1701 nt, Artificial Sequence; identical to SEQ ID NO: 124450
  derived and/or modified sequence opt3 from hemagglutinin__InfluenzaA__ACU80458

SEQ ID NO: 125224 - RNA, 1701 nt, Artificial Sequence; identical to SEQ ID NO: 124450
  derived and/or modified sequence opt3 from hemagglutinin__InfluenzaA__ACU80470

SEQ ID NO: 125225 - RNA, 1701 nt, Artificial Sequence; identical to SEQ ID NO: 124553
  derived and/or modified sequence opt3 from hemagglutinin__InfluenzaA__ACU80600

SEQ ID NO: 125226 - RNA, 1701 nt, Artificial Sequence; identical to SEQ ID NO: 125220
  derived and/or modified sequence opt3 from hemagglutinin__InfluenzaA__ACU80611

SEQ ID NO: 125227 - RNA, 1701 nt, Artificial Sequence; identical to SEQ ID NO: 124553
  derived and/or modified sequence opt3 from hemagglutinin__InfluenzaA__ACU80622

SEQ ID NO: 125228 - RNA, 1701 nt, Artificial Sequence; identical to SEQ ID NO: 124450
  derived and/or modified sequence opt3 from hemagglutinin__InfluenzaA__ACU80633

SEQ ID NO: 125229 - RNA, 1701 nt, Artificial Sequence
  derived and/or modified sequence opt3 from hemagglutinin__InfluenzaA__ACU80644
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauagcaaguuuaaguauccagcauuaaaugugaccaugcccaacaacgaggaguucgacaaacuguacauuuggggaguccaccauccuggcacagauaaugaccagaucuuucuuuaugcccaggcuucuggccguauuacuguguccaccaagagaucacaacagacaguaaucccaaacauagggagcaggccccggguucgcaauauuccuaguagaaucucuauuuacuggaccaucgugaaaccaggagauaucuugcugauuaacuccacggguaaucuaauagccccgaggggcuacuucaagauccggagcgggaaaucgucuauuaugcgcuccgacgcgcccaucggaaaguguaacucagaaugcauaacuccuaauggcaguauuccaaacgacaagcccuuucagaaugucaaccgaaucacauauggugcauguccuagauacgugaaacagaauacccucaagcuggccacugggaugaggaacgugccagaaaaacaaacacggggaaucuucggcgcuauugccggcuuuaucgagaaugggugggagggaauggucgaugguugguauggcuuccgucaccagaacagcgaagggauuggacaggcagcugaccuuaaguccacccaagccgcgauagaucagaucaauggcaaacugaaccgcuugauugguaagacgaacgagaaauuccaccagaucgaaaaggaguuuucugaaguugaggggagaauccaggaccucgagaaguacguggaagauaccaaaauugaccuguggagcuauaaugccgaguuacugguagcacucgaaaaccaacauacaauagaucuuacugacucagagaugaauaagcuguucgagaaaaccaagaaacaguugagggaaaacgcugaggauaugggcaauggaugcuuuaagaucuaccacaagugugacaacgccugcauuggcaguauccggaaugggacauaugaucaugacguguaccgagacgaagcucuaaacaaucgcuuccagauuaaaggagucgagcugaaguccgguuacaaagauuggauccucuggaucagcuuugccauaucuugcuuccugcuuuguguggcacuguugggcuuuauuaugugggccugccagaaggggaacaucagauguaauauuugcaucuga

SEQ ID NO: 125230 - RNA, 1701 nt, Artificial Sequence; identical to SEQ ID NO: 124450
  derived and/or modified sequence opt3 from hemagglutinin__InfluenzaA__ACU80655

SEQ ID NO: 125231 - RNA, 1701 nt, Artificial Sequence; identical to SEQ ID NO: 124450
  derived and/or modified sequence opt3 from hemagglutinin__InfluenzaA__ACU80666

SEQ ID NO: 125232 - RNA, 1701 nt, Artificial Sequence; identical to SEQ ID NO: 123944
  derived and/or modified sequence opt3 from hemagglutinin__InfluenzaA__ACU80677

SEQ ID NO: 125233 - RNA, 1701 nt, Artificial Sequence; identical to SEQ ID NO: 124450
  derived and/or modified sequence opt3 from hemagglutinin__InfluenzaA__ACU80688

SEQ ID NO: 125234 - RNA, 1701 nt, Artificial Sequence; identical to SEQ ID NO: 124553
  derived and/or modified sequence opt3 from hemagglutinin__InfluenzaA__ACU80699

SEQ ID NO: 125235 - RNA, 1701 nt, Artificial Sequence; identical to SEQ ID NO: 124553
  derived and/or modified sequence opt3 from hemagglutinin__InfluenzaA__ACU80710

SEQ ID NO: 125236 - RNA, 1701 nt, Artificial Sequence
  derived and/or modified sequence opt3 from hemagglutinin__InfluenzaA__ACU80721
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaacugaggugaccaacgcgacagaacugguacagucuucaaguaccggugagaucugcgacagcccacaccagauucuagauggcgaaaauuguacucucaucgacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacacuggaauuuaacaaugaguccuucaacuggaccgguguuacgcagaaugggacuucuagcgcuugcauacggcgcuccaacaauucauuuuucagucgacugaacuggcucacccauuuaaaguuuaaguauccagcacugaaugugacaaugcccaacaacgagcaguucgacaaacuuuacaucuggggaguccaccauccuggcacugauaaugaccagaucuuuuuguaugcccaagcuagcggccguauuaccgugucuacaaagagaucccagcagaccguaauuccaaacaucgggucaaggccccggguucgcaauauaccuagcagaauuaguaucuacuggacgauugugaaaccaggagauauccugcuaaucaacucuacugguaaucucauugccccgaggggcuacuucaagauacgguccgggaaaagcucgaucaugcgcucugacgcgcccauuggaaaguguaacuccgaaugcaucacaccuaauggcucaauaccaaacgacaagcccuuucagaaugucaaccgaauuaccuauggugcauguccuagauacgugaaacaaaauacucugaagcuggccacagggaugaggaacgugccagagaaacagacccggggaaucuucggcgcuaucgccggcuuuauugaaaaugggugggagggaauggucgaugguugguauggcuuccgucaccagaacagugaggggcgcggacaagcagcugaccuuaagagcacgcaggccgcgaucgaucagauuaauggcaaauugaacagacucauagguaagaccaacgaaaaauuccaccagaucgagaaggaauuuuccgagguugaagggaggauucaagaccuggagaaguacguggaggauacaaaaaucgacuuauggucuuauaaugccgaacugcucguagcacuugagaaccagcauacuaucgaucugaccgacagcgaaaugaauaaguuguucgagaaaacaaagaaacagcuacgggaaaacgcugaggauaugggcaauggaugcuuuaagauuuaccacaagugugacaacgccugcauaggcucaauccgaaaugggacuuaugaucaugacguguaccgcgacgaggcucugaacaauagauuccagauuaaaggagucgaacucaagagugguuacaaagauuggauccuguggauuuccuuugccaucagcugcuuccuucuguguguggcauugcucggcuuuauaaugugggccugccaaaaggggaacaucagguguaauauuugcaucuga

SEQ ID NO: 125237 - RNA, 1701 nt, Artificial Sequence; identical to SEQ ID NO: 124450
  derived and/or modified sequence opt3 from hemagglutinin__InfluenzaA__ACU80732

SEQ ID NO: 125238 - RNA, 1701 nt, Artificial Sequence; identical to SEQ ID NO: 124450
  derived and/or modified sequence opt3 from hemagglutinin__InfluenzaA__ACU80743

SEQ ID NO: 125239 - RNA, 1701 nt, Artificial Sequence
  derived and/or modified sequence opt3 from hemagglutinin__InfluenzaA__ACU80754
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucaugacguguaccgcgacgaggcucugaacaauagauuccagaucaaaggagucgaacucaagagugguuacaaagauuggauucuguggaucuccuuugccauaagcugcuuccuucugugugugguuuugcucggcuuuaucaugugggcaugccaaaaggggaacauuagguguaauaucugcauuuga

SEQ ID NO: 125240 - RNA, 1701 nt, Artificial Sequence
  derived and/or modified sequence opt3 from hemagglutinin__InfluenzaA__ACU80765
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauagcaaguuuaaguauccagcauuaaaugugaccaugcccaacaacgaggaguucgacaaacuguacauuuggggaguccaccauccuggcacagauaaugaccagaucuuucuuuaugcccaggcuucuggccguauuacuguguccaccaagagaucacaacagacaguaaucccaaacauagggagcaggccccggguucgcaauauuccuaguagaaucucuauuuacuggaccaucgugaaaccaggagauaucuugcugauuaacuccacggguaaucuaauagccccgaggggcuacuucaagauccggagcgggaaaucgucuauuaugcgcuccgacgcgcccaucggaaaguguaacucagaaugcauaacuccuaauggcaguauuccaaacgacaagcccuuucagaaugucaaccgaaucacauauggugcauguccuagauacgugaaacagaauacccucaagcuggccacugggaugaggaacgugccagaaaaacaaacacggggaaucuucggcgcuauugccggcuuuaucgagaaugggugggagggaauggucgaugguugguauggcuuccgucaccagaacagcgaagggauuggacaggcagcugaccuuaaguccacccaagccgcgauagaucagaucaauggcaaacugaaccgcuugauugguaagacgaacgagaaauuccaccagaucgaaaaggaguuuucugaaguugaggggagaauccaggaccucgagaaguacguggaagauaccaaaauugaccuguggagcuauaaugccgaguuacugguagcacucgaaaaccaacauacaauagaucuuacugacucagagaugaauaagcuguucgagaaaaccaagaaacaguugagggaaaacgcugaggauaugggcaauggaugcuuuaagaucuaccacaagugugacaacgccugcauuggcaguauccggaaugggacauaugaucaugacguguaccgagacgaagcucuaaacaaucgcuuccagauuaaaggagucgagcugaaguccgguuacaaagauuggauccucuggaucagcuuugccauaucuugcuuccugcuuuguauugcacuguugggcuuuaucaugugggccugccagaaggggaacauuagauguaauaucugcauauga

SEQ ID NO: 125241 - RNA, 1701 nt, Artificial Sequence
  derived and/or modified sequence opt3 from hemagglutinin__InfluenzaA__ACU80787
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaaugauggaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgaggucgaagggaggauccaagaccuggagaaguacguugaggauaccaaaaucgacuuauggucuuauaaugccgaacugcucguggcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucaugacguauaccgcgacgaggcucugaacaauagauuccagaucaaaggaguggaacucaagagugguuacaaagauuggauucuguggaucuccuuugccauaagcugcuuccuucugugugucgcauugcucggcuuuaucaugugggccugccaaaaggggaacauuagguguaauaucugcauuuga

SEQ ID NO: 125242 - RNA, 1701 nt, Artificial Sequence; identical to SEQ ID NO: 124450
  derived and/or modified sequence opt3 from hemagglutinin__InfluenzaA__ACU80798

SEQ ID NO: 125243 - RNA, 1701 nt, Artificial Sequence; identical to SEQ ID NO: 124450
  derived and/or modified sequence opt3 from hemagglutinin__InfluenzaA__ACU81103

SEQ ID NO: 125244 - RNA, 1701 nt, Artificial Sequence
  derived and/or modified sequence opt3 from hemagglutinin__InfluenzaA__ACU87270
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugauagagagggaaggaugaauuacuauuggacccugauugaacccggugacaagaucacauucgaggccacuggcaaccuaguggucccucgguacgcuuuugccauggaacgcaacgcagggagcggaauaauuaucucggauaccccaguucaugacugcaauacaaccugucagacgccgaaaggcgcuauuaacacuucucuccccuuccaaaauauccacccuaucacaauugguaagugcccaaaguaugugaaauccaccaagcugagacuugccacugggcugaggaacguacccucaauacagagucggggauuguuuggcgcgaucgccggcuucauugaagggggauggacagguaugguggacggcugguacggguaucaucaccagaaugaacagggaagcggcuacgcagcugaucucaaauccacccaaaacgccaucgacgagauaacgaauaaggucaacucugugauugagaaaaugaauacccaguuuacagcuguugguaaggaguucaaccaccuggaaaagcgcaucgaaaauuuaaacaaaaagguggaugacggguuccuggauaucuggacuuacaaugccgagcuccuuguccuguuggaaaacgagcgaacccuagacuaucaugauagcaaugugaaaaaccuguacgagaagguaagaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagggaggagaucgacggggugaaacuugaaagcacccggauuuaucagauacuggcuaucuacucuacagucgcgucaaguuuggugcucgucgugagccugggagcaauuuccuuuuggaugugcucuaacgguucguuacaaugccguaucuguaucuga

SEQ ID NO: 125245 - RNA, 1701 nt, Artificial Sequence; identical to SEQ ID NO: 124685
  derived and/or modified sequence opt3 from hemagglutinin__InfluenzaA__ACV04228

SEQ ID NO: 125246 - RNA, 1701 nt, Artificial Sequence; identical to SEQ ID NO: 124685
  derived and/or modified sequence opt3 from hemagglutinin__InfluenzaA__ACV04238

SEQ ID NO: 125247 - RNA, 1701 nt, Artificial Sequence
  derived and/or modified sequence opt3 from hemagglutinin__InfluenzaA__ACV04248
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaaggguaucaccgccgcuuguccucaugcaggggccaagaguuuuuauaaaaaucugauauggcucgucaagaaaggaaacagcuacccaaaguuaucuaaauccuauaucaaugacaagggcaaggaggugcugguacuuuggggcauucaccaccccucaacgagcgcugaucaacagaguuuguaccagaacgccgacgcguacguuuucguggggucuucccgcuauagcaaaaaguuuaaaccugagaucgcaauucgaccaaagguccgugaucaggaaggaagaaugaauuacuauuggacucugguggagcccggugacaaaaucaccuucgaagccacaggcaaccuaguggucccuagguacgcuuuugccauggagcggaacgcagggucgggaauaauuaucucugauacuccaguucaugacugcaauaccacaugucaaaccccgaagggcgcuauuaacacgucccuccccuuccacaauauccauccuaucacuauugguaaaugcccaaaguaugugaagucaacaaaacugcgccuugccaccgggcugagaaacguacccaguauacagagcaggggauuguuuggcgcgaucgccggcuucauugaagggggauggacugguaugguggacggcugguacggguaucaccaccagaaugagcagggauccggcuacgcagcugaucucaagucuacacaaaacgccaucgacgagauaaccaauaaagucaacagcgugauugaaaagaugaauacgcaguuuaccgcuguugguaaagaguucaaccaucuggaaaagcggaucgagaauuuaaacaagaaaguggaugacggguuccuggauaucuggacauacaaugccgaacuccuuguccuguuggagaacgagcgcacucuagacuaucacgauucaaaugugaagaaccuguacgaaaaaguacgaagucagcucaagaacaaugcaaaagagauuggcaacggauguuuugaguucuaucauaagugcgacaauaccuguauggaauccguuaagaacggcacauacgauuauccuaaauacagcgaagaggccaagcugaauagagaggaaaucgacggggugaaacuugagucuacuaggauuuaucagauacuggcuaucuacucaaccgucgcgaguagcuuggugcucgucgugucccugggagcaauuucuuuuuggaugugcucgaacgguagcuuacaaugccggaucuguaucuga

SEQ ID NO: 125248 - RNA, 1701 nt, Artificial Sequence; identical to SEQ ID NO: 124685
  derived and/or modified sequence opt3 from hemagglutinin__InfluenzaA__ACV04258

SEQ ID NO: 125249 - RNA, 1701 nt, Artificial Sequence; identical to SEQ ID NO: 124685
  derived and/or modified sequence opt3 from hemagglutinin__InfluenzaA__ACV04268

SEQ ID NO: 125250 - RNA, 1701 nt, Artificial Sequence; identical to SEQ ID NO: 124685
  derived and/or modified sequence opt3 from hemagglutinin__InfluenzaA__ACV04278

SEQ ID NO: 125251 - RNA, 1701 nt, Artificial Sequence; identical to SEQ ID NO: 124685
  derived and/or modified sequence opt3 from hemagglutinin__InfluenzaA__ACV04288

SEQ ID NO: 125252 - RNA, 1701 nt, Artificial Sequence
  derived and/or modified sequence opt3 from hemagglutinin__InfluenzaA__ACV04298
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuguaacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 125253 - RNA, 1701 nt, Artificial Sequence; identical to SEQ ID NO: 124685
  derived and/or modified sequence opt3 from hemagglutinin__InfluenzaA__ACV04308

SEQ ID NO: 125254 - RNA, 1701 nt, Artificial Sequence
  derived and/or modified sequence opt3 from hemagglutinin__InfluenzaA__ACV04318
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcauaauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 125255 - RNA, 1701 nt, Artificial Sequence; identical to SEQ ID NO: 124685
  derived and/or modified sequence opt3 from hemagglutinin__InfluenzaA__ACV04328

SEQ ID NO: 125256 - RNA, 1701 nt, Artificial Sequence; identical to SEQ ID NO: 124685
  derived and/or modified sequence opt3 from hemagglutinin__InfluenzaA__ACV04338

SEQ ID NO: 125257 - RNA, 1701 nt, Artificial Sequence; identical to SEQ ID NO: 124927
  derived and/or modified sequence opt3 from hemagglutinin__InfluenzaA__ACV04358

SEQ ID NO: 125258 - RNA, 1701 nt, Artificial Sequence
  derived and/or modified sequence opt3 from hemagglutinin__InfluenzaA__ACV04368
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuaugucagcucagaggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcaacugagcaguguguccucuuucgaacgguuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucagcagaguuuguaccagaacgccgacgcguacguguucgucgggacuucucgcuauuccaaaaaguuuaaaccugagauugcaauccgaccaaaggugcgugaucaagagggaagaaugaauuacuauuggacccugguggaacccggugacaaaauuacauucgaggccacuggcaaccuagucguuccuagguacgcuuuugccauggaacggaacgcagggagcggaaucauaauuucggauaccccagugcaugacugcaauacaaccugucagacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccaaaaugaacagggaagcggcuacgcagcugaucucaaguccacccagaacgccauugacgagaucacgaauaaagugaacucuguuauagagaagaugaauacccaguuuacagcuguggguaaagaguucaaccaccuggaaaagcggauugaaaauuuaaacaagaaagucgaugacggguuccuggauaucuggacuuacaaugccgagcuccuugugcuguuggaaaacgagcgcacccuagacuaucaugauagcaauguaaagaaccuguacgagaaaguucgaucacaacucaagaacaaugcaaaagaaaucggcaacggauguuuugaguucuaucacaagugcgacaauacauguauggaaagugugaagaacggcacuuacgauuauccuaaauacuccgaggaagccaagcugaauagagaggagauugacggggucaaacuugaaagcaccaggaucuaucagauucuggcuauauacucuacaguggcgucaaguuugguccucgugguuagccugggagcaaucuccuuuuggaugugcucuaacgguucguuacagugccggauuuguaucuga

SEQ ID NO: 125259 - RNA, 1701 nt, Artificial Sequence
  derived and/or modified sequence opt3 from hemagglutinin__InfluenzaA__ACV04378
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucauugucagccugggagcaaucuccuuuuggaugugcucuaacgguucguuacagugccggaucuguauuuga

SEQ ID NO: 125260 - RNA, 1701 nt, Artificial Sequence; identical to SEQ ID NO: 124927
  derived and/or modified sequence opt3 from hemagglutinin__InfluenzaA__ACV04388

SEQ ID NO: 125261 - RNA, 1701 nt, Artificial Sequence; identical to SEQ ID NO: 124685
  derived and/or modified sequence opt3 from hemagglutinin__InfluenzaA__ACV04398

SEQ ID NO: 125262 - RNA, 1701 nt, Artificial Sequence; identical to SEQ ID NO: 124929
  derived and/or modified sequence opt3 from hemagglutinin__InfluenzaA__ACV04408

SEQ ID NO: 125263 - RNA, 1701 nt, Artificial Sequence; identical to SEQ ID NO: 124685
  derived and/or modified sequence opt3 from hemagglutinin__InfluenzaA__ACV04489

SEQ ID NO: 125264 - RNA, 1701 nt, Artificial Sequence; identical to SEQ ID NO: 124685
  derived and/or modified sequence opt3 from hemagglutinin__InfluenzaA__ACV04499

SEQ ID NO: 125265 - RNA, 1701 nt, Artificial Sequence; identical to SEQ ID NO: 124865
  derived and/or modified sequence opt3 from hemagglutinin__InfluenzaA__ACV04509

SEQ ID NO: 125266 - RNA, 1701 nt, Artificial Sequence; identical to SEQ ID NO: 124685
  derived and/or modified sequence opt3 from hemagglutinin__InfluenzaA__ACV04519

SEQ ID NO: 125267 - RNA, 1701 nt, Artificial Sequence; identical to SEQ ID NO: 124685
  derived and/or modified sequence opt3 from hemagglutinin__InfluenzaA__ACV04529

SEQ ID NO: 125268 - RNA, 1701 nt, Artificial Sequence; identical to SEQ ID NO: 124685
  derived and/or modified sequence opt3 from hemagglutinin__InfluenzaA__ACV04549

SEQ ID NO: 125269 - RNA, 1701 nt, Artificial Sequence; identical to SEQ ID NO: 124685
  derived and/or modified sequence opt3 from hemagglutinin__InfluenzaA__ACV04559

SEQ ID NO: 125270 - RNA, 1701 nt, Artificial Sequence; identical to SEQ ID NO: 124685
  derived and/or modified sequence opt3 from hemagglutinin__InfluenzaA__ACV04579

SEQ ID NO: 125271 - RNA, 1701 nt, Artificial Sequence
  derived and/or modified sequence opt3 from hemagglutinin__InfluenzaA__ACV04751
auggaggccauccugguggucaugcucuacaccuucgcuacagcaaacgccgacacucuuugcauuggcuaucacgcgaauaacagcacggauaccguugacacagugcuggaaaagaauguaacugugacccauuccgucaacuuguuagaggauaaacacaaugggaagcuguguaaacuaagaggaguggcuccccucaggcuggguaagugcaacauagccggcuggauccuugggaauccugaaugugagucucugucaacagcaaguagcugguccuacauuguugaaaccucuucgucagacaacggaacuugcuauccaggcgauuuuaucgacuacgaggaguugcgggaacagcucagcaguguguccucuuucgagcgcuuugaaauuuucccgaaaacaagcuccuggcccaaucaugauucaaacaagggugucaccgccgcuuguccucacgcaggggccaagaguuuuuauaaaaaucugaucuggcuggugaagaaaggaaacagcuacccaaagcucucuaaauccuauauaaaugacaagggcaaggagguauuaguucuguggggcauccaucaccccucaacgagcgcugaucaacagagucuuuaccagaacgccgacgcguacguguucgucgggacuucucgauauuccaaaaaguuuaaaccugagauugcaauccguccaaaggugagagaucaggaaggaaggaugaauuacuauuggaccuugguggagcccggugacaaaauuacauucgaagccacuggcaaccuggucguuccucgguacgcuuuugccauggagcgcaacgcagggagcggaaucauaauuucggauaccccagugcacaauugcaacacaaccugucaaacgccgaagggcgcuaucaauacuucucuacccuuccagaacauucauccuaucacaaucgguaaaugcccaaaguauguaaaguccaccaaacucagacuggccacugggcuuaggaaugugcccucaauucagagucggggacuguuuggcgcgauagccggcuucaucgaagggggauggacagguauggucgacggcugguacggguaucaccaucagaacgagcaaggaagcggcuacgcagcugacuugaaguccacccagaaugccauugaugagaucacgaacaaaguuaauucugugauagaaaagaugaacacccaguuuacagcuguggguaaagaguucaaucaccucgaaaagcgcauugagaaccugaauaagaaagucgacgauggguucuuagacaucuggacuuacaacgccgaacugcucgugcuucuggagaaugagcgaaccuuggauuaucacgacagcaacguaaagaaccuauacgaaaaaguuagaucacagcugaagaauaacacaaaagagaucggcaauggauguuuugaguucuaucauaagugcgauaacacuuguauggaaagugugaagaauggcaccuacgacuauccuaaauacuccgaagaggcaaagcucaacagggaggaaauugauggggucaaacuggagagcacacggaucuaucaaauucuugccauauacucuaccguggcuucaagucuggucuuggugguuagccucggagcgaucuccuuuuggaugugcucuaaugguucgcugcagugccguauuuguaucuga

SEQ ID NO: 125272 - RNA, 1701 nt, Artificial Sequence
  derived and/or modified sequence opt3 from hemagglutinin__InfluenzaA__ACV04752
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacauauuagaggauaaacacaaugggaagcuguguaaacuaagaggaguggcuccccuccaucuggguaagugcaacaucgccggcuggauucuugaaaauccugagugugaaucucugucaacagcaaguagcugguccuacaucguugagaccucuucgucagacaacgggacuugcuauccaggagauuuuauugacuacgaggaauugagggagcagcucagcaguguguccucuuucgaacgguuugagaucuucccgaaaacaagcuccuggcccaaucacgauucaaacaagggcgucaccgccgcuuguccucaugcaggcgccaagaguuuuuauaaaaaucugauauggcuggugaagaaagggaacagcuacccaaagcucucuaaauccuauaucaaugacaagggaaaggagguauuaguucuguggggcauucaccaccccucaacgagcgcugaucaacagagucuuuaccagaacgccgacgcguacguguucgucgguucuucccgcuauagcaaaaaguuuaaaccugaaaucgcaauucgaccaaaggugcgugaucaggaggggagaaugaauuacuauuggacuuugguggaacccggagacaaaaucaccuucgaggccacagguaaccuggucguuccuagguacgcuuuugccauggaacggaacgcaggcucggggauaauuaucucugauacuccagugcaugacugcaauaccacaugucaaaccccgaagggagcuauuaacacgucccuacccuuccacaauauccauccuaucacuauuggcaaaugcccaaaguauguaaagucaacaaaacuccgccuggccaccggucuuagaaacgugcccaguauacagagcagggggcuguuuggagcgaucgccggcuucauugagggcggguggacuggaauggucgacgguugguacggcuaucaccaccagaaugagcagggguccggauacgcagcugauuugaagucuacacaaaacgccaucgacgaaauaaccaauaaagugaacagcguuauugagaagaugaauacgcaguuuaccgcugugggcaaagaguucaaccaucucgaaaagcggaucgaaaaucugaacaagaaagucgaugacgguuucuuagauaucuggacauacaaugccgagcugcucgugcuucuggagaacgaacgcacuuuggacuaucacgauucaaauguaaagaaccuauacgagaaaguucgaagucagcugaagaacaaugcaaaagaaauugggaacggcuguuuugaguucuaucauaagugcgacaauaccuguauggaauccgugaagaacggaacauacgauuauccuaaauacagcgaggaggccaagcucaauagagaagagaucgacggcgucaaacuggaaucuacuaggauuuaucagauacuugcuaucuacucaaccguggcgaguagccuggucuuggugguuucccucggggcaauuucuuuuuggaugugcucgaacggaagccugcaaugccggaucuguaucuga

SEQ ID NO: 125273 - RNA, 1701 nt, Artificial Sequence
  derived and/or modified sequence opt3 from hemagglutinin__InfluenzaA__ACV04753
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugauagagaaggaaggaugaauuacuauuggacccugguggagcccggugacaaaauuacauucgaagccacuggcaaccuagucguuccucgguacgcuuuugccauggagcgcaacgcagggagcggaaucauaauuucggauaccccagugcaugacugcaauacaaccugucagacgccgaagggcgcuaucaacacuucucuccccuuccaaaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugagcagggaagcggcuacgcagcugaucucaaguccacccaaaacgccauugacgagaucacgaauaaagugaacucuguuauagaaaagaugaauacccaguuuacagcuguggguaaagaguucaaccaccuggaaaagcgcauugagaauuuaaacaagaaagucgaugacggguuccuggauaucuggacuuacaaugccgaacuccuugugcuguuggagaacgagcgaacccuagacuaucaugauagcaauguaaagaaccuguacgaaaaaguuagaucacagcucaagaacaaugcaaaagagaucggcaacggauguuuugaguucuaucacaagugcgacaauacauguauggaaagugugaagaacggcacuuacgauuauccuaaauacuccgaagaggccaagcugaauagggaggaaauugacggggucaaacuugagagcacccggaucuaucagauucuggcuauauacucuacaguggcgucaaguuugguccucgugguuagccugggagcaaucuccuuuuggaugugcucuaacgguucguuacaaugccguauuuguaucuga

SEQ ID NO: 125274 - RNA, 1701 nt, Artificial Sequence
  derived and/or modified sequence opt3 from hemagglutinin__InfluenzaA__ACV04754
auggaggccauccuggugguccuccuuuacaccuucgcuacagcaaacgccgacacucugugcauuggcuaucacgcgaauaacagcacggauaccguugacacaguguuggaaaagaauguacccgugacucauuccgucaacuuacugaaagauaagcacaaugggaaacuauguaagcucagaggaguggcuccucugcaucuugguaaaugcaacauagccggcuggauccuggggaauccagagugugaaucuuugucaaccgcaaguagcugguccuacauuguugagacaucuucgucagacaacggaaccugcuauccgggcgauuuuaucgacuacgaagaacucagggagcagcugagcaguguguccucuuucgaacgguuugagauuuuccccaagacuagcuccuggccuaaucacgaaucaaacaagggugucacagccgcuuguccacaugcaggggccaaaaguuuuuauaagaaucugaucuggcucgugaaaaagggaaacagcuaccccaaauuaucuaaguccuauauaaaugauaagggcaaagagguacugguucuuuggggcauccaccacccuucaaccagcgcugaccaacagaguuuguaccagaacgccgaugcguacguguucgucgggacgucucgcuauuccaagaaauuuaagccagagauugcaauccgacccaaagugcgugaccaggaaggaagaaugaauuacuauuggacucugguggagccuggugauaagauuaccuucgaagccacaggcaaccuagucguuccaagguacgcuuuugccauggagcggaacgcagggagcggaaucauaauuucggacacuccggugcaugauugcaauaccacaugucaaacccccaaaggcgcuaucaacacgucucucccuuuccagaauauucacccaaucacuaucgguaagugccccaaguauguaaaauccacaaagcugcgccuugccaccgggcugagaaacgugccuucaauucagaguaggggagucuuuggcgcgauagccggcuucaucgaagggggauggacugguaugguggacggcugguacggguaucaucaccagaaugagcaaggaagcggcuacgcagcugacuugaaauccacacagaacgccauugaugagaucaccaauaagguuaacucugugauagagaaaaugaauacgcaguuuaccgcugucgguaaggaguucaaccaccucgaaaagcggauugagaaucugaacaaaaagguggacgauggguucuuagacaucuggacauacaaugccgaacugcucguacuucuggagaacgagcgcacuuuggauuaucaugacagcaauguuaaaaaccuauacgaaaaggugcgaucacagcugaaaaacaaugcaaaggagaucggcaacggauguuuugaguucuaucacaagugcgauaauaccuguauggaaagugucaaaaacggcacauacgacuauccaaaguacuccgaagaggccaaacucaauagagaggaaauugauggggugaagcuggagagcacuaggaucuaucaaauucuugcuauauacucuaccgucgcgucaagucugguguugguugugagccucggagcaaucuccuuuuggaugugcucuaacgguucgcugcagugccggauuuguaucuga

SEQ ID NO: 125275 - RNA, 1701 nt, Artificial Sequence; identical to SEQ ID NO: 125170
  derived and/or modified sequence opt3 from hemagglutinin__InfluenzaA__ACV04755

SEQ ID NO: 125276 - RNA, 1701 nt, Artificial Sequence; identical to SEQ ID NO: 124865
  derived and/or modified sequence opt3 from hemagglutinin__InfluenzaA__ACV33084

SEQ ID NO: 125277 - RNA, 1701 nt, Artificial Sequence; identical to SEQ ID NO: 124685
  derived and/or modified sequence opt3 from hemagglutinin__InfluenzaA__ACV33094

SEQ ID NO: 125278 - RNA, 1701 nt, Artificial Sequence; identical to SEQ ID NO: 124685
  derived and/or modified sequence opt3 from hemagglutinin__InfluenzaA__ACV33104

SEQ ID NO: 125279 - RNA, 1701 nt, Artificial Sequence; identical to SEQ ID NO: 124685
  derived and/or modified sequence opt3 from hemagglutinin__InfluenzaA__ACV33114

SEQ ID NO: 125280 - RNA, 1701 nt, Artificial Sequence; identical to SEQ ID NO: 124685
  derived and/or modified sequence opt3 from hemagglutinin__InfluenzaA__ACV33124

SEQ ID NO: 125281 - RNA, 1701 nt, Artificial Sequence; identical to SEQ ID NO: 124685
  derived and/or modified sequence opt3 from hemagglutinin__InfluenzaA__ACV33134

SEQ ID NO: 125282 - RNA, 1701 nt, Artificial Sequence; identical to SEQ ID NO: 125247
  derived and/or modified sequence opt3 from hemagglutinin__InfluenzaA__ACV33144

SEQ ID NO: 125283 - RNA, 1701 nt, Artificial Sequence; identical to SEQ ID NO: 124685
  derived and/or modified sequence opt3 from hemagglutinin__InfluenzaA__ACV33154

SEQ ID NO: 125284 - RNA, 1701 nt, Artificial Sequence; identical to SEQ ID NO: 124685
  derived and/or modified sequence opt3 from hemagglutinin__InfluenzaA__ACV33164

SEQ ID NO: 125285 - RNA, 1701 nt, Artificial Sequence; identical to SEQ ID NO: 124685
  derived and/or modified sequence opt3 from hemagglutinin__InfluenzaA__ACV33174

SEQ ID NO: 125286 - RNA, 1701 nt, Artificial Sequence; identical to SEQ ID NO: 124672
  derived and/or modified sequence opt3 from hemagglutinin__InfluenzaA__ACV41981

SEQ ID NO: 125287 - RNA, 1701 nt, Artificial Sequence; identical to SEQ ID NO: 124711
  derived and/or modified sequence opt3 from hemagglutinin__InfluenzaA__ACV41991

SEQ ID NO: 125288 - RNA, 1701 nt, Artificial Sequence; identical to SEQ ID NO: 124711
  derived and/or modified sequence opt3 from hemagglutinin__InfluenzaA__ACV42001

SEQ ID NO: 125289 - RNA, 1701 nt, Artificial Sequence; identical to SEQ ID NO: 124685
  derived and/or modified sequence opt3 from hemagglutinin__InfluenzaA__ACV42008

SEQ ID NO: 125290 - RNA, 1701 nt, Artificial Sequence; identical to SEQ ID NO: 124685
  derived and/or modified sequence opt3 from hemagglutinin__InfluenzaA__ACV42018

SEQ ID NO: 125291 - RNA, 1701 nt, Artificial Sequence; identical to SEQ ID NO: 124332
  derived and/or modified sequence opt3 from hemagglutinin__InfluenzaA__ACV49501

SEQ ID NO: 125292 - RNA, 1701 nt, Artificial Sequence
  derived and/or modified sequence opt3 from hemagglutinin__InfluenzaA__ACV49512
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucgagucacggccuuggguccgcggacugagcaguagaauaucuauuuauuggaccaucgugaagccaggcgacgugcuagucauuaacuccaaugguaaccucaucgccccgaggggguacuuuaaaaugcggacuggaaagagcucgaucaugcgcucugacgcucccauugauacauguauauccgaaugcaucaccccuaauggcucaauuccaaacgacaaacccuuccagaauguuaacaagaucacguacggcgccuguccuaaauaugugaagcagaauacccugaaacuugcgacagggaugcgaaacguaccagagaaacagacuagaggacuguuuggugcaauagccggcuucauugaaaaugggugggagggaaugaucgauggcugguacgguuuuaggcaccaaaacagugaggggaccggccaggcugccgaccuuaagagcacacaggcagcuaucgaucaaauuaauggaaaacucaaccgggugaucgaaaagacuaaugagaaauuccaccagauugaaaaggaguucuccgaagucgagggccguauacaggaccuggagaaauauguggaagauaccaagaucgacuuauggucuuacaacgccgagcugcucguugcgcuugaaaaucagcauacaauugaucugaccgacagcgagaugaacaaguuguuugaaaagacucgcagacaacuaagggagaacgccgaggauauggggaauggaugcuucaagaucuaucacaaaugugacaacgcaugcaucgaaucaauucggaaugguacguacgaccaugauguguaucgagacgaggcucugaacaaucgcuuucagauaaaggaugucgaacucaaaaguggcuacaaggacuggauccuguggauuuccuucgccaucagcugcuuucuucugugugugguauugcucggguucauuaugugggcuugccagagaggaaacaucagguguaauauaugcaucuga

SEQ ID NO: 125293 - RNA, 1701 nt, Artificial Sequence; identical to SEQ ID NO: 124345
  derived and/or modified sequence opt3 from hemagglutinin__InfluenzaA__ACV49523

SEQ ID NO: 125294 - RNA, 1698 nt, Artificial Sequence
  derived and/or modified sequence opt3 from hemagglutinin__InfluenzaA__ACV49545
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacugaagaacucauacgucaauaaaaagggcaaagaggugcuaguacucuggggcauacaucacccacccaacaguaaggaacagcagaaccuguaucagaaugagaacgccuacguuagcguggucacuucuaauuacaaccguagauuuacaccugaaaucgcugagaggccaaaggugcgggaccaagccgggcgcaugaauuauuacuggacccuucugaaaccgggagauacgauuaucuucgaggcgaacgguaauuugauugcacccauguaugccuuugcucucuccagaggcuucgggucaggaaucauaacuagcaacgccaguaugcacgaauguaauaccaagugccagacaccucugggcgcaauuaacucuuccuuaccauaccagaauauccaucccgugacuauuggugaguguccuaaauaugucaggagcgcuaagcugcggaugguuaccgggcuccgcaacaucccaucgauccagucucgaggacuuuuuggcgccauugcgggcuucauagaagggggauggacagguaugaucgacggcugguacggguaucaccaucaaaaugagcagggauccggcuacgccgcagaucagaaaucaacccagaacgcuauuaaugguaucacgaacaaggugaacacuguaauagagaaaaugaauauucaauuuacagccguggggaaggaguucaacaagcuggagaaaagaauggaaaauuugaacaagaaagucgacgauggcuuucuagacaucuggaccuacaaugcugagcugcucgugcugcuugaaaacgagaggacucuggacuuccacgauaguaauguuaagaacuuguaugaaaaagucaagagccagcucaagaauaacgccaaagagaucggaaauggcugcuucgaguuuuaccacaagugugacaacgaaugcauggaguccgugcggaaugggacauaugauuaccccaaauauucugaagagagcaagcugaaccgugagaaaguggacggaguaaaguuagaaucaauggguauuuaccagauccuggcaauuuauaguaccguugccuccagccuagugcuccuggucucucuuggcgcuauaucauucuggaugugcaguaaugggagcuugcaaugucgcaucugcauuuga

SEQ ID NO: 125295 - RNA, 1701 nt, Artificial Sequence
  derived and/or modified sequence opt3 from hemagglutinin__InfluenzaA__ACV49556
augaaggccagacugcucauccuucugugcgcuuuggcagccaccgacgcggauacaauuuguauaggcuaccacgcuaacaauagcacugacacgguggauaccgucuuagagaaaaacguuacagugacucauuccguaaaucugcuagaagacucucacaacgggaagcucugcaggcugaaaggaaucgccccgcuucagcuggguaaguguaauauugcaggcuggaucuuggggaacccugagugcgauucacuccugccagccaguagcugguccuauauuguggaaacccccaauucuaaaaacggaaucuguuaccccggcgacuucauagauuaugaggaacugcgggagcaacucucgucagucagcaguuuugagcgcuucgaaaucuuuccuaaggaguccucuuggccaaagcauagcacaaccaaaggugugacugcugcaugcucccacgccgggaagucaaguuucuaccgaaauuuacuguggcuuaccaaaaaggaagacagcuaucccaaauugucuaacuccuacguuaauaagaagggaaaagaggugcugguccuauggggcgugcaucacccuucaagcaguaaggagcagcagacacucuaucagaacgaaaaugcuuacguaucuguuguguccagcaacuacaaucguagauuuauuccagagaucgccgaaaggcccgaggucaaagaucaagcgggccggauuaacuauuacuggacgcugcuugaaccuggggacacuaucauauucgaggcaaacggaaaucugguggccccaugguaugcuuuugccuugucgcgcgguuucggcucugggauuaucaccuccaacgcaucaaugcacgaguguaauacaaagugccagacuccgcagggagcuauuaacaguagccuccccuuucagaauauccauccugugaccaucggcgaauguccaaaauacgucaaguccgccaaacugagaaugguuacagguuuaaggaacauucccucuauacaaagccgggggcuguucggagcgaucgccggcuuuauugagggcggguggaccggaaugaucgaugguugguauggcuaccaccaucagaaugaacaggggucaggauaugcagcugaccagaagaguacgcaaaacgccauaaauggcauuacuaacaagguaaauuccgugaucgagaaaaugaacacacaguucaccgcuguggguaaggaauuuaauaaccucgagaaacgcauggagaaucuuaacaagaaagucgaugacggguuccuggacaucuggacuuacaacgccgaauugcuagugcugcucgagaaugaacgaacacuggauuuccacgacagcaacguuaagaaucuuuacgagaaggugaaaauucagcugaagaacaaugcaaaagaaaucggcaacggaugcuuugaguucuaucacaagugugauaaugagugcauggaaucugucagaaacggcaccuacgacuauccuaaauacucaaaggagaguaaguugaauagggagaaaauugauggggugaagcucgaaagcaugggaguauaucaaauacuggccaucuacuccacgguugcuucuucguuagugcugcuagucagccucggugcgauuuccuuuuggaugugcucaaacggcagucugcagugucggaucugcaucuga

SEQ ID NO: 125296 - RNA, 1701 nt, Artificial Sequence
  derived and/or modified sequence opt3 from hemagglutinin__InfluenzaA__ACV49567
augaaggccaaacugcucauccuucugugcgcuuugaccgcaacagacgccgauacuauuuguauaggcuaccacgcgaacaauagcacggacaccguggauacagucuuagagaagaacguuacugugacccauuccguaaaucugcuagaagacucucacaacgggaaacucugcagacugaagggaaucgcuccccuucagcuggguaaauguaauauugccggcuggaucuuggggaacccugagugcgaaucacuccugaguaagaggagcugguccuauauugcagagacaccaaauucugaaaacggagccuguuacccgggcgauuucgcugacuaugaggagcugcgggaacaacucucgucagugagcaguuuugagcgcuucgaaaucuuucccaaggagcgauccuggccuaaacauaauauaacccguggugucacugcagccugcucucacgcugggaaaagcuccuucuacaaaaacuuacuguggcuuacagagaccgauggaucauauccaaaguugaguaaaagcuacgugaauaacaaggaaaaggagguucuggugcuauggggcguccaucaccccucuaauaucgaagaccagaaaacgcucuauagaaaggagaacgccuacguguccguaguuucaagcaauuacaacaggcgguuuacuccugaaauugcggagcgcccaaaagugagaggccaggcagggaggaucaacuauuacuggacccugcuugagcccggagauacaauuaucuucgaagccaaugguaaccugauagcuccuugguaugccuuugcauugagucgggacuucggcucugggauuaucacuuccaaugcuagcauggaugagugugacaccaagugccagacaccacaaggagccauuaacucgucucucccguuucagaauauccaccccgucaccaucggcgaauguccuaaauacgugaaguccacgaaacugcgcauggugacugguuuacgaaacauuccaucaauacagaguagagggcuguucggagcgaucgccggcuuuauugagggcggguggacaggaaugaucgaugguugguauggcuaccaucaccagaaugaacaagggagcggauaugcagcugaccagaaguccacccagaacgccauaaauuggauuacuaacaaggucaauucuguuaucgagaaaaugaacacacaguucaccgcugugggcaaggaguuuaauaaacucgaaaagaggauggagaaccuuaauaaaaagguagacgaugguuuccuggacaucuggacguacaacgccgaauugcuagugcugcucgagaacgaacggacccuggauuuccaugacagcaaugucaagaaccuuuacgagaaagugaagaaucaacugcguaacaaugcaaaagagauugggaacggcugcuuugaguucuaucacaaguguaauaacgaaugcauggaaucaguuaaaaauggaacauacgauuaucccaaguacagugaggaguccaaguugaaccgcgaaaagaucgacggcgugaagcucgagagcaugggggucuaucagauucuggccauauacucuacuguggcuucaaguuuaguacugcuaguuagccucggagcgaucuccuuuuggaugugcucuaaugguucgcugcaguguagaauuugcaucuga

SEQ ID NO: 125297 - RNA, 1689 nt, Artificial Sequence
  derived and/or modified sequence opt3 from hemagglutinin__InfluenzaA__ACV49578
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaaccccaaguauucacucugcuacccuggcaguuuuaaugauuaugaggagcugaagcaucugcucagcuccgugaaacacuucgaaaaggucaaaauuuuaccaaaggaccgauggacucaacauaccacaaccggugggucucgugcuugugccgugucgggaaaccccucauuuuucagaaauaugguuuggcugacuaaaaagggcccuaacuacccaguggcaaagggcagcuauaauaacacaaguggggagcagaugcuuaucauuuggggaguccaccaccccaucgaugaggccgaacagauagcuuuguaccagaaaguggguaccuacguauccgcaucuacgagcacucugaauaagagguccaccccugagauugccgcucggccagaaguuaacggccuagggucacgcauggaguuuaguuggacacuccuggacaugugggauacuaucaauuucgaaagcaccggaaaccuuguggccccggaguauggcuuuaaaauuucuaagagagguuccucagggaucaugaaaacagagggaacccuggaaaacugcgagacgaagugucaaacucccuugggcgcgaucaauacaacccucccuuuccauaacguccacccacugacuauuggcgaaugccccaaauacgucaagagcgagaaguuagugcuggcaacagggcucaggaaugugccucagauagaaagucggggacuuuuuggugccaucgcuggcuucauugaagggggauggcagggcaugguugacgguugguauggguaccaucacucuaacgaucagggcuccggauaugccgcagacaaagagagcacccaaaaggcuuuugauggcaucacgaauaaagugaacucgguaauagaaaagaugaauacccaguucgaggccguggggaaagaauuuucuaaccuggagaagcgcuuggaaaaucuaaacaagaaaauggaggacggauuccuggacgucuggacauacaaugcggagcuccuggugcuuauggaaaacgagcgaacucuggauuuccacgacuccaauguuaagaacuuguaugauaaagugagaaugcagcucagggacaaugucaaggaacuggguaacggcuguuuugaguucuaccauaaaugcgaugacgaguguauggauucagugaagaacgggaccuacgacuauccaaaguacgaagaggaaaguaaauuaaaucggaacgagauuaagggaguaaaacugagcuccaugggcguuuaucagauccuagccaucuacgcaacaguggcugguucucucagccuggccauuaugauggcugggaucucauuuuggaugugcaguaauggcucccuucaaugccguauuuguauauga

SEQ ID NO: 125298 - RNA, 1689 nt, Artificial Sequence; identical to SEQ ID NO: 125297
  derived and/or modified sequence opt3 from hemagglutinin__InfluenzaA__ACV49589

SEQ ID NO: 125299 - RNA, 1689 nt, Artificial Sequence
  derived and/or modified sequence opt3 from hemagglutinin__InfluenzaA__ACV49600
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaggaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacugagaagggcagcaacuauccuguggcaaaagggaguuacaauaacacauccggagagcagaugcuuaucauuugggguguccaccacccaaaugacgaaaccgagcagaggacguuguaucagaacgugggcacuuacguaucuguugggaccagcacacugaauaagcgguccacucccgaaaucgccacccgcccuaaggugaacggacaaggcgguagaauggaguuuucauggacacuacucgauaugugggacaccauaaacuucgaaaguacggggaaucugauugcuccagaguacggauuuaaaaucagcaagagggggucuuccggcauuaugaaaacugagggcacacuugaaaacugcgagaccaagugucagacuccgcugggagcaaucaauacaaccuugcccuuccauaacguccacccucucacgaucggugaaugcccaaaauaugugaagucagagaaacugguguuagccaccggccugcggaaugucccccagauugaaagccgcgggcucuuuggagcuauagccggcuucaucgaggguggguggcagggcaugguugauggaugguacggcuaucaucacaguaacgaccaagggucuggauacgcggcagauaaggaguccacacagaaggccuuugacgguauuacuaauaaagugaacagcguaaucgaaaagaugaauacccaguucgaggcugugggcaaagaauuuucgaaccuugagcgaagacuggaaaauuugaacaagaaaauggaggacggguuccuagaugucuggacauauaaugccgagcugcucgugcugauggaaaacgagaggacucuugacuuccacgauucuaauguuaagaaccuguacgacaaggugcggaugcaguugcgugauaacgucaaagaacucggaaauggcuguuuugaguucuaucauaagugcgacgaugaguguaugaacuccgugaaaaaugguaccuacgacuacccuaaguaugaagaggaaucaaaacugaaccgcaaugagauaaaggggguaaaguuaaguagcaugggcguuuaccaaauucuggcaaucuaugcuacaguggccggaucccuaucucucgcgaucaugauggccggcauuagcuuuuggaugugcucaaacgggagucugcagugcagaaucuguauuuga

SEQ ID NO: 125300 - RNA, 1689 nt, Artificial Sequence
  derived and/or modified sequence opt3 from hemagglutinin__InfluenzaA__ACV49611
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacugagaagggcagcaacuauccuguggcaaaagggaguuacaauaacacauccggagagcagaugcuuaucauuugggguguccaccacccaaaugacgaaaccgagcagaggacguuguaucagaacgugggcacuuacguaucuguugggaccagcacacugaauaagcgguccacucccaagaucgccacccgcccuaaagugaacggacaaggcgguagaauggaauuuucauggacacuacucgauaugugggacaccauaaacuucgagaguacggggaaucugauugcuccagaauacggauuuaagaucagcaaaagggggucuuccggcauuaugaagacugagggcacacuugagaacugcgaaaccaaaugucagacuccgcugggagcaaucaauacaaccuugcccuuccauaacguccacccucucacgaucggugagugcccaaaguaugugaaaucagaaaagcugguguuagccaccggccugcggaaugucccccagauugagagccgcgggcucuuuggagcuauagccggcuucaucgaagguggguggcagggcaugguugauggaugguacggcuaucaucacaguaacgaccaagggucuggauacgcggcagauaaggaguccacacagaaagccuuugacgguauuacuaauaaggugaacagcguaaucgagaaaaugaauacccaguucgaagcugugggcaaggaguuuucgaaccuugaacgaagacuggagaauuugaacaaaaaggucgaagacggguuccuagauguguggacauauaaugccgagcugcucguucugauggagaacgaaaggacucuugacuuccacgauucuaaugugaagaaccuguacgacaaaguccggaugcaguugcgugauaacgugaaggagcucggaaauggcuguuuugaguucuaucauaaaugcgacgaugaguguaugaacuccguaaagaaugguaccuacgacuacccuaaauaugaggaagagucaaagcugaaccgcaaugaaauaaaggggguuaaauuaaguagcaugggcguguaccaaauucuggcaaucuaugcuacagucgccggaucccuaucucucgcgaucaugauggccggcauuagcuuuuggaugugcucaaacgggagucugcagugcagaaucuguauuuga

SEQ ID NO: 125301 - RNA, 1701 nt, Artificial Sequence
  derived and/or modified sequence opt3 from hemagglutinin__InfluenzaA__ACV49633
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaacguccuaugcaugcaagcgaggcucugugaaguccuuuuucucccgucucaacugguuacacaaacuggaguacaaguauccagcccuuaaugucacuaugcccaacaaugauaaauuugacaaguuguacauauggggcgugcaucacccuucaaccgauaguguacaaacaagccuguacguucaggcuucugggagagugacugucuccaccaaaaggucacagcagacagugaucccaaacauuggaagccggcccugggugcgcgguaucaguucuagaauuuccaucuauuggaccauagucaagccuggcgacauucuacucaucaauagcacggggaaccugauugccccaaggggauacuucaagauccggucgggcaaaucuuccaucaugcgcucagacgcgccgauugguaacuguaauagugagugcauaacucccaacgggagcaucccuaaugauaagccauuucaaaacguuaaucgaauuacauauggagcaugucccagauacgugaaacagaacacccuuaagcuggccacuggcaugaggaauguaccugaaaaacagacacggggcaucuucggggcuauagccggauuuauugagaacgguugggaaggcaugguggacgggugguauggauuccgucaccagaauagcgagggcaccggucaagcagcugauuugaagucuacgcaggccgcgaucaaccagaucaaugggaaacucaaccgccugauugagaagaccaaugaaaaguuuccacaaaucgagaaagaguucagcgaagucgaaggcaggauucaggacuuagagaaguacguggaggauacaaaaauagaccuguggucauauaacgccgaacuccuuguugcacuggagaaucagcauacuaucgauuugaccgacagugaaaugaacaagcuauucgagagaacacggaaacagcugcgagaaaacgcugaggauaugggaaauggcugcuuuaagauuuaccacaagugugacaacgccugcaucggguccauccgcaauggaacuuacgaucaugacguguauagagacgaggcucucaacaauagguuccaaauuaaaggugucgaacuuaagagcggcuacaaagauuggauacuuuggaucucuuuugccauuucaugcuuccuguugugugugguacuccugggguuuaucaugugggcaugccagaagggaaacauucgguguaauaucugcauauga

SEQ ID NO: 125302 - RNA, 1701 nt, Artificial Sequence; identical to SEQ ID NO: 124372
  derived and/or modified sequence opt3 from hemagglutinin__InfluenzaA__ACV49644

SEQ ID NO: 125303 - RNA, 1698 nt, Artificial Sequence; identical to SEQ ID NO: 125191
  derived and/or modified sequence opt3 from hemagglutinin__InfluenzaA__ACV49676

SEQ ID NO: 125304 - RNA, 1701 nt, Artificial Sequence; identical to SEQ ID NO: 124672
  derived and/or modified sequence opt3 from hemagglutinin__InfluenzaA__ACV53450

SEQ ID NO: 125305 - RNA, 1701 nt, Artificial Sequence; identical to SEQ ID NO: 124672
  derived and/or modified sequence opt3 from hemagglutinin__InfluenzaA__ACV53460

SEQ ID NO: 125306 - RNA, 1701 nt, Artificial Sequence; identical to SEQ ID NO: 124672
  derived and/or modified sequence opt3 from hemagglutinin__InfluenzaA__ACV53480

SEQ ID NO: 125307 - RNA, 1701 nt, Artificial Sequence
  derived and/or modified sequence opt3 from hemagglutinin__InfluenzaA__ACV53490
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcgacauagccggcuggauccuggggaacccugaaugugagucuuugucaacagcaaguagcugguccuacauuguugaaaccucuucgucagauaauggaacuugcuauccaggcgacuuuaucgauuacgaggagcucagggaacagcugagcaguguguccucuuucgagcgguuugaaauuuucccgaaaacaagcuccuggcccaaccacgacucaaauaagggugucaccgccgcuuguccucaugcaggggccaagaguuuuuauaaaaaccugaucuggcucgugaagaaaggaaauagcuacccaaaguuaucuaaauccuauauaaacgauaagggcaaggagguacugguucuuuggggcauccaccaccccucaacgagcgcugaccaacagaguuuguaccagaaugccgaugcguacguguucgucgggucuucccgcuauagcaaaaaguuuaaaccugagauugcaauccgaccaaaggugcgugaccaggaaggaagaaugaacuacuauuggacucugguggagcccggugauaaaauuaccuucgaagccacaggcaaucuagucguuccuagguacgcuuuugccauggagcggaacgcagggucgggaaucauaauuucugacacuccagugcaugacugcaacaccacaugucaaaccccgaagggcgcuaucaauacgucccuccccuuccacaacauucauccuaucacuaucgguaaaugcccaaaguauguaaagucaacaaaacugcgccuugccaccgggcugagaaaugugcccaguauucagagcaggggauuguuuggcgcgauagccggcuucaucgaagggggauggacugguauggucgauggcugguacggguaucaccaccagaacgagcagggauccggcuacgcagcugaccucaagucuacacaaaaugccauugaugagaucaccaacaaagugaauagcguuauagaaaagaugaacacgcaguuuaccgcuguggguaaagaguucaaucaucuggaaacacggauugagaacuuaaauaagaaggucgacgauggguuccuggacaucuggacuuacaacgccgaacuccuugugcuguuggagaaugagcgcacccuagauuaucacgacucaaacguaaagaaucuguacgaaaagguucgaagucagcucaaaaacaacgcaaaggagaucggcaauggauguuuugaguucuaucauaaaugcgauaacacauguauggaauccgugaagaauggcacuuacgacuauccuaaguacagcgaagaggccaaacugaacagagaggaaauugauggggucaaacuugagucuaccaggaucuaucagauucuggcuauauacucaacaguggcgaguagcuugguccucgugguuucccugggagcaaucucuuuuuggaugugcucgaaugguagcuuacaaugccggauuuguaucuga

SEQ ID NO: 125308 - RNA, 1701 nt, Artificial Sequence
  derived and/or modified sequence opt3 from hemagglutinin__InfluenzaA__ACV53500
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaacacggauugagaauuuaaacaagaaggucgaugacggguuccuggauaucuggacuuacaaugccgaacuccuugugcuguuggagaacgagcgcacccuagacuaucacgauucaaauguaaagaaccuguacgaaaagguucgaagucagcucaaaaacaaugcaaaggagaucggcaacggauguuuugaguucuaucauaaaugcgacaauacauguauggaauccgugaagaacggcacuuacgauuauccuaaguacagcgaagaggccaaacugaauagagaggaaauugacggggucaaacuugagucuaccaggaucuaucagauucuggcuauauacucaacaguggcgaguagcuugguccucgugguuucccugggagcaaucucuuuuuggaugugcucgaacgguagcuuacaaugccggauuuguaucuga

SEQ ID NO: 125309 - RNA, 1701 nt, Artificial Sequence
  derived and/or modified sequence opt3 from hemagglutinin__InfluenzaA__ACV53880
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 125310 - RNA, 1701 nt, Artificial Sequence; identical to SEQ ID NO: 124685
  derived and/or modified sequence opt3 from hemagglutinin__InfluenzaA__ACV53881

SEQ ID NO: 125311 - RNA, 1701 nt, Artificial Sequence; identical to SEQ ID NO: 124672
  derived and/or modified sequence opt3 from hemagglutinin__InfluenzaA__ACV53882

SEQ ID NO: 125312 - RNA, 1701 nt, Artificial Sequence; identical to SEQ ID NO: 124685
  derived and/or modified sequence opt3 from hemagglutinin__InfluenzaA__ACV53883

SEQ ID NO: 125313 - RNA, 1701 nt, Artificial Sequence; identical to SEQ ID NO: 124685
  derived and/or modified sequence opt3 from hemagglutinin__InfluenzaA__ACV53885

SEQ ID NO: 125314 - RNA, 1701 nt, Artificial Sequence
  derived and/or modified sequence opt3 from hemagglutinin__InfluenzaA__ACV53899
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccggagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggagagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 125315 - RNA, 1701 nt, Artificial Sequence; identical to SEQ ID NO: 124685
  derived and/or modified sequence opt3 from hemagglutinin__InfluenzaA__ACV53909

SEQ ID NO: 125316 - RNA, 1701 nt, Artificial Sequence; identical to SEQ ID NO: 124685
  derived and/or modified sequence opt3 from hemagglutinin__InfluenzaA__ACV67220

SEQ ID NO: 125317 - RNA, 1701 nt, Artificial Sequence
  derived and/or modified sequence opt3 from hemagglutinin__InfluenzaA__ACV67221
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugaguguggaucuuugucaacagcaaguagcugguccuacauuguugaaaccucuucgucagacaacggcacuugcuauccaggugauuuuaucgacuacgaggaacucagggagcagcugagcaguguguccucuuucgagcgguuugaaauuuucccgaagacaagcuccuggcccaaucacgauucaaacaagggggucaccgccgcuuguccucaugcaggagccaaaaguuuuuauaagaaucugaucuggcucgugaaaaagggcaacagcuacccaaaauuaucuaaguccuauauaaaugacaagggcaaagagguacugguucuuugggggauccaccaccccucaacgagcgcugaucaacagaguuuguaccagucugccgacgcguacguguucgucggaacuucccgcuauagcaagaaauuuaagccugaaauugcaauccgaccaaaagugcgugaucaggaggguagaaugaacuacuauuggacccugguggagcccggcgacaagauuacauucgaagccacugggaaucuagucguuccuagguacgcuuuugccauggagcggaacgcaggaucgggcaucauaauuucugauaccccagugcaugacugcaacacaaccugucaaacgccgaaaggugcuaucaauacuucccuccccuuccagaacauucacccuaucacaaucgggaagugcccaaaguauguaaaaucaaccaagcugcgccuugccacuggacugagaaaugugcccaguauucagagcaggggcuuguuuggcgcgauagccggguucaucgaaggagguuggacaggcauggucgacgggugguacggauaucaucaccagaacgagcaaggcuccgguuacgcagcugaucucaaaucuacccagaaugccauugacgaaaucacgaacaaggugaauagcguuauagagaaaaugaacacccaguuuacagcuguggggaaggaguucaaucaccuggaaaagcggauugagaacuuaaauaaaaaggucgaugacggcuuccuggauaucuggacuuacaacgccgaacuccuugugcuguuggagaaugaacgcacccuagacuaucaugauucaaacguaaagaaucuguacgagaagguucgaagucagcucaaaaacaacgcaaaggagaucggaaauggcuguuuugaguucuaucacaagugcgacaacacauguauggaauccgugaaaaaugggacuuacgauuauccuaaguacagcgaagaggccaaacugaacagagaagagauugacggagucaaacuugagucuaccaggaucuaucaaauucuggcuauauacucaacaguggcgaguagcuugguccucgugguuucccugggugcaaucucuuuuuggaugugcucgaauggcagcuuacagugccggauuuguaucuga

SEQ ID NO: 125318 - RNA, 1701 nt, Artificial Sequence; identical to SEQ ID NO: 124672
  derived and/or modified sequence opt3 from hemagglutinin__InfluenzaA__ACV67222

SEQ ID NO: 125319 - RNA, 1701 nt, Artificial Sequence; identical to SEQ ID NO: 124711
  derived and/or modified sequence opt3 from hemagglutinin__InfluenzaA__ACV67223

SEQ ID NO: 125320 - RNA, 1701 nt, Artificial Sequence; identical to SEQ ID NO: 124927
  derived and/or modified sequence opt3 from hemagglutinin__InfluenzaA__ACV67224

SEQ ID NO: 125321 - RNA, 1701 nt, Artificial Sequence; identical to SEQ ID NO: 124865
  derived and/or modified sequence opt3 from hemagglutinin__InfluenzaA__ACV67225

SEQ ID NO: 125322 - RNA, 1701 nt, Artificial Sequence; identical to SEQ ID NO: 124685
  derived and/or modified sequence opt3 from hemagglutinin__InfluenzaA__ACV67226

SEQ ID NO: 125323 - RNA, 1701 nt, Artificial Sequence
  derived and/or modified sequence opt3 from hemagglutinin__InfluenzaA__ACV67227
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucgaauaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 125324 - RNA, 1701 nt, Artificial Sequence; identical to SEQ ID NO: 124927
  derived and/or modified sequence opt3 from hemagglutinin__InfluenzaA__ACV67228

SEQ ID NO: 125325 - RNA, 1701 nt, Artificial Sequence
  derived and/or modified sequence opt3 from hemagglutinin__InfluenzaA__ACV67229
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacccuauugacgagaucacgaauaaggugaacucuguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauagcaauguaaagaaccuguacgagaagguucgaucacagcucaaaaacaaugccaaggaaaucggcaacggauguuuugaguucuaucacaagugcgacaauacauguauggaaagugugaaaaacggcacuuacgauuauccaaaguacuccgaggaagcaaaacugaauagagaggagauugacggggucaaacuugaaagcaccaggaucuaucaaauucuggccauauacucuacaguggcuucaaguuugguccucgugguuagccugggagcgaucuccuuuuggaugugcucuaacgguucguuacagugccggauuuguaucuga

SEQ ID NO: 125326 - RNA, 1701 nt, Artificial Sequence; identical to SEQ ID NO: 124672
  derived and/or modified sequence opt3 from hemagglutinin__InfluenzaA__ACV67230

SEQ ID NO: 125327 - RNA, 1701 nt, Artificial Sequence; identical to SEQ ID NO: 124685
  derived and/or modified sequence opt3 from hemagglutinin__InfluenzaA__ACV67231

SEQ ID NO: 125328 - RNA, 1701 nt, Artificial Sequence; identical to SEQ ID NO: 124685
  derived and/or modified sequence opt3 from hemagglutinin__InfluenzaA__ACV67232

SEQ ID NO: 125329 - RNA, 1701 nt, Artificial Sequence; identical to SEQ ID NO: 124672
  derived and/or modified sequence opt3 from hemagglutinin__InfluenzaA__ACV67233

SEQ ID NO: 125330 - RNA, 1701 nt, Artificial Sequence; identical to SEQ ID NO: 124927
  derived and/or modified sequence opt3 from hemagglutinin__InfluenzaA__ACV67234

SEQ ID NO: 125331 - RNA, 1701 nt, Artificial Sequence
  derived and/or modified sequence opt3 from hemagglutinin__InfluenzaA__ACV67235
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguuaaaaaccuguacgagaagguacgaagucagcucaaaaacaaugcaaacgaaaucggcaauggauguuuugaguucuaucacaagugcgacaacaccuguauggaauccgugaagaauggcacauacgauuauccuaaauacagcgaggaagccaagcugaacagagaggagauugacggggucaaacuugaaucuacuaggaucuaucaaauucuggcuauauacucaaccguggcgaguagcuugguccucgugguuucccugggagcaaucucuuuuuggaugugcucgaaugguagcuuacagugccggauuuguaucuga

SEQ ID NO: 125332 - RNA, 1701 nt, Artificial Sequence; identical to SEQ ID NO: 124929
  derived and/or modified sequence opt3 from hemagglutinin__InfluenzaA__ACV67236

SEQ ID NO: 125333 - RNA, 1701 nt, Artificial Sequence; identical to SEQ ID NO: 124672
  derived and/or modified sequence opt3 from hemagglutinin__InfluenzaA__ACV67238

SEQ ID NO: 125334 - RNA, 1701 nt, Artificial Sequence
  derived and/or modified sequence opt3 from hemagglutinin__InfluenzaA__ACV67239
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggucuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguaaagaaccuguacgagaagguucgaagucagcucaaaaacaaugccaaggaaaucggcaacggauguuuugaguucuaucacaagugcaauaacacauguauggaauccgugaaaaauggcacuuacgacuauccuaaguacagcgaggaagcaaaacugaacagagaggagauugauggggucaaacuugaaucuaccaggaucuaucaaauucuggccauauacucaacaguggcuaguagcuugguccucgugguuucccugggagcgaucucuuuuuggaugugcucgaaugguagcuuacagugccggauuuguaucuga

SEQ ID NO: 125335 - RNA, 1701 nt, Artificial Sequence; identical to SEQ ID NO: 124929
  derived and/or modified sequence opt3 from hemagglutinin__InfluenzaA__ACV67240

SEQ ID NO: 125336 - RNA, 1701 nt, Artificial Sequence
  derived and/or modified sequence opt3 from hemagglutinin__InfluenzaA__ACV67241
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaacggaaauagcuacccaaaguuaucuaaauccuauauaaacgacaagggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacgagaucacgaacaaaguuaauucugugauagagaagaugaacacccaguuuacagcuguggguaaagaguucaaucaccuggaaaagcggauugaaaacuuaaauaagaaagucgaugacggguuccuggauaucuggacuuacaacgccgagcuccuugugcuguuggaaaaugagcgcacccuagacuaucaugauagcaacguaaagaaccuguacgagaaaguucgaucacagcucaagaauaacgcaaaagaaaucggcaauggauguuuugaguucuaucacaagugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 125337 - RNA, 1701 nt, Artificial Sequence; identical to SEQ ID NO: 124927
  derived and/or modified sequence opt3 from hemagglutinin__InfluenzaA__ACV67242

SEQ ID NO: 125338 - RNA, 1701 nt, Artificial Sequence; identical to SEQ ID NO: 124865
  derived and/or modified sequence opt3 from hemagglutinin__InfluenzaA__ACV67244

SEQ ID NO: 125339 - RNA, 1701 nt, Artificial Sequence; identical to SEQ ID NO: 124778
  derived and/or modified sequence opt3 from hemagglutinin__InfluenzaA__ACV67246

SEQ ID NO: 125340 - RNA, 1701 nt, Artificial Sequence; identical to SEQ ID NO: 125309
  derived and/or modified sequence opt3 from hemagglutinin__InfluenzaA__ACV67247

SEQ ID NO: 125341 - RNA, 1701 nt, Artificial Sequence; identical to SEQ ID NO: 124672
  derived and/or modified sequence opt3 from hemagglutinin__InfluenzaA__ACV70073

SEQ ID NO: 125342 - RNA, 1701 nt, Artificial Sequence; identical to SEQ ID NO: 124672
  derived and/or modified sequence opt3 from hemagglutinin__InfluenzaA__ACV70093

SEQ ID NO: 125343 - RNA, 1701 nt, Artificial Sequence; identical to SEQ ID NO: 124672
  derived and/or modified sequence opt3 from hemagglutinin__InfluenzaA__ACV70103

SEQ ID NO: 125344 - RNA, 1701 nt, Artificial Sequence; identical to SEQ ID NO: 124672
  derived and/or modified sequence opt3 from hemagglutinin__InfluenzaA__ACV70113

SEQ ID NO: 125345 - RNA, 1701 nt, Artificial Sequence; identical to SEQ ID NO: 124672
  derived and/or modified sequence opt3 from hemagglutinin__InfluenzaA__ACV70123

SEQ ID NO: 125346 - RNA, 1701 nt, Artificial Sequence; identical to SEQ ID NO: 124672
  derived and/or modified sequence opt3 from hemagglutinin__InfluenzaA__ACV70154

SEQ ID NO: 125347 - RNA, 1701 nt, Artificial Sequence
  derived and/or modified sequence opt3 from hemagglutinin__InfluenzaA__ACV70164
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggucuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgcucaaaggcgcaaucaacacuucccugccguuccagaauauucaccccaucacaaucgguaagugcccuaaguauguaaaaucaaccaaacuucgccuggcuacuggguugagaaacgugccaaguauucagagcaggggacucuuuggcgccauagcgggcuucaucgaagggggauggacagguauggucgacggcugguacggguaucaucaccagaaugaacaaggauccggcuacgccgcagaucugaaaucuacccagaacgcuauugacgagaucacgaauaaggugaacagcguuauagagaaaaugaauacccaguuuacagccguggguaaggaguucaaccacuuagaaaagcggauugaaaaucugaacaaaaaggucgaugacggguuccucgauaucuggacuuacaaugcugagcuucugguguugcuagaaaacgagcgcacccuggacuaucaugauucaaauguaaagaaccucuacgagaagguucgaagucagcugaaaaacaaugccaaggaaaucggcaacggauguuuugaguucuaucacaagugcgacaauacauguauggaauccgugaaaaacggcacuuacgauuaucccaaguacagcgaggaagcaaaacuuaauagagaggagauugacggggucaagcuggaaucuaccaggaucuaucaaauuuuggccauauacucaacaguggcuaguagccucguccuggugguuuccuuaggagcgaucucuuuuuggaugugcucgaacgguagccugcagugccggauuuguaucuga

SEQ ID NO: 125348 - RNA, 1701 nt, Artificial Sequence; identical to SEQ ID NO: 124672
  derived and/or modified sequence opt3 from hemagglutinin__InfluenzaA__ACV70174

SEQ ID NO: 125349 - RNA, 1701 nt, Artificial Sequence; identical to SEQ ID NO: 124672
  derived and/or modified sequence opt3 from hemagglutinin__InfluenzaA__ACV70184

SEQ ID NO: 125350 - RNA, 1701 nt, Artificial Sequence; identical to SEQ ID NO: 124672
  derived and/or modified sequence opt3 from hemagglutinin__InfluenzaA__ACV70194

SEQ ID NO: 125351 - RNA, 1701 nt, Artificial Sequence; identical to SEQ ID NO: 124672
  derived and/or modified sequence opt3 from hemagglutinin__InfluenzaA__ACV70204

SEQ ID NO: 125352 - RNA, 1701 nt, Artificial Sequence; identical to SEQ ID NO: 124672
  derived and/or modified sequence opt3 from hemagglutinin__InfluenzaA__ACV70214

SEQ ID NO: 125353 - RNA, 1701 nt, Artificial Sequence; identical to SEQ ID NO: 124672
  derived and/or modified sequence opt3 from hemagglutinin__InfluenzaA__ACV70224

SEQ ID NO: 125354 - RNA, 1701 nt, Artificial Sequence; identical to SEQ ID NO: 124672
  derived and/or modified sequence opt3 from hemagglutinin__InfluenzaA__ACV70234

SEQ ID NO: 125355 - RNA, 1701 nt, Artificial Sequence; identical to SEQ ID NO: 124672
  derived and/or modified sequence opt3 from hemagglutinin__InfluenzaA__ACV70254

SEQ ID NO: 125356 - RNA, 1701 nt, Artificial Sequence; identical to SEQ ID NO: 124672
  derived and/or modified sequence opt3 from hemagglutinin__InfluenzaA__ACV70264

SEQ ID NO: 125357 - RNA, 1701 nt, Artificial Sequence; identical to SEQ ID NO: 124672
  derived and/or modified sequence opt3 from hemagglutinin__InfluenzaA__ACV70274

SEQ ID NO: 125358 - RNA, 1701 nt, Artificial Sequence; identical to SEQ ID NO: 124672
  derived and/or modified sequence opt3 from hemagglutinin__InfluenzaA__ACV70284

SEQ ID NO: 125359 - RNA, 1701 nt, Artificial Sequence; identical to SEQ ID NO: 124672
  derived and/or modified sequence opt3 from hemagglutinin__InfluenzaA__ACV70294

SEQ ID NO: 125360 - RNA, 1701 nt, Artificial Sequence; identical to SEQ ID NO: 124672
  derived and/or modified sequence opt3 from hemagglutinin__InfluenzaA__ACV70304

SEQ ID NO: 125361 - RNA, 1701 nt, Artificial Sequence; identical to SEQ ID NO: 125347
  derived and/or modified sequence opt3 from hemagglutinin__InfluenzaA__ACV70314

SEQ ID NO: 125362 - RNA, 1701 nt, Artificial Sequence
  derived and/or modified sequence opt3 from hemagglutinin__InfluenzaA__ACV70324
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuguuuacagcaucaaguuggagcuacauuguugagaccuccucuucggacaacggaacuugcuauccaggcgauuucaucgacuacgaggagcucagggagcagcugucaagcgugaguuccuuugaacgguucgagauuuuuccgaagacaucuagcuggcccaaucacgauuccaacaagggugucaccgccgcuuguccucaugcaggggccaaaucauucuauaagaaucugaucuggcucgugaaaaagggaaacaguuacccaaaauuaagcaagucuuauauaaaugacaagggcaaagaaguacugguucuuuggggcauccaccaccccuccacgucagcugaucaacagagcuuguaccagaacgccgacgcguacguguuugucgggaguucucgcuauuccaagaaauucaagccugagauugcaauccgaccaaaagugcgugaucaggagggaagaaugaauuacuauuggacucugguggaacccggugacaagauuaccuuugaggccacaggcaaccuagucguuccuagguacgcuuucgccauggaacggaacgcagggagcggaaucauaauuucggauacuccagugcaugacugcaauaccacaugucaaaccccgaaaggcgcuaucaacacgucucuccccuuucagaauauucacccuaucacuaucgguaagugcccaaaguauguaaaauccacaaagcugcgccuugccaccgggcugagaaacgugcccucaauucagaguaggggauuguucggcgcgauagccggcuuuaucgaagggggauggacugguauggucgacggcugguacggguaucaucaccagaaugaacaaggaagcggcuacgcagcugaucucaaauccacacagaacgccauugacgagaucaccaauaaggugaacucuguuauagagaaaaugaauacgcaguucaccgcuguggguaaggaguucaaccaccuggaaaagcggauugaaaauuuaaacaaaaaggucgaugacggguuucuggauaucuggacauacaaugccgagcuccuugugcuguuggaaaacgagcgcacucuagacuaucaugauagcaauguaaagaaccuguacgagaagguucgaucacagcucaaaaacaaugcaaaggaaaucggcaacggauguuucgaguuuuaucacaagugcgacaauaccuguauggaaagugugaaaaacggcacauacgauuauccuaaguacuccgaggaagccaaacugaauagagaggagauugacggggucaaacuugaaagcacuaggaucuaucaaauucuggcuauauacucuaccguggcgucaaguuugguccucgugguuagccugggagcaaucuccuucuggaugugcucuaacgguucguuacagugccggauuuguaucuga

SEQ ID NO: 125363 - RNA, 1701 nt, Artificial Sequence; identical to SEQ ID NO: 124672
  derived and/or modified sequence opt3 from hemagglutinin__InfluenzaA__ACV70334

SEQ ID NO: 125364 - RNA, 1701 nt, Artificial Sequence; identical to SEQ ID NO: 124672
  derived and/or modified sequence opt3 from hemagglutinin__InfluenzaA__ACV70344

SEQ ID NO: 125365 - RNA, 1701 nt, Artificial Sequence; identical to SEQ ID NO: 124672
  derived and/or modified sequence opt3 from hemagglutinin__InfluenzaA__ACV70354

SEQ ID NO: 125366 - RNA, 1701 nt, Artificial Sequence; identical to SEQ ID NO: 124672
  derived and/or modified sequence opt3 from hemagglutinin__InfluenzaA__ACV70364

SEQ ID NO: 125367 - RNA, 1701 nt, Artificial Sequence; identical to SEQ ID NO: 124672
  derived and/or modified sequence opt3 from hemagglutinin__InfluenzaA__ACV70374

SEQ ID NO: 125368 - RNA, 1701 nt, Artificial Sequence; identical to SEQ ID NO: 124672
  derived and/or modified sequence opt3 from hemagglutinin__InfluenzaA__ACV70384

SEQ ID NO: 125369 - RNA, 1701 nt, Artificial Sequence; identical to SEQ ID NO: 124672
  derived and/or modified sequence opt3 from hemagglutinin__InfluenzaA__ACV70394

SEQ ID NO: 125370 - RNA, 1701 nt, Artificial Sequence; identical to SEQ ID NO: 124672
  derived and/or modified sequence opt3 from hemagglutinin__InfluenzaA__ACV70404

SEQ ID NO: 125371 - RNA, 1701 nt, Artificial Sequence; identical to SEQ ID NO: 125347
  derived and/or modified sequence opt3 from hemagglutinin__InfluenzaA__ACV70414

SEQ ID NO: 125372 - RNA, 1701 nt, Artificial Sequence; identical to SEQ ID NO: 124672
  derived and/or modified sequence opt3 from hemagglutinin__InfluenzaA__ACV70424

SEQ ID NO: 125373 - RNA, 1701 nt, Artificial Sequence; identical to SEQ ID NO: 124672
  derived and/or modified sequence opt3 from hemagglutinin__InfluenzaA__ACV70434

SEQ ID NO: 125374 - RNA, 1701 nt, Artificial Sequence; identical to SEQ ID NO: 124672
  derived and/or modified sequence opt3 from hemagglutinin__InfluenzaA__ACV70444

SEQ ID NO: 125375 - RNA, 1701 nt, Artificial Sequence; identical to SEQ ID NO: 124672
  derived and/or modified sequence opt3 from hemagglutinin__InfluenzaA__ACV70454

SEQ ID NO: 125376 - RNA, 1701 nt, Artificial Sequence; identical to SEQ ID NO: 124672
  derived and/or modified sequence opt3 from hemagglutinin__InfluenzaA__ACV70464

SEQ ID NO: 125377 - RNA, 1701 nt, Artificial Sequence; identical to SEQ ID NO: 124672
  derived and/or modified sequence opt3 from hemagglutinin__InfluenzaA__ACV70474

SEQ ID NO: 125378 - RNA, 1701 nt, Artificial Sequence; identical to SEQ ID NO: 124672
  derived and/or modified sequence opt3 from hemagglutinin__InfluenzaA__ACV70484

SEQ ID NO: 125379 - RNA, 1701 nt, Artificial Sequence; identical to SEQ ID NO: 124672
  derived and/or modified sequence opt3 from hemagglutinin__InfluenzaA__ACV70494

SEQ ID NO: 125380 - RNA, 1701 nt, Artificial Sequence; identical to SEQ ID NO: 124672
  derived and/or modified sequence opt3 from hemagglutinin__InfluenzaA__ACV70504

SEQ ID NO: 125381 - RNA, 1701 nt, Artificial Sequence; identical to SEQ ID NO: 124672
  derived and/or modified sequence opt3 from hemagglutinin__InfluenzaA__ACV70514

SEQ ID NO: 125382 - RNA, 1701 nt, Artificial Sequence; identical to SEQ ID NO: 124672
  derived and/or modified sequence opt3 from hemagglutinin__InfluenzaA__ACV70524

SEQ ID NO: 125383 - RNA, 1701 nt, Artificial Sequence; identical to SEQ ID NO: 124865
  derived and/or modified sequence opt3 from hemagglutinin__InfluenzaA__ACV70534

SEQ ID NO: 125384 - RNA, 1701 nt, Artificial Sequence; identical to SEQ ID NO: 124672
  derived and/or modified sequence opt3 from hemagglutinin__InfluenzaA__ACV70544

SEQ ID NO: 125385 - RNA, 1701 nt, Artificial Sequence; identical to SEQ ID NO: 124672
  derived and/or modified sequence opt3 from hemagglutinin__InfluenzaA__ACV70564

SEQ ID NO: 125386 - RNA, 1701 nt, Artificial Sequence; identical to SEQ ID NO: 124672
  derived and/or modified sequence opt3 from hemagglutinin__InfluenzaA__ACV70584

SEQ ID NO: 125387 - RNA, 1701 nt, Artificial Sequence; identical to SEQ ID NO: 125347
  derived and/or modified sequence opt3 from hemagglutinin__InfluenzaA__ACV70594

SEQ ID NO: 125388 - RNA, 1701 nt, Artificial Sequence; identical to SEQ ID NO: 124672
  derived and/or modified sequence opt3 from hemagglutinin__InfluenzaA__ACV70604

SEQ ID NO: 125389 - RNA, 1701 nt, Artificial Sequence; identical to SEQ ID NO: 124672
  derived and/or modified sequence opt3 from hemagglutinin__InfluenzaA__ACV70614

SEQ ID NO: 125390 - RNA, 1701 nt, Artificial Sequence; identical to SEQ ID NO: 124672
  derived and/or modified sequence opt3 from hemagglutinin__InfluenzaA__ACV70624

SEQ ID NO: 125391 - RNA, 1701 nt, Artificial Sequence; identical to SEQ ID NO: 124672
  derived and/or modified sequence opt3 from hemagglutinin__InfluenzaA__ACV70634

SEQ ID NO: 125392 - RNA, 1701 nt, Artificial Sequence; identical to SEQ ID NO: 124672
  derived and/or modified sequence opt3 from hemagglutinin__InfluenzaA__ACV70644

SEQ ID NO: 125393 - RNA, 1701 nt, Artificial Sequence; identical to SEQ ID NO: 124672
  derived and/or modified sequence opt3 from hemagglutinin__InfluenzaA__ACV70654

SEQ ID NO: 125394 - RNA, 1701 nt, Artificial Sequence; identical to SEQ ID NO: 124672
  derived and/or modified sequence opt3 from hemagglutinin__InfluenzaA__ACV70664

SEQ ID NO: 125395 - RNA, 1701 nt, Artificial Sequence; identical to SEQ ID NO: 124672
  derived and/or modified sequence opt3 from hemagglutinin__InfluenzaA__ACV70674

SEQ ID NO: 125396 - RNA, 1701 nt, Artificial Sequence; identical to SEQ ID NO: 124672
  derived and/or modified sequence opt3 from hemagglutinin__InfluenzaA__ACV70684

SEQ ID NO: 125397 - RNA, 1701 nt, Artificial Sequence; identical to SEQ ID NO: 124672
  derived and/or modified sequence opt3 from hemagglutinin__InfluenzaA__ACV70694

SEQ ID NO: 125398 - RNA, 1701 nt, Artificial Sequence; identical to SEQ ID NO: 124672
  derived and/or modified sequence opt3 from hemagglutinin__InfluenzaA__ACV70704

SEQ ID NO: 125399 - RNA, 1701 nt, Artificial Sequence; identical to SEQ ID NO: 124672
  derived and/or modified sequence opt3 from hemagglutinin__InfluenzaA__ACV70714

SEQ ID NO: 125400 - RNA, 1701 nt, Artificial Sequence; identical to SEQ ID NO: 124672
  derived and/or modified sequence opt3 from hemagglutinin__InfluenzaA__ACV70724

SEQ ID NO: 125401 - RNA, 1701 nt, Artificial Sequence; identical to SEQ ID NO: 125309
  derived and/or modified sequence opt3 from hemagglutinin__InfluenzaA__ACV70734

SEQ ID NO: 125402 - RNA, 1701 nt, Artificial Sequence; identical to SEQ ID NO: 124672
  derived and/or modified sequence opt3 from hemagglutinin__InfluenzaA__ACV70744

SEQ ID NO: 125403 - RNA, 1701 nt, Artificial Sequence; identical to SEQ ID NO: 124672
  derived and/or modified sequence opt3 from hemagglutinin__InfluenzaA__ACV70754

SEQ ID NO: 125404 - RNA, 1701 nt, Artificial Sequence; identical to SEQ ID NO: 124672
  derived and/or modified sequence opt3 from hemagglutinin__InfluenzaA__ACV70764

SEQ ID NO: 125405 - RNA, 1701 nt, Artificial Sequence; identical to SEQ ID NO: 124672
  derived and/or modified sequence opt3 from hemagglutinin__InfluenzaA__ACV70784

SEQ ID NO: 125406 - RNA, 1701 nt, Artificial Sequence
  derived and/or modified sequence opt3 from hemagglutinin__InfluenzaA__ACV70794
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugccaccgcugcauguccucaugccggggcuaaaggauuuuauaagaaucugaucuggcucgucaaaaagggcaacaguuacccaaaauuaagcaagucuuauauaaaugacaagggcaaagaagugcugguacuuugggggauccaccaccccuccacgucagccgaucaacagagcuuguaccagaacgcggacgcauacguuuucgugggaaguucucgcuauuccaagaaauuuaagccugagauugccauccgaccaaaaguccgugaucaggaggguagaaugaauuacuauuggacucugguggaacccggcgacaagauuaccuucgaggcuacagggaaccuaguggucccuagguacgccuuugcaauggaacggaacgcuggaagcggcaucauaauuucggauacuccaguucaugacugcaauaccacaugucaaaccccgaaaggugccaucaacacgucucuccccuuccagaauauucacccuaucacuaucgggaagugcccaaaguaugugaaauccacaaagcugcgccuugcgaccggacugagaaacguacccucaauucagaguaggggcuuguuuggcgccauagcaggguucaucgagggagguuggacuggcaugguggacgggugguacggauaucaucaccagaaugaacaaggcagcgguuacgcugccgaucucaaauccacacagaacgcuauugacgagaucaccaauaaggucaacucugugauagagaaaaugaauacgcaguuuaccgccguugggaaggaguucaaccaccuggagaagcggauugaaaauuuaaacaaaaagguggaugacggcuuccuggauaucuggacauacaaugcagagcuccuuguccuguuggaaaacgagcgcacucuagacuaucaugauagcaaugugaaaaaccuguacgagaagguacgaucacagcucaaaaacaaugccaaggaaaucggaaacggcuguuuugaguucuaucacaagugcgacaauaccuguauggaaaguguuaaaaacgggacauacgauuauccuaaguacuccgaggaagcuaaacugaauagagaggagauugacggagugaaacuugaaagcacuaggaucuaucaaauucuggcgauauacucuaccgucgcaucaaguuuggugcucgucgugagccugggugccaucuccuuuuggaugugcucuaacggcucguuacagugccggauuuguaucuga

SEQ ID NO: 125407 - RNA, 1701 nt, Artificial Sequence; identical to SEQ ID NO: 124672
  derived and/or modified sequence opt3 from hemagglutinin__InfluenzaA__ACV70804

SEQ ID NO: 125408 - RNA, 1701 nt, Artificial Sequence; identical to SEQ ID NO: 125347
  derived and/or modified sequence opt3 from hemagglutinin__InfluenzaA__ACV70824

SEQ ID NO: 125409 - RNA, 1701 nt, Artificial Sequence; identical to SEQ ID NO: 124672
  derived and/or modified sequence opt3 from hemagglutinin__InfluenzaA__ACV70834

SEQ ID NO: 125410 - RNA, 1701 nt, Artificial Sequence
  derived and/or modified sequence opt3 from hemagglutinin__InfluenzaA__ACV70844
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgucagcugaucaacagagcuuguaccagaacgccgacgcguacguguucgucggaaguucucgcuauuccaagaaauuuaagccugagauugcaauccgaccaaaagugcgugaucaggaggguagaaugaauuacuauuggacucugguggaacccggcgacaagauuaccuucgaggccacagggaaccuacucgucccuagguacgcuuuugccauggaacggaacgcaggaagcggcaucauaauuucggauacuccaguucaugacugcaauaccacaugucaaaccccgaaaggugcuaucaacacgucucugcccuuccagaauauucacccuaucacuaucgggaagugcccaaaguaugugaaauccacaaaacuucgccuggccaccggauugagaaacguacccucaauucagaguaggggccucuuuggcgcgauagccggguucaucgagggagguuggacuggcaugguggacgggugguacggauaucaucaccagaaugaacaaggcagcgguuacgcagcugaucugaaguccacacagaacgccauugacgagaucaccaauaaggucaacucugugauagagaaaaugaauacgcaguuuaccgcuguugggaaggaguucaaccacuuagagaagcggauugaaaaucugaacaaaaagguggaugacggcuuccucgauaucuggacauacaaugccgagcuucuggucuugcuagaaaacgagcgcacucuggacuaucaugauagcaaugugaaaaaccucuacgagaagguacgaucacagcugaaaaacaaugcaaaggaaaucggaaacggcuguuuugaguucuaucacaagugcgacaauaccuguauggaaaguguuaaaaacgggacauacgauuauccuaaguacuccgaggaagccaaacuuaauagagaggagauugacggagugaagcuggaaagcacuaggaucuaucaaauuuuggcuauauacucuaccgucgcgucaagucucgugcuggucgugagcuuaggugcaaucuccuuuuggaugugcucuaacggcucgcugcagugccggauuuguaucuga

SEQ ID NO: 125411 - RNA, 1701 nt, Artificial Sequence; identical to SEQ ID NO: 124672
  derived and/or modified sequence opt3 from hemagglutinin__InfluenzaA__ACV70854

SEQ ID NO: 125412 - RNA, 1701 nt, Artificial Sequence
  derived and/or modified sequence opt3 from hemagglutinin__InfluenzaA__ACV70864
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaacgagcuacccaaaauuaucuaaguccuauauaaacgacaagggcaaagaaguacugguucuuuggggcauccaccaccccucaacuagcgcugaucaacagaguuuguaccagaaugccgacgcguacguguucgucgggucuucccgcuauagcaagaaauuuaagccugagauugcaauccgaccaaaagugcgugaucaggagggaagaaugaacuacuauuggacccugguggaacccggugacaagauuacauucgaggccacuggcaaucuagucguuccuagguacgcuuuugccauggaacggaacgcagggucgggaaucauaauuucugauaccccagugcaugacugcaacacaaccugucaaacgccgaaaggcgcuaucaauacuucccuccccuuccagaacauucacccuaucacaaucgguaagugcccaaaguauguaaaaucaaccaagcugcgccuugccacugggcugagaaaugugcccaguauucagagcaggggauuguuuggcgcgauagccggcuucaucgaagggggauggacagguauggucgacggcugguacggguaucaucaccagaacgaacaaggauccggcuacgcagcugaucucaaaucuacccagaaugccauugacgagaucacgaacaaggugaauagcguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucaugauucaaacguaaagaaucuguacgagaagguucgaagucagcucaaaaacaacgcaaaggaaaucggcaauggauguuuugaguucuaucacaagugcgacaacacauguauggaauccgugaaaaauggcacuuacgauuauccuaaguacagcgaggaagccaaacugaacagagaggagauugacggggucaaacuugaaucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 125413 - RNA, 1701 nt, Artificial Sequence; identical to SEQ ID NO: 124672
  derived and/or modified sequence opt3 from hemagglutinin__InfluenzaA__ACV70874

SEQ ID NO: 125414 - RNA, 1701 nt, Artificial Sequence; identical to SEQ ID NO: 124865
  derived and/or modified sequence opt3 from hemagglutinin__InfluenzaA__ACV70884

SEQ ID NO: 125415 - RNA, 1701 nt, Artificial Sequence
  derived and/or modified sequence opt3 from hemagglutinin__InfluenzaA__ACV70904
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacauucccaguauacagagcaggggauuguuuggcgcgaucgccggcuucauugaagggggauggacugguaugguggacggcugguacggguaucaucaccagaaugaacaaggauccggcuacgcagcugaucucaaaucuacacagaacgccaucgacgagauaaccaauaaggucaacagcgugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauucaaaugugaaaaaccuguacgagaagguacgaagucagcucaaaaacaaugcaaaggaaauuggcaacggauguuuugaguucuaucacaagugcgacaauaccuguauggaauccguuaaaaacggcacauacgauuauccuaaguacagcgaggaagccaaacugaauagagaggagaucgacggggugaaacuugaaucuacuaggauuuaucaaauacuggcuaucuacucaaccgucgcgaguagcuuggugcucgucgugucccugggagcaauuucuuuuuggaugugcucgaacgguagcuuacagugccggaucuguaucuga

SEQ ID NO: 125416 - RNA, 1701 nt, Artificial Sequence; identical to SEQ ID NO: 124672
  derived and/or modified sequence opt3 from hemagglutinin__InfluenzaA__ACV70914

SEQ ID NO: 125417 - RNA, 1701 nt, Artificial Sequence; identical to SEQ ID NO: 124672
  derived and/or modified sequence opt3 from hemagglutinin__InfluenzaA__ACV70924

SEQ ID NO: 125418 - RNA, 1701 nt, Artificial Sequence; identical to SEQ ID NO: 124672
  derived and/or modified sequence opt3 from hemagglutinin__InfluenzaA__ACV70934

SEQ ID NO: 125419 - RNA, 1701 nt, Artificial Sequence; identical to SEQ ID NO: 124672
  derived and/or modified sequence opt3 from hemagglutinin__InfluenzaA__ACV70944

SEQ ID NO: 125420 - RNA, 1701 nt, Artificial Sequence
  derived and/or modified sequence opt3 from hemagglutinin__InfluenzaA__ACV70954
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuacucgucccuagguacgcuuuugccauggaacggaacgcagggucgggaaucauaauuucugauacuccaguucaugacugcaauaccacaugucaaaccccgaaaggcgcuaucaacacgucccugcccuuccagaauauucacccuaucacuaucgguaagugcccaaaguaugugaaaucaacaaaacuucgccuggccaccggguugagaaacguacccaguauucagagcaggggacucuuuggcgcgauagccggcuucaucgaagggggauggacugguaugguggacggcugguacggguaucaucaccagaaugaacaaggauccggcuacgcagcugaucugaagucuacacagaacgccauugacgagaucaccaauaaggucaacagcgugauagagaaaaugaauacgcaguuuaccgcuguugguaaggaguucaaccacuuagaaaagcggauugaaaaucugaacaaaaagguggaugacggguuccucgauaucuggacauacaaugccgagcuucuggucuugcuagaaaacgagcgcacucuggacuaucaugauucaaaugugaaaaaccucuacgagaagguacgaagucagcugaaaaacaaugcaaaggaaaucggcaacggauguuuugaguucuaucacaagugcgacaauaccuguauggaauccguuaaaaacggcacauacgauuauccuaaguacagcgaggaagccaaacuuaauagagaggagauugacggggugaagcuggaaucuacuaggaucuaucaaauuuuggcuauauacucaaccgucgcgaguagccucgugcuggucguguccuuaggagcaaucucuuuuuggaugugcucgaacgguagccugcagugccggauuuguaucuga

SEQ ID NO: 125421 - RNA, 1701 nt, Artificial Sequence; identical to SEQ ID NO: 124672
  derived and/or modified sequence opt3 from hemagglutinin__InfluenzaA__ACV70964

SEQ ID NO: 125422 - RNA, 1701 nt, Artificial Sequence; identical to SEQ ID NO: 124672
  derived and/or modified sequence opt3 from hemagglutinin__InfluenzaA__ACV70974

SEQ ID NO: 125423 - RNA, 1701 nt, Artificial Sequence; identical to SEQ ID NO: 125415
  derived and/or modified sequence opt3 from hemagglutinin__InfluenzaA__ACV70984

SEQ ID NO: 125424 - RNA, 1701 nt, Artificial Sequence; identical to SEQ ID NO: 125420
  derived and/or modified sequence opt3 from hemagglutinin__InfluenzaA__ACV70994

SEQ ID NO: 125425 - RNA, 1701 nt, Artificial Sequence; identical to SEQ ID NO: 124672
  derived and/or modified sequence opt3 from hemagglutinin__InfluenzaA__ACV71004

SEQ ID NO: 125426 - RNA, 1701 nt, Artificial Sequence
  derived and/or modified sequence opt3 from hemagglutinin__InfluenzaA__ACV82230
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagaucccaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaguaucaggcacugaaugugaccaugccaaacaacgagcaauucgacaaacuuuacauuuggggaguccaccaucccggcacagauaaggaccagaucuuuuuguaugcccaggcuagcggccguauuacugugucuaccaaaagaucccagcaaacaguaaucccuaauauagggucaaggccacggguucgcaacauucccagcagaaucaguauuuacuggaccaucgugaagccuggagauauccugcuaauuaauucuacggguaaccucauagccccaaggggcuacuucaaaauccaguccggaaagagcucgauuaugcggucugacgcgccgaucgggaaguguaauuccgagugcauaacucccaacggcucaauuccuaaugacaaaccauuucagaacgucaaucgcaucacauauggugcauguccccgauacgugaagcaaaacacccugaaacuugccacugggaugagaaaugugccugaaaagcagacaaggggaaucuucggcgcuauugccggcuuuaucgagaacgggugggaaggaauggucgaugguugguauggcuuccggcaccagaauagugaggggcguggacaggcagcugaccugaaaagcacccaagccgcgauugaucagauaaacggcaaguugaaucgccucaucgguaaaacgaacgagaaguuccaccagauugaaaaggaguuuuccgaaguugaggggagaauccaggaccuggaaaaauacguggaggauaccaagaucgacuuauggucuuauaacgccgagcugcucguagcacuugaaaaucaacauacaauugaucugacugacagcgagaugaacaaauuguucgaaaagaccaaaaagcagcuaagggagaaugcugaagauaugggcaacggaugcuuuaagauauaccacaaaugugacaaugccugcaucggcucaauucggaacgggacauaugaucaugacguguaccgagacgaggcucugaauaaccgcuuccagaucaagggagucgagcucaaaagugguuacaaggauuggauucuguggaucuccuuugccauaagcugcuuccuucuguguguggcauugcucggcuuuaucaugugggccugccagaaagggaauauuagauguaacaucugcauuuga

SEQ ID NO: 125427 - RNA, 1701 nt, Artificial Sequence
  derived and/or modified sequence opt3 from hemagglutinin__InfluenzaA__ACV82232
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaagcuguacauuuggggaguccaccauccuggcacagauaaagaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuauggugccuguccuagauacgugaaacaaaauacacugaaacuugcuaccgggaugaggaacgugccagagaagcagacucggggaaucuucggcgccauugcaggcuuuaucgaaaaugggugggagggaauggucgaugguugguauggcuuccgucaccagaacagugaggggcgcggacaagcugccgaccuuaagagcacacaggcggccauugaucagauaaauggcaaauugaacagacucaucgguaagaccaacgaaaaauuccaccagauugagaaggaauuuuccgagguugaagggaggauccaagaccuggagaaguacguggaggauacgaaaaucgacuuauggucuuauaaugcagaacugcucguagcucuugagaaccagcauaccauugaucugacagacagcgaaaugaauaaguuguucgagaaaacuaagaaacagcuacgggaaaacgccgaggauaugggcaauggaugcuuuaagauauaccacaagugugacaacgcuugcaucggcucaauucgaaaugggaccuaugaucaugacguguaccgcgacgaggcccugaacaauagauuccagaucaaaggagucgaacucaagagugguuacaaagauuggauucuguggaucuccuuugcaauaagcugcuuccuucuguguguggccuugcucggcuuuaucaugugggcuugccaaaaggggaacauuagguguaauaucugcauuuga

SEQ ID NO: 125428 - RNA, 1698 nt, Artificial Sequence
  derived and/or modified sequence opt3 from hemagglutinin__InfluenzaA__ACV82233
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacaaucacaacgggaaacuaugccuccugaagggaauagcgccccuucagcuggguaauuguucuguggccggcuggaucuuggggaacccugagugcgaacuccugauuucaaaagagaguuggagcuacaucguugaaaagccaaauccggagaacggaaccuguuaucccggccauuuugcugauuacgaggaacugagagagcaacucuccucugugucgucauucgaaagguuugagauuuucccuaaggagagcaguuggccaaaucacacugucacagguguguccgccucuugcagccauaacggggaaaauuccuuuuaucggaacuuacuguggcuuaccggcaaaaauggauuguaccccaaccugucaaagaguuaugcaaacaauaaagagaaggaaguucuaguacucuggggcgugcaccacccuccaaacaucgccgaccagaaaacgcuguaccauacugagaaugcuuacgucagcguggugucuucccacuauucacgcaaguucacccccgaaauagcaaagcgaccuaaaauccgugaucaggaggggagaauuaacuacuauuggacacuucuggagccaggagacacuaucauuuuugaagccaaugguaacuugaucgcuccgagguacgccuucgcgcucagccggggcuuugggaguggaauaauuaauucuaacgcacccauggauaagugugacgccaaaugccagaccccucaaggcgcuaucaauuccagccugccauuccagaacguccaucccguuacaauuggugaguguccuaaguaugugcgcucggccaaauuaagaaugguaaccgggcugaggaauaucccaucuauccagucccggggacucuuuggcgcaauugcuggcuucauagaagggggauggacggguaugguggauggcugguacggguaucaccaccagaacgagcaaggaucaggcuacgccgcggaccagaagaguacucagaaugccaucaacgguauuacaaauaaagucaacagcgugaucgaaaagaugaacacccaguuuacugcaguugggaaggaguucaauaaacuugagcgccgaauggaaaaccugaauaagaaaguggaugacggcuucauagauauuuggacauacaacgcugaguugcuaguccugcucgaaaaugagagaacccuggacuuucaugacuccaacgugaagaaucuuuaugaaaaaguaaagucucaacugaagaacaaugccaaagagaucggaaacggcugcuucgaguuuuaccacaaguguaaugaugaaugcauggagagcguuaaaaacgggacguaugacuaccccaaguauucagaagagaguaaauugaauagggagaagaucgauggagugaagcucgaauccaugggugucuaccagauucuggcuaucuauagcaccguggccucuucauuaguccugcuagugagucucggcgcaauuagcuucuggaugugcuccaacgggucucugcagugucggauaugcaucuga

SEQ ID NO: 125429 - RNA, 1701 nt, Artificial Sequence
  derived and/or modified sequence opt3 from hemagglutinin__InfluenzaA__ACV83662
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugauagagagggaaggaugaauuacuauuggacccugguggaacccggugacaagauuacauucgaggccacuggcaaccuagucguuccucgguacgcuuuugccauggugcgcaacgcagggagcggaaucauaauuucggauaccccaguacaugacugcaauacaaccugucagacgccgaaaggcgcuaucaacacuucucuccccuuccaaaauauucacccuaucacaaucgguaagugcccaaaguaugugaaauccaccaagcugagacuugccacugggcugaggaacguccccucaauucagagucggggauuguuuggcgcgauagccggcuucaucgaagggggauggacagguaugguggacggcugguacggguaucaucaccagaaugagcagggaagcggcuacgcagcugaucucaaauccacccaaaacgccauugacgaaaucacgaauaagguuaacucugugauagagaaaaugaauacccaguuuacagcugucgguaaggaguucaaccaccuggaaaagcgcauugagaauuuaaacaaaaagguggaugacggguuccuggauaucuggacuuacaaugccgaacuccuuguacuguuggagaacgaacgaacccuagacuaucaugauagcaauguuaaaaaccuguacgagaaggugagaucacagcucaaaaacaaugcaaaggagaucggcaacggauguuuugaguucuaucacaagugcgacaauacauguauggagagugucaaaaacggcacuuacgauuauccuaaguacuccgaagaggccaaacugaauagggaagagauugacggggugaaacuugagagcacccggaucuaucagauucuggcuauauacucuacagucgcgucaaguuuggugcucguugugagccugggagcaaucuccuuuuggaugugcucuaacgguucguuacaaugccguauuuguaucuga

SEQ ID NO: 125430 - RNA, 1701 nt, Artificial Sequence
  derived and/or modified sequence opt3 from hemagglutinin__InfluenzaA__ACV83663
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguggacaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugaugagaucacgaauaaggugaacucuguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacagcaauguaaagaaccuguacgagaagguucgaucacagcucaaaaacaaugcaaaggaaaucggaaacggcuguuuugaguucuaucacaagugcgauaauacauguauggaaagugugaaaaacgggacuuacgacuauccuaaguacuccgaggaagccaaacugaauagagaggagauugauggagucaaacuugaaagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 125431 - RNA, 1701 nt, Artificial Sequence; identical to SEQ ID NO: 125430
  derived and/or modified sequence opt3 from hemagglutinin__InfluenzaA__ACV83664

SEQ ID NO: 125432 - RNA, 1701 nt, Artificial Sequence
  derived and/or modified sequence opt3 from hemagglutinin__InfluenzaA__ACV83665
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgauugcugaucaacagagcuuguaccagaacgccgacgcguacguguucgucgggaguucucgcuauuccaaaaaguuuaaaccugagaucgcaauucgaccaaaggugcgugaucaggaaggaagaaugaauuacuauuggacucugguggagcccggugacaaaaucaccuucgaagccacaggcaaccuagucguuccuagguacgcuuuugccauggagcggaacgcagggagcggaauaauuaucucggauacuccagugcaugacugcaauaccacaugucaaaccccgaagggcgcuauuaacacgucucuccccuuccacaauauccauccuaucacuauugguaaaugcccaaaguauguaaaguccacaaaacugcgccuugccaccgggcugagaaacgugcccucaauacagaguaggggauuguuuggcgcgaucgccggcuucauugaagggggauggacugguauggucgacggcugguacggguaucaccaccagaaugagcagggaagcggcuacgcagcugaucucaaguccacacaaaacgccaucgacgagauaaccaauaaagugaacucuguuauugaaaagaugaauacgcaguuuaccgcuguggguaaagaguucaaccaucuggaaaagcggaucgagaauuuaaacaagaaagucgaugacggguuccuggauaucuggacauacaaugccgaacuccuugugcuguuggagaacgagcgcacucuagacuaucacgauagcaauguaaagaaccuguacgaaaaaguucgaucacagcucaagaacaaugcaaaagagauuggcaacggauguuuugaguucuaucauaagugcgacaauaccuguauggaaagugugaagaacggcacauacgauuauccuaaauacuccgaagaggccaagcugaauagagaggaaaucgacggggucaaacuugagagcacuaggauuuaucagauacuggcuaucuacucuaccguggcgucaaguuugguccucgugguuagccugggagcaauuuccuuuuggaugugcucuaacgguucguuacaaugccggaucuguaucuga

SEQ ID NO: 125433 - RNA, 1701 nt, Artificial Sequence
  derived and/or modified sequence opt3 from hemagglutinin__InfluenzaA__ACV83667
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguaaucaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 125434 - RNA, 1701 nt, Artificial Sequence; identical to SEQ ID NO: 124685
  derived and/or modified sequence opt3 from hemagglutinin__InfluenzaA__ACV83668

SEQ ID NO: 125435 - RNA, 1701 nt, Artificial Sequence; identical to SEQ ID NO: 124685
  derived and/or modified sequence opt3 from hemagglutinin__InfluenzaA__ACV83670

SEQ ID NO: 125436 - RNA, 1701 nt, Artificial Sequence; identical to SEQ ID NO: 124927
  derived and/or modified sequence opt3 from hemagglutinin__InfluenzaA__ACV83671

SEQ ID NO: 125437 - RNA, 1701 nt, Artificial Sequence; identical to SEQ ID NO: 125247
  derived and/or modified sequence opt3 from hemagglutinin__InfluenzaA__ACV88399

SEQ ID NO: 125438 - RNA, 1701 nt, Artificial Sequence; identical to SEQ ID NO: 125247
  derived and/or modified sequence opt3 from hemagglutinin__InfluenzaA__ACV88409

SEQ ID NO: 125439 - RNA, 1701 nt, Artificial Sequence; identical to SEQ ID NO: 124672
  derived and/or modified sequence opt3 from hemagglutinin__InfluenzaA__ACV88419

SEQ ID NO: 125440 - RNA, 1698 nt, Artificial Sequence; identical to SEQ ID NO: 125294
  derived and/or modified sequence opt3 from hemagglutinin__InfluenzaA__ACV89502

SEQ ID NO: 125441 - RNA, 1701 nt, Artificial Sequence
  derived and/or modified sequence opt3 from hemagglutinin__InfluenzaA__ACV89516
augaaggccagacugcucauccuucugugcgcuuuggcagccaccgacgcggauacaauuuguauaggcuaccacgcuaacaauagcacugacacgguggauaccgucuuagagaaaaacguuacagugacucauuccguaaaucugcuagaagacucucacaacgggaagcucugcaggcugaaaggaaucgccccgcuucagcuggguaaguguaauauugcaggcuggaucuuggggaacccugagugcgauucacuccugccagccaguagcugguccuauauuguggaaacccccaauucuaaaaacggaaucuguuaccccggcgacuucauagauuaugaggaacugcgggagcaacucucgucagucagcaguuuugagcgcuucgaaaucuuuccuaaggaguccucuuggccaaagcauagcacaaccaaaggugugacugcugcaugcucccacgccgggaagucaaguuucuaccgaaauuuacuguggcuuaccaaaaagggagacagcuaucccaaauugucuaacuccuacguuaauaagaagggcaaagaagugcugguccuauggggcgugcaucacccuucaagcaguaaggagcagcagacacucuaucagaacgagaaugcuuacguaucuguuguguccagcaacuacaaucguagauuuauuccagaaaucgccgagaggcccgaagucaaagaucaagcggggcggauuaacuauuacuggacgcugcuugagccuggagacacuaucauauucgaagcaaacgguaaucugguggccccaugguaugcuuuugccuugucgcgcggcuucgggucuggaauuaucaccuccaacgcaucaaugcacgaguguaauacaaagugccagacuccgcagggcgcuauuaacaguagccuccccuuucagaauauccauccugugaccaucggugaguguccaaaauacgucaaguccgccaaacugagaaugguuacaggguuaaggaacauucccucuauacaaagccggggacuguucggcgcgaucgccggcuuuauugaagggggauggaccgguaugaucgauggcugguauggguaccaccaucagaaugagcagggaucaggcuaugcagcugaccagaagaguacgcaaaacgccauaaaugguauuacuaacaagguaaauuccgugaucgagaaaaugaacacacaguucaccgcuguggggaaggaauuuaauaaccucgaaaaacgcauggagaaucuuaacaagaaagucgaugacggcuuccuggacaucuggacuuacaacgccgaguugcuagugcugcucgaaaaugagcgaacacuggauuuccacgacagcaacguuaagaaucuuuacgaaaaggugaaaauucagcugaagaacaaugcaaaagagaucggaaacggcugcuuugaguucuaucacaagugugauaaugaaugcauggagucugucagaaacgggaccuacgacuauccuaaauacucaaaggaaaguaaguugaauagggagaaaauugauggagugaagcucgaaagcauggguguauaucaaauacuggccaucuacuccacgguugcuucuucguuagugcugcuagucagccucggcgcgauuuccuuuuggaugugcucaaacgggagucugcagugucggaucugcaucuga

SEQ ID NO: 125442 - RNA, 1698 nt, Artificial Sequence
  derived and/or modified sequence opt3 from hemagglutinin__InfluenzaA__ACV90512
augaacgugaagcugcucguccuucugugcaccuucacagccacuuacgcugacacgaucuguauuggcuaucacgcaaauaacagcaccgauacaguugacacuguguuggagaaaaauguaaccgugacacauuccgucaacuuacuggaaaauucucacaacgggaagcuaugccuccugaaaggaauagcgccccuucagcuggguaauuguucaguggccggcuggaucuuggggaacccugagugcgaacuccugauuaguaaggagagcugguccuacaucguugaaaaaccaaauccggagaacggaaccuguuaucccggccauuuugcugauuacgaggaacugagagagcaacucucuucggugagcucauucgaaagguuugagauuuucccuaaggagaguuccuggccaaaucacacugucacaggugugucugccagcugcucccauaacggggaaaauucauuuuaucggaacuuacuguggcuuaccggaaagaauggcuuguaccccaaccugaguaaaagcuaugcaaacaauaaggagaaagaaguucuaguacucuggggcgugcaccacccuccaaacaucgccgaccagaagacgcuguaccauacugagaaugcuuacgucucugugguguccucacacuauagccgcaaauucacccccgaaauagcaaagcgaccuaagguccgugaucaggaggggagaaucaacuacuauuggacacuucuggagccaggagacacuauuaucuuugaagccaaugguaacuugauugcuccgagguacgccuucgcgcucagucggggcuuugggucuggaaucauaaauuccaacgcacccauugauaaaugggacgccaagugucagaccccucaaggcgcuaucaauagcucgcugccauuccagaacguucaucccgugacaauuggugaguggccuaaauauguacgcucugccaaguuaagaauggugaccgggcugaggaauaucccauccauccagucacggggacucuuuggcgcaauugcuggcuucauagaagggggauggacggguauggucgauggcugguacggguaucaccaccagaacgagcaaggaaguggcuacgccgcggaccagaaaagcacucagaaugccaucaacgguauuacaaauaagaugaacuccgugaucgaaaagaugaacacccaguuuacugcaguugggaaggaguucaauaaacuugagcgccgaauggaaaaccugaauaaaaagguggaugacggcuucauagauauuuggacauacaacgcugaguugcuaguccugcucgaaaaugagagaacccuggacuuucaugacucuaacgugaaaaaucuuuaugaaaagguaaaaagccaacugaagaacaaugccaaggagaucggaaacggcugcuucgaguuuuaccacaaauguaaugaugaaugcauggagucaguuaagaacgggacguaugacuaccccaaauauagugaagaguccaaguugaauagggagaaaaucgauggagugacccucgaaagcaugggugucuaccagauucuggcuaucuauucuacaguggccucaaguuuaguccugcuagugagccucggcgcaauuuccuucuggauguguucuaacgggucgcugcagugccggauaugcaucuga

SEQ ID NO: 125443 - RNA, 1701 nt, Artificial Sequence; identical to SEQ ID NO: 124685
  derived and/or modified sequence opt3 from hemagglutinin__InfluenzaA__ACV91672

SEQ ID NO: 125444 - RNA, 1701 nt, Artificial Sequence; identical to SEQ ID NO: 124685
  derived and/or modified sequence opt3 from hemagglutinin__InfluenzaA__ACV91676

SEQ ID NO: 125445 - RNA, 1701 nt, Artificial Sequence; identical to SEQ ID NO: 124685
  derived and/or modified sequence opt3 from hemagglutinin__InfluenzaA__ACV91680

SEQ ID NO: 125446 - RNA, 1701 nt, Artificial Sequence
  derived and/or modified sequence opt3 from hemagglutinin__InfluenzaA__ACX31591
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauaucaggcacugaaugugaccaugccaaacaacgagcaguucgacaagcuguacauuuggggaguccaccaucccggcacagauaaagaccaaaucuuuuuguaugcccaggcuagcggccguauuacugugucuaccaagagaucccagcagacaguaaucccuaauauagggucaaggccacggguucgcaacauucccagcagaaucaguauuuacuggaccaucgugaaaccuggagauauccugcuaauuaauucuacggguaaccucauagccccaaggggcuacuucaagauccaauccggaaagagcucgauuaugcggucugacgcgccgaucgggaaauguaauuccgagugcauaacucccaacggcucaauuccuaaugacaagccauuucagaacgucaaucgcaucacauauggugcauguccccgauacgugaaacagaacacccugaaacuugccacugggaugagaaaugugccugaaaaacaaacaaggggaaucuucggcgcuauugccggcuuuaucgagaacgggugggaaggaauggucgaugguugguauggcuuccggcaccagaauagugaggggcguggacaggcagcugaccuuaagagcacccaggccgcgauugaucaaauaaacggcaaauugaaucgccucaucgguaagacgaacgagaaguuccaccagauugaaaaagaguuuuccgaaguugaggggagaauccaggaccuggaaaaguacguggaggauaccaaaaucgacuuauggucuuauaacgccgagcugcucguagcacuugaaaaucagcauacaauugaucugacugacagcgagaugaacaaguuguucgaaaagaccaagaagcaacuaagggagaaugcugaagauaugggcaacggaugcuuuaaaauauaccacaagugugacaaugccugcaucggcucaauucggaacgggacauaugaucaugacguguaccgagacgaggcucugaauaaccgcuuccagaucaaaggagucgagcucaagagugguuacaaagauuggauucuguggaucuccuuugccauaagcugcuuccuucuguguguggcauugcucggcuuuaucaugugggccugccagaaggggaauauuagauguaacaucugcauuuga

SEQ ID NO: 125447 - RNA, 1701 nt, Artificial Sequence
  derived and/or modified sequence opt3 from hemagglutinin__InfluenzaA__ACX31933
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacguguucgucggaacuucucgcuauuccaagaaauuuaagccugagauugcaauccgaccaaaagugcgugaccaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugaugagaucacgaauaaggugaacucuguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacagcaauguaaagaaccuguacgagaagguucgaucacagcucaaaaacaaugcaaaggaaaucggaaacggcuguuuugaguucuaucacaagugcgauaauacauguauggaaagugugaaaaacgggacuuacgacuauccuaaguacuccgaggaagccaaacugaauagagaggagauuaacggagucaaacuugaaagcaccaggaucuaucaaauucuggcuauauacucuacaguggcgucaaguuugguccucgugguuagccugggugcaaucuccuuuuggaugugcucuaauggcucguuacagugccggauuuguaucuga

SEQ ID NO: 125448 - RNA, 1701 nt, Artificial Sequence
  derived and/or modified sequence opt3 from hemagglutinin__InfluenzaA__ACX31934
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauuaccauccgaccaaaagugcguggacaggaggguagaaugaauuacuauuggacacugguggaacccggcgauaagauuacuuucgaggcaaccgggaaccuagucguuccuagguacgccuuugcuauggaacggaacgccggaagcggcaucauaauuucggacacaccagugcaugauugcaauaccacgugucaaacuccgaaaggugcaaucaacacaucucuccccuuccagaauauucacccuaucaccaucgggaagugcccaaaguauguaaaauccacuaagcugcgccuugcuacaggacugagaaacgugcccucaauucagaguaggggcuuguuuggcgccauagcgggguucaucgagggagguuggaccggcauggucgacgggugguacggauaucaucaccagaaugaacaaggcagcgguuacgccgcagaccucaaauccacgcagaacgcuauugaugagaucaccaauaaggugaacucuguuauagagaaaaugaauacacaguuuacugccguggggaaggaguucaaccaccuggagaagcggauugaaaauuuaaacaaaaaggucgacgauggcuuccuggacaucuggaccuacaaugcugagcuccuugugcuguuggaaaacgagcgcacacuagauuaucaugacagcaauguaaagaaccuguacgagaagguucgaucacagcucaaaaacaaugccaaggaaaucggaaacggcuguuuugaguucuaucacaagugcgauaauacuuguauggaaagugugaaaaacgggaccuacgacuauccuaaguacuccgaggaagcaaaacugaauagagaggagauugauggagucaaacuugaaagcacaaggaucuaucaaauucuggccauauacucuaccguggcuucaaguuugguccucgugguuagccugggugcgaucuccuuuuggaugugcucuaacggcucguuacagugccggauuuguaucuga

SEQ ID NO: 125449 - RNA, 1701 nt, Artificial Sequence; identical to SEQ ID NO: 124685
  derived and/or modified sequence opt3 from hemagglutinin__InfluenzaA__ACX31935

SEQ ID NO: 125450 - RNA, 1701 nt, Artificial Sequence; identical to SEQ ID NO: 124685
  derived and/or modified sequence opt3 from hemagglutinin__InfluenzaA__ACX31936

SEQ ID NO: 125451 - RNA, 1701 nt, Artificial Sequence; identical to SEQ ID NO: 124776
  derived and/or modified sequence opt3 from hemagglutinin__InfluenzaA__ACX31939

SEQ ID NO: 125452 - RNA, 1701 nt, Artificial Sequence; identical to SEQ ID NO: 124776
  derived and/or modified sequence opt3 from hemagglutinin__InfluenzaA__ACX31940

SEQ ID NO: 125453 - RNA, 1701 nt, Artificial Sequence; identical to SEQ ID NO: 124685
  derived and/or modified sequence opt3 from hemagglutinin__InfluenzaA__ACX31943

SEQ ID NO: 125454 - RNA, 1701 nt, Artificial Sequence; identical to SEQ ID NO: 124685
  derived and/or modified sequence opt3 from hemagglutinin__InfluenzaA__ACX31946

SEQ ID NO: 125455 - RNA, 1701 nt, Artificial Sequence; identical to SEQ ID NO: 124685
  derived and/or modified sequence opt3 from hemagglutinin__InfluenzaA__ACX31947

SEQ ID NO: 125456 - RNA, 1701 nt, Artificial Sequence; identical to SEQ ID NO: 124685
  derived and/or modified sequence opt3 from hemagglutinin__InfluenzaA__ACX31948

SEQ ID NO: 125457 - RNA, 1701 nt, Artificial Sequence
  derived and/or modified sequence opt3 from hemagglutinin__InfluenzaA__ACX31949
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcauuauugcaauacaaccugucaaacgccgaaaggcgcuaucaacacuucucuccccuuccagaauauucacccuaucacaaucgguaagugcccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaucaccagaaugaacaaggaagcggcuacgcagcugaccucaaauccacccagaacgccauugaugagaucacgaauaaggugaacucuguuauagagaaaaugaauacccaguuuacagcuguggguaaggaguucaaccaccuggagaagcggauugaaaauuuaaacaaaaaggucgacgauggguuccuggacaucuggacuuauaaugccgagcuccuugugcuguuggaaaacgagcgcacccuagauuaccaugacagcaauguuaaaaaccuguaugaggaaguacgaucacagcucaagaacaaugcaaaagagaucggcaacggauguuuugaguucuaccacaagugcgauaauacauguauggagagugugaagaacggcacuuaugacuacccuaaauauuccgaagaggccaagcugaauagagaggaaauugauggggucaaacuugagagcaccaggaucuaccaaauucuggcuauauacucuacaguggcgucaaguuugguccucgugguuagccugggagcaaucuccuuuuggaugugcucuaacgguucguuacagugccggauuuguaucuga

SEQ ID NO: 125458 - RNA, 1701 nt, Artificial Sequence; identical to SEQ ID NO: 124685
  derived and/or modified sequence opt3 from hemagglutinin__InfluenzaA__ACX31950

SEQ ID NO: 125459 - RNA, 1701 nt, Artificial Sequence; identical to SEQ ID NO: 124685
  derived and/or modified sequence opt3 from hemagglutinin__InfluenzaA__ACX31951

SEQ ID NO: 125460 - RNA, 1701 nt, Artificial Sequence; identical to SEQ ID NO: 124685
  derived and/or modified sequence opt3 from hemagglutinin__InfluenzaA__ACX31954

SEQ ID NO: 125461 - RNA, 1701 nt, Artificial Sequence; identical to SEQ ID NO: 124685
  derived and/or modified sequence opt3 from hemagglutinin__InfluenzaA__ACX31955

SEQ ID NO: 125462 - RNA, 1701 nt, Artificial Sequence; identical to SEQ ID NO: 124672
  derived and/or modified sequence opt3 from hemagglutinin__InfluenzaA__ACX31956

SEQ ID NO: 125463 - RNA, 1701 nt, Artificial Sequence; identical to SEQ ID NO: 124685
  derived and/or modified sequence opt3 from hemagglutinin__InfluenzaA__ACX31957

SEQ ID NO: 125464 - RNA, 1701 nt, Artificial Sequence; identical to SEQ ID NO: 124672
  derived and/or modified sequence opt3 from hemagglutinin__InfluenzaA__ACX31958

SEQ ID NO: 125465 - RNA, 1701 nt, Artificial Sequence; identical to SEQ ID NO: 124927
  derived and/or modified sequence opt3 from hemagglutinin__InfluenzaA__ACX31960

SEQ ID NO: 125466 - RNA, 1701 nt, Artificial Sequence
  derived and/or modified sequence opt3 from hemagglutinin__InfluenzaA__ACX31961
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggucuucccgcuauagcaagaaauuuaagccugagauugcaauccgaccaaaagugcgugaucaggagggaagaaugaauuacuauuggacuuugguggaacccggugacaagauuaccuucgaggccacaggcaaccuggucguuccuagguacgcuuuugccauggaacggaacgcagggucgggaaucauaauuucugauacuccagugcaugacugcaauaccacaugucaaaccccgaaaggcgcuaucaacacgucccuacccuuccagaauauucacccuaucacuaucgguaagugcccaaaguauguaaaaucaacaaagcuccgccuggccaccgggcuuagaaacgugcccaguauucagagcaggggacuguuuggcgcgauagccggcuucaucgaagggggauggacugguauggucgacggcugguacggguaucaucaccagaaugaacaaggauccggcuacgcagcugauuugaaaucuacacagaacgccauugacgagaucaccaauaaggugaacagcguuauagagaaaaugaauacgcaguuuaccgcuguggguaaggaguucaaccaccucgagaagcggauugaaaaucugaacaaaaaggucgaugacggguucauggauaucuggacauacaaugccgaguuacuggugcuccuugaaaacgagcgcacucuggacuaucaugauucaaauguuaaaaacuuguacgagaagguacgaagucagcugaaaaacaaugcaaaggaaaucggcaacggauguuuugaguucuaucacaagugcgacaauaccuguauggaauccgugaaaaacggcacauacgauuauccuaaguacagcgaggaagccaaacuaaauagagaggagauugacggggucaagcucgaaucuacuaggaucuaucaaauucuggcuauauacucaaccguggcgaguagccuuguccuggugguuuccuugggagcaaucucuuuuuggaugugcucgaacgguagccuccagugccggauuuguaucuga

SEQ ID NO: 125467 - RNA, 1701 nt, Artificial Sequence; identical to SEQ ID NO: 124685
  derived and/or modified sequence opt3 from hemagglutinin__InfluenzaA__ACX31962

SEQ ID NO: 125468 - RNA, 1701 nt, Artificial Sequence; identical to SEQ ID NO: 124685
  derived and/or modified sequence opt3 from hemagglutinin__InfluenzaA__ACX31964

SEQ ID NO: 125469 - RNA, 1701 nt, Artificial Sequence; identical to SEQ ID NO: 124672
  derived and/or modified sequence opt3 from hemagglutinin__InfluenzaA__ACX35237

SEQ ID NO: 125470 - RNA, 1701 nt, Artificial Sequence; identical to SEQ ID NO: 124685
  derived and/or modified sequence opt3 from hemagglutinin__InfluenzaA__ACX35247

SEQ ID NO: 125471 - RNA, 1701 nt, Artificial Sequence; identical to SEQ ID NO: 124685
  derived and/or modified sequence opt3 from hemagglutinin__InfluenzaA__ACX35257

SEQ ID NO: 125472 - RNA, 1701 nt, Artificial Sequence; identical to SEQ ID NO: 124685
  derived and/or modified sequence opt3 from hemagglutinin__InfluenzaA__ACX35267

SEQ ID NO: 125473 - RNA, 1701 nt, Artificial Sequence; identical to SEQ ID NO: 124685
  derived and/or modified sequence opt3 from hemagglutinin__InfluenzaA__ACX35277

SEQ ID NO: 125474 - RNA, 1701 nt, Artificial Sequence; identical to SEQ ID NO: 124685
  derived and/or modified sequence opt3 from hemagglutinin__InfluenzaA__ACX35287

SEQ ID NO: 125475 - RNA, 1701 nt, Artificial Sequence; identical to SEQ ID NO: 124685
  derived and/or modified sequence opt3 from hemagglutinin__InfluenzaA__ACX35297

SEQ ID NO: 125476 - RNA, 1701 nt, Artificial Sequence
  derived and/or modified sequence opt3 from hemagglutinin__InfluenzaA__ACX35307
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccuggugggucccggcgacaagauuacauucgaagccacugggaaccuagucguuccuagguacgcuuuugccauggagcggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgaaggagguuggacaggcauggucgacgggugguacggauaucaucaccagaaugagcaaggcagcgguuacgcagcugaucucaaauccacccagaacgccauugacgaaaucacgaauaaggugaacucuguuauagagaaaaugaauacccaguuuacagcuguggggaaggaguucaaccaccuggaaaagcggauugagaauuuaaacaaaaaggucgaugacggcuuccuggauaucuggacuuacaaugccgaacuccuugugcuguuggagaacgaacgcacccuagacuaucaugauagcaauguaaagaaccuguacgagaagguucgaucacagcucaaaaacaaugcaaaggagaucggaaacggcuguuuugaguucuaucacaagugcgacaauacauguauggagagugugaaaaacgggacuuacgauuauccuaaguacuccgaagaggccaaacugaauagagaagagauugacggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 125477 - RNA, 1701 nt, Artificial Sequence; identical to SEQ ID NO: 124927
  derived and/or modified sequence opt3 from hemagglutinin__InfluenzaA__ACX35317

SEQ ID NO: 125478 - RNA, 1701 nt, Artificial Sequence
  derived and/or modified sequence opt3 from hemagglutinin__InfluenzaA__ACX35327
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacucuuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguaaagaaccuguacgagaagguucgaagucagcucaaaaacaaugccaaggaaaucggcaacggauguuuugaguucuaucacaagugcgacaauacauguauggaauccgugaaaaacggcacuuacgauuauccuaaguacagcgaggaagcaaaacugaauagagaggagauugacggggucaaacuugaaucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 125479 - RNA, 1701 nt, Artificial Sequence
  derived and/or modified sequence opt3 from hemagglutinin__InfluenzaA__ACX36501
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguauuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgaaaagcggaucgaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaauuggcaacggauguuuugaguucuaucacaagugcgacaauacauguauggaaagugugaaaaacggcacuuacgauuauccuaaguacuccgaggaagccaaacucaauagagaggagaucgacggggucaagcuggaaagcaccaggauuuaucaaauacuugcuaucuacucuacaguggcgucaagucuggucuuggugguuagccucggagcaauuuccuuuuggaugugcucuaacgguucgcugcagugccggaucuguaucuga

SEQ ID NO: 125480 - RNA, 1701 nt, Artificial Sequence
  derived and/or modified sequence opt3 from hemagglutinin__InfluenzaA__ACX36502
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguaucuaccagaacgccgacgcguacguuuucguggggacuucucgcuauuccaagaaauuuaagccugagauugcaauccgaccaaaaguccgugaucaggagggaagaaugaauuacuauuggaccuugguggaacccggugacaagauaacauucgaggccacuggcaaccugguggucccuagguacgcuuuugccauggaacggaacgcagggagcggaauuaucauuucggauaccccaguucaugacugcaauacaaccugucaaacgccgaaaggcgcuaucaacacuucucuacccuuccagaauauccacccuauuacaauagguaagugcccaaaguaugugaaauccaccaagcuccgccuggccacugggcuuagaaacguacccucaauccagaguaggggacuguuuggcgcgauugccggcuucaucgaagggggauggacagguaugguggacggcugguacggguaucaucaccagaaugaacaaggaagcggcuacgcagcugauuugaaauccacccagaacgccauagacgagauuacgaauaaggucaacucugugaucgagaaaaugaauacccaguuuacagcuguugguaaggaguucaaccaccucgaaaagcggaucgaaaaucugaacaaaaagguggaugacggguucuuagauauuuggacuuacaaugccgagcugcucguccuucuggaaaacgagcgcaccuuggacuaucaugauagcaaugugaaaaaccuauacgagaagguacgaucacagcugaaaaacaaugcaaaggaaaucggcaacggauguuuugaguucuaucacaagugcgacaauacauguauggaaaguguuaaaaacggcacuuacgauuauccuaaguacuccgaggaagccaaacucaauagagaggagauugacggggugaagcuggaaagcaccaggauauaucaaauccuugcuauuuacucuacagucgcgucaagucugguguuggucgugagccucggagcaaucuccuuuuggaugugcucuaacgguucgcugcagugccggaucuguauuuga

SEQ ID NO: 125481 - RNA, 1701 nt, Artificial Sequence
  derived and/or modified sequence opt3 from hemagglutinin__InfluenzaA__ACX36503
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguaucuaccagaacgccgacgcguacguuuucguggggacuucucgcuauuccaagaaauuuaagccugagauugcaauccgaccaaaaguccgugaucaggagggaagaaugaauuacuauuggaccuugguggaacccggugacaagauaacauucgaggccacuggcaaccugguggucccuagguacgcuuuugccauggaacggaacgcagggagcggaauuaucauuucggauaccccaguucaugacugcaauacaaccugucaaacgccgaaaggcgcuaucaacacuucucuacccuuccagaauauccacccuauuacaauagguaagugcccaaaguaugugaaauccaccaagcuccgccuggccacugggcuuagaaacguacccucaauccagaguaggggacuguuuggcgcgauugccggcuucaucgaagggggauggacagguaugguggacggcugguacggguaucaucaccagaaugaacaaggaagcggcuacgcagcugauuugaaauccacccagaacgccauagacgagauuacgaauaaggucaacucugugaucgagaaaaugaauacccaguuuacagcuguugguaaggaguucaaccaccucgaaaagcggaucgaaaaucugaacaaaaagguggaugacggguucuuagauauuuggacuuacaaugccgagcugcucguccuucuggaaaacgagcgcaccuuggacuaucaugauagcaaugugaaaaaccuauacgagaagguacgaucacagcugaaaaacaauacaaaggaaaucggcaacggauguuuugaguucuaucacaagugcgacaauacuuguauggaaaguguuaaaaacggcaccuacgauuauccuaaguacuccgaggaagcaaaacucaauagagaggagauugacggggugaagcuggaaagcacaaggauauaucaaauccuugccauuuacucuaccgucgcuucaagucugguguuggucgugagccucggagcgaucuccuuuuggaugugcucuaacgguucgcugcagugccggaucuguauuuga

SEQ ID NO: 125482 - RNA, 1701 nt, Artificial Sequence
  derived and/or modified sequence opt3 from hemagglutinin__InfluenzaA__ACX47367
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucuggugaagccuggugacaaaauuacauucgaagccacuggcaaccuagucguuccaagguacgcuuuugccauggagcggaacgcaggguccggaaucauaauuagcgauaccccggugcaugacugcaauacaaccugucaaacgcccaagggcgcuaucaacacuucgcucccuuuccagaauauucacccaaucacaaucgguaagugccccaaauauguaaagucuaccaaacugcgccuugccacugggcugagaaacgugccuuccauucagucaaggggauuguuuggcgcgauagccggcuucaucgaagggggauggacagguauggucgacggcugguacggguaucaucaccagaaugagcaaggaaguggcuacgcagcugaucucaagagcacccagaacgccauugacgaaaucacgaauaaagugaacuccguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggcaacggauguuuugaguucuaucacaaaugcgacaauacauguauggagucagugaagaacggcacuuacgauuauccaaaauacagugaagaggccaagcugaauagagaagagauugacggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 125483 - RNA, 1701 nt, Artificial Sequence
  derived and/or modified sequence opt3 from hemagglutinin__InfluenzaA__ACX47368
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucuaauguaaagaaccuguacgagaagguucgaagccagcucaaaaacaaugcaaaggaaaucggcaacggauguuuugaguucuaucacaagugcgacaauacauguauggaaucagugaaaaacggcacuuacgauuauccaaaguacagugaggaagccaaacugaauagagaggagauugacggggucaaacuugaauccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 125484 - RNA, 1701 nt, Artificial Sequence; identical to SEQ ID NO: 125483
  derived and/or modified sequence opt3 from hemagglutinin__InfluenzaA__ACX47369

SEQ ID NO: 125485 - RNA, 1701 nt, Artificial Sequence
  derived and/or modified sequence opt3 from hemagglutinin__InfluenzaA__ACX47370
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucgccaaaguuuguaccagaacgccgacgcguacguguucgucgggacuagccgauauucuaagaaauuuaagccagagauugcaauccgucccaaagugagagaucaggagggaaggaugaauuacuauuggacccugguggaaccuggugacaagauuacauucgaggccacuggcaaccuagucguuccacgguacgcuuuugccauggaacgcaacgcaggguccggaaucauaauuagcgauaccccggugcaugacugcaauacaaccugucagacgcccaaaggcgcuaucaacacuucgcucccuuuccaaaauauucacccaaucacaaucgguaagugccccaaguauguaaaaucuaccaagcugagacuugccacugggcugaggaacgugccuuccauucagucacggggauuguuuggcgcgauagccggcuucaucgaagggggauggacagguauggucgacggcugguacggguaucaucaccagaaugaacagggaaguggcuacgcagcugaucucaaaagcacccaaaacgccauugacgagaucacgaauaaggugaacuccguuauagagaaaaugaauacccaguuuacagcuguggguaaggaguucaaccaccuggaaaagcgcauugaaaauuuaaacaaaaaggucgaugacggguuccuggauaucuggacuuacaaugccgagcuccuugugcuguuggaaaacgagcgaacccuagacuaucaugauucuaauguaaagaaccuguacgagaagguuagaagccagcucaaaaacaaugcaaaggaaaucggcaacggauguuuugaguucuaucacaagugcgacaauacauguauggaaucagugaaaaacggcacuuacgauuauccaaaguacagugaggaagccaaacugaauagggaggagauugacggggucaaacuugaauccacccggaucuaucagauucuggcuauauacagcacaguggcgucuucauugguccucgugguuagucugggagcaaucagcuuuuggaugugcuccaacgguucuuuacaaugccguauuuguaucuga

SEQ ID NO: 125486 - RNA, 1701 nt, Artificial Sequence; identical to SEQ ID NO: 125483
  derived and/or modified sequence opt3 from hemagglutinin__InfluenzaA__ACX47371

SEQ ID NO: 125487 - RNA, 1701 nt, Artificial Sequence; identical to SEQ ID NO: 125483
  derived and/or modified sequence opt3 from hemagglutinin__InfluenzaA__ACX47372

SEQ ID NO: 125488 - RNA, 1701 nt, Artificial Sequence; identical to SEQ ID NO: 125483
  derived and/or modified sequence opt3 from hemagglutinin__InfluenzaA__ACX47373

SEQ ID NO: 125489 - RNA, 1701 nt, Artificial Sequence; identical to SEQ ID NO: 125483
  derived and/or modified sequence opt3 from hemagglutinin__InfluenzaA__ACX47374

SEQ ID NO: 125490 - RNA, 1701 nt, Artificial Sequence
  derived and/or modified sequence opt3 from hemagglutinin__InfluenzaA__ACX47375
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggacuucccgcuauucuaagaaauuuaagccagagauugcaauccgacccaaagugcgugaucaggagggaagaaugaauuacuauuggacccugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaacggcgcuaucaauacuucgcucccuuuccagaacauucacccaaucacaaucgguaaaugccccaaguauguaaagucuaccaaacugcgccuugccacugggcugagaaaugugccuuccauucagucaaggggauuguuuggcgcgauagccggcuucaucgaagggggauggacagguauggucgacggcugguacggguaucaucaccagaacgaacaaggaaguggcuacgcagcugaucucaagagcacccagaaugccauugacgagaucacgaacaaagugaauaguguuauagagaagaugaacacccaguuuacagcuguggguaaagaguucaaucaccuggaaaagcggauugaaaacuuaaauaagaaagucgaugacggguuccuggauaucuggacuuacaacgccgagcuccuugugcuguuggaaaaugagcgcacccuagacuaucaugauucuaacguaaagaaccuguacgagaaaguucgaagccagcucaagaauaacgcaaaagaaaucggcaauggauguuuugaguucuaucacaagugcgacaacacauguauggaaucagugaagaauggcacuuacgauuauccaaaauacagugaggaagccaagcugaacagagaggagauugacggggucaaacuugaauccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 125491 - RNA, 1701 nt, Artificial Sequence; identical to SEQ ID NO: 125483
  derived and/or modified sequence opt3 from hemagglutinin__InfluenzaA__ACX47376

SEQ ID NO: 125492 - RNA, 1701 nt, Artificial Sequence; identical to SEQ ID NO: 125483
  derived and/or modified sequence opt3 from hemagglutinin__InfluenzaA__ACX47377

SEQ ID NO: 125493 - RNA, 1701 nt, Artificial Sequence
  derived and/or modified sequence opt3 from hemagglutinin__InfluenzaA__ACX47380
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacaaccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugugauggaacggaacgcugggagcggaaucauaauuucggauacaccaguacaugacugcaauaccacgugucaaacuccgaaaggcgccaucaacacaucucuccccuuccagaauauucacccuaucaccaucgguaagugcccaaaguaugugaaauccacuaagcugcgccuugcaacagggcugagaaacguccccucaauucagaguaggggauuguuuggcgcuauagccggcuucaucgaagggggauggaccgguaugguggacggcugguacggguaucaucaccagaaugaacaaggaagcggcuacgcggccgaucucaaauccacgcagaacgcaauugacgagaucaccaauaagguuaacucugugauagagaaaaugaauacacaguuuacugcugucgguaaggaguucaaccaccuggaaaagcggauugaaaauuuaaacaaaaagguggaugacggguuccuggauaucuggaccuacaaugccgagcuccuuguacuguuggaaaacgagcgcacacuagacuaucaugauagcaauguuaaaaaccuguacgagaaggugcgaucacagcucaaaaacaaugcuaaggaaaucggcaacggauguuuugaguucuaucacaagugcgacaauacuuguauggaaagugucaaaaacggcaccuacgauuauccuaaguacuccgaggaagccaaacugaauagagaggagauugacggggugaaacuugaaagcacaaggaucuaucaaauucuggcaauauacucuaccgucgccucaaguuuggugcucguugugagccugggagcuaucuccuuuuggaugugcucuaacgguucguuacagugccggauuuguaucuga

SEQ ID NO: 125494 - RNA, 1701 nt, Artificial Sequence; identical to SEQ ID NO: 125493
  derived and/or modified sequence opt3 from hemagglutinin__InfluenzaA__ACX47381

SEQ ID NO: 125495 - RNA, 1701 nt, Artificial Sequence; identical to SEQ ID NO: 125493
  derived and/or modified sequence opt3 from hemagglutinin__InfluenzaA__ACX47382

SEQ ID NO: 125496 - RNA, 1701 nt, Artificial Sequence
  derived and/or modified sequence opt3 from hemagglutinin__InfluenzaA__ACX47383
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacaaccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguuaaaaaccuguacgagaagguacgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagagaagauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 125497 - RNA, 1701 nt, Artificial Sequence
  derived and/or modified sequence opt3 from hemagglutinin__InfluenzaA__ACX47384
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacaaccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 125498 - RNA, 1701 nt, Artificial Sequence; identical to SEQ ID NO: 125497
  derived and/or modified sequence opt3 from hemagglutinin__InfluenzaA__ACX47385

SEQ ID NO: 125499 - RNA, 1701 nt, Artificial Sequence; identical to SEQ ID NO: 125497
  derived and/or modified sequence opt3 from hemagglutinin__InfluenzaA__ACX47387

SEQ ID NO: 125500 - RNA, 1701 nt, Artificial Sequence; identical to SEQ ID NO: 124685
  derived and/or modified sequence opt3 from hemagglutinin__InfluenzaA__ACX55834

SEQ ID NO: 125501 - RNA, 1701 nt, Artificial Sequence; identical to SEQ ID NO: 125483
  derived and/or modified sequence opt3 from hemagglutinin__InfluenzaA__ACX61574

SEQ ID NO: 125502 - RNA, 1701 nt, Artificial Sequence; identical to SEQ ID NO: 124685
  derived and/or modified sequence opt3 from hemagglutinin__InfluenzaA__ACX61575

SEQ ID NO: 125503 - RNA, 1701 nt, Artificial Sequence
  derived and/or modified sequence opt3 from hemagglutinin__InfluenzaA__ACX83577
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuuucaacaaguagcuccuggucuuacauuguugagaccucgucaagcgacaacggaacuugcuauccaggcgauuucaucgacuacgaagaguugagggagcagcucaguuccgugucuagcuuugaacgguucgagauuuuuccgaagacauccucauggcccaaucacgauaguaacaagggugucaccgcagccuguccucaugcuggggcaaagagcuucuauaaaaaucugaucuggcuggugaaaaagggaaacucuuacccaaaacucuccaagucauauauaaaugacaagggcaaagaaguauuaguucuguggggcauccaccaccccagcacgagugccgaucaacagucucuuuaccagaacgcugacgccuacguguuugucgggacuucccgcuauagcaagaaauucaagccugagauugcgauccgaccaaaagugcguggacaggaggguagaaugaauuacuauuggaccuugguggaacccggcgauaagauuacauuugaggcaacugggaaccuggucguuccuagguacgccuucgcuauggaacggaacgccggaucgggcaucauaauuucugacaccccagugcaugauugcaauacaaccugucaaacgccgaaaggugcaaucaacacuucccuacccuuucagaauauucacccuaucacaaucgggaagugcccaaaguauguaaaaucaaccaagcuccgccuggcuacuggacuuagaaacgugcccaguauucagagcaggggccuguucggcgccauagcgggguuuaucgagggagguuggacaggcauggucgacgggugguacggauaucaucaccagaaugaacaaggcuccgguuacgccgcagacuugaaaucuacccagaacgcuauugaugagaucacgaauaaggugaacagcguuauagagaaaaugaauacccaguucacagccguggggaaggaguucaaccaccucgaaaagcggauugaaaaucugaacaaaaaggucgacgauggcuuuuuagacaucuggacuuacaaugcugagcugcucgugcuucuggaaaacgagcgcaccuuggauuaucaugacucaaauguuaaaaaccuauacgagaagguacgaagucagcugaaaaacaaugccaaggaaaucggaaacggcuguuucgaguuuuaucacaagugcgauaauacauguauggaauccgugaaaaacgggacuuacgacuauccuaaguacagcgaggaagcaaaacucaauagagaggagauugauggagucaagcuggaaucuaccaggaucuaucaaauucuugccauauacucaacaguggcuaguagccuggucuuggugguuucccucggugcgaucucuuucuggaugugcucgaacggcagccugcagugccggauuuguaucuga

SEQ ID NO: 125504 - RNA, 1701 nt, Artificial Sequence
  derived and/or modified sequence opt3 from hemagglutinin__InfluenzaA__ACX94091
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaaucagcuggcccaaucacgauuccaacaagggugucaccgccgcuuguccucaugcaggggccaaaucauuuuauaagaaucugauauggcucgugaaaaagggaaacaguuacccaaaauuaagcaagucuuauaucaaugacaagggcaaagaaguacugguucuuuggggcauucaccaccccuccacgucagcugaucaacagagcuuguaccagaacgccgacgcguacguguucgucgggaccagucgcuauucuaagaaauuuaagccugagaucgcaauucgaccaaaagugcgugaucaggagggaagaaugaauuacuauuggacucugguggaacccggugacaagaucacauucgaggccacuggcaaccuagucguuccuagguacgcuuuugccauggaacggaacgcaggguccggaauaauuaucagcgauaccccagugcaugacugcaauacaaccugucaaacgccgaaaggcgcuauuaacacuucgcuccccuuccagaauauccacccuaucacaauugguaagugcucuaaguauguaaaauccaccaagcugcgccuugccacugggcugagaaacgugccaucaauacagaguaggggauuguuuggcgcgaucgccggcuucauugaagggggauggacagguauggucgacggcugguacggguaucaucaccagaaugaacaaggaagcggcuacgcagcugaucucaaauccacccagaacgccaucgacgagauaacgaauaaggugaacucuguuauugagaaaaugaauacccaguuuacagcuguggguaaggaguucaaccaccuggaaaagcggaucgaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaauuggcaacggauguuuugaguucuaucacaagugcgacaauacauguauggaaagugugaaaaacggcacuuacgauuaucccaaguacuccgaggaagccaaacugaauagagaggagaucgacggggucaaacuugaaagcaccaggauuuaucaaauacuggcuaucuacucuacaguggcgucaaguuugguccucgugguuagccugggagcaauuuccuuuuggaugugcucuaacgguucguuacagugccggaucuguaucuga

SEQ ID NO: 125505 - RNA, 1701 nt, Artificial Sequence
  derived and/or modified sequence opt3 from hemagglutinin__InfluenzaA__ACY26192
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcauaauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccaggaugccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 125506 - RNA, 1701 nt, Artificial Sequence; identical to SEQ ID NO: 125254
  derived and/or modified sequence opt3 from hemagglutinin__InfluenzaA__ACY26202

SEQ ID NO: 125507 - RNA, 1701 nt, Artificial Sequence; identical to SEQ ID NO: 124685
  derived and/or modified sequence opt3 from hemagglutinin__InfluenzaA__ACY46103

SEQ ID NO: 125508 - RNA, 1701 nt, Artificial Sequence; identical to SEQ ID NO: 124685
  derived and/or modified sequence opt3 from hemagglutinin__InfluenzaA__ACY46113

SEQ ID NO: 125509 - RNA, 1701 nt, Artificial Sequence
  derived and/or modified sequence opt3 from hemagglutinin__InfluenzaA__ACY46123
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugggagaucaggagggucguaugaauuacuauuggacccugguggaacccggcgacaagauuacauucgaggccacugggaaccuagucguuccuagauacgcuuuugccauggaaaggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcggcuugccacuggacugcgcaacgugcccucaauucagaguagaggcuuguuuggcgcgauagccggguucaucgagggagguuggacaggcauggucgacgggugguacggauaucaucaccagaaugaacaaggcagcgguuacgcagcugaucucaaauccacccagaacgccauugacgagaucacgaauaaggugaacucuguuauagagaaaaugaauacccaguuuacagcuguggggaaggaguucaaccaccuggagaagaggauugaaaauuuaaacaaaaaggucgaugacggcuuccuggauaucuggacuuacaaugccgagcuccuugugcuguuggaaaacgagcggacccuagacuaucaugauagcaauguaaagaaccuguacgagaagguucgcucacagcucaaaaacaaugcaaaggaaaucggaaacggcuguuuugaguucuaucacaagugcgacaauacauguauggaaagugugaaaaacgggacuuacgauuauccuaaguacuccgaggaagccaaacugaaucgagaggagauugacggagucaaacuugaaagcaccagaaucuaucaaauucuggcuauauacucuacaguggcgucaaguuugguccucgugguuagccugggugcaaucuccuuuuggaugugcucuaacggcucguuacagugcaggauuuguaucuga

SEQ ID NO: 125510 - RNA, 1701 nt, Artificial Sequence; identical to SEQ ID NO: 124685
  derived and/or modified sequence opt3 from hemagglutinin__InfluenzaA__ACY46133

SEQ ID NO: 125511 - RNA, 1701 nt, Artificial Sequence; identical to SEQ ID NO: 124685
  derived and/or modified sequence opt3 from hemagglutinin__InfluenzaA__ACY46163

SEQ ID NO: 125512 - RNA, 1701 nt, Artificial Sequence
  derived and/or modified sequence opt3 from hemagglutinin__InfluenzaA__ACY46173
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuuccaaguauagcaaaaaguuuaaaccugagauugcaauccgcccaaaggugcgagaucaggagggacguaugaauuacuauuggacucugguggaacccggugacaaaauuaccuucgaggccacaggcaaccuagucguuccuagauacgcuuuugccauggaaaggaacgcagggucgggaaucauaauuucugauacuccagugcaugacugcaauaccacaugucaaaccccgaagggcgcuaucaacacgucccuccccuuccagaauauucacccuaucacuaucgguaagugcccaaaauauguaaagucaacaaaacugcggcuugccaccgggcugcgcaacgugcccaguauucagagcagaggauuguuuggcgcgauagccggcuucaucgaagggggauggacugguauggucgacggcugguacggguaucaucaccagaaugaacaaggauccggcuacgcagcugaucucaagucuacacagaacgccauugacgagaucaccaauaaagugaacagcguuauagagaagaugaauacgcaguuuaccgcuguggguaaggaauuuaaccaccuggagaaaaggauugaaaauuuaaacaagaaagucgaugacggguuccuggauaucuggacauacaaugccgagcuccuugugcuguuggaaaacgagcggacucuagacuaucaugauucaaauguaaagaaccuguacgagaaaguucgcagucagcucaagaacaaugcaaaggaaaucggcaacggauguuucgaguucuaucacaaaugcgacaauaccuguauggaauccgugaagaacggcacauacgauuauccuaaauacagcgaggaagccaagcugaaucgagaggagauugacggggucaaacuugaaucuacuagaaucuaucaaauucuggcuauauacucaaccguggcgaguagcuugguccucgugguuucccugggagcaaucucuuuuuggaugugcucgaacgguagcuuacagugcaggauuuguaucuga

SEQ ID NO: 125513 - RNA, 1701 nt, Artificial Sequence; identical to SEQ ID NO: 124685
  derived and/or modified sequence opt3 from hemagglutinin__InfluenzaA__ACY46213

SEQ ID NO: 125514 - RNA, 1701 nt, Artificial Sequence; identical to SEQ ID NO: 124685
  derived and/or modified sequence opt3 from hemagglutinin__InfluenzaA__ACY46223

SEQ ID NO: 125515 - RNA, 1701 nt, Artificial Sequence; identical to SEQ ID NO: 124685
  derived and/or modified sequence opt3 from hemagglutinin__InfluenzaA__ACY46233

SEQ ID NO: 125516 - RNA, 1701 nt, Artificial Sequence; identical to SEQ ID NO: 124685
  derived and/or modified sequence opt3 from hemagglutinin__InfluenzaA__ACY46243

SEQ ID NO: 125517 - RNA, 1701 nt, Artificial Sequence; identical to SEQ ID NO: 124685
  derived and/or modified sequence opt3 from hemagglutinin__InfluenzaA__ACY46253

SEQ ID NO: 125518 - RNA, 1701 nt, Artificial Sequence; identical to SEQ ID NO: 124685
  derived and/or modified sequence opt3 from hemagglutinin__InfluenzaA__ACY46263

SEQ ID NO: 125519 - RNA, 1701 nt, Artificial Sequence; identical to SEQ ID NO: 124685
  derived and/or modified sequence opt3 from hemagglutinin__InfluenzaA__ACY46273

SEQ ID NO: 125520 - RNA, 1701 nt, Artificial Sequence; identical to SEQ ID NO: 124685
  derived and/or modified sequence opt3 from hemagglutinin__InfluenzaA__ACY46283

SEQ ID NO: 125521 - RNA, 1701 nt, Artificial Sequence
  derived and/or modified sequence opt3 from hemagglutinin__InfluenzaA__ACY46293
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccgcggggcugagaaacgugcccucaauucagaguaggggauuguuuggcgccauagcaggcuucaucgaagggggauggacugguauggucgacggcugguacggguaucaucaccagaaugaacaaggaagcggcuacgcugccgaucucaaauccacacagaacgcuauugacgagaucaccaauaaggugaacucuguuauagagaaaaugaauacgcaguuuaccgccguggguaaggaguucaaccaccuggaaaagcggauugaaaauuuaaacaaaaaggucgaugacggguuccuggauaucuggacauacaaugcagagcuccuugugcuguuggaaaacgagcgcacucuagacuaucaugauagcaauguaaagaaccuguacgagaagguucgaucacagcucaaaaacaaugccaaggaaaucggcaacggauguuuugaguucuaucacaagugcgacaauaccuguauggaaagugugaaaaacggcacauacgauuauccuaaguacuccgaggaagcuaaacugaauagagaggagauugacggggucaaacuugaaagcacuaggaucuaucaaauucuggcgauauacucuaccguggcaucaaguuugguccucgugguuagccugggagccaucuccuuuuggaugugcucuaacgguucguuacagugccggauuuguaucuga

SEQ ID NO: 125522 - RNA, 1701 nt, Artificial Sequence; identical to SEQ ID NO: 124685
  derived and/or modified sequence opt3 from hemagglutinin__InfluenzaA__ACY46303

SEQ ID NO: 125523 - RNA, 1701 nt, Artificial Sequence; identical to SEQ ID NO: 124685
  derived and/or modified sequence opt3 from hemagglutinin__InfluenzaA__ACY46313

SEQ ID NO: 125524 - RNA, 1701 nt, Artificial Sequence; identical to SEQ ID NO: 124685
  derived and/or modified sequence opt3 from hemagglutinin__InfluenzaA__ACY46323

SEQ ID NO: 125525 - RNA, 1701 nt, Artificial Sequence; identical to SEQ ID NO: 124685
  derived and/or modified sequence opt3 from hemagglutinin__InfluenzaA__ACY46343

SEQ ID NO: 125526 - RNA, 1701 nt, Artificial Sequence; identical to SEQ ID NO: 124685
  derived and/or modified sequence opt3 from hemagglutinin__InfluenzaA__ACY46353

SEQ ID NO: 125527 - RNA, 1701 nt, Artificial Sequence
  derived and/or modified sequence opt3 from hemagglutinin__InfluenzaA__ACY46373
augaaggccauccugauugugcuccuuuacaccuucgcuacagcaaacgccgacacucugugcauaggcuaucacgcgaauaacagcacggauaccgucgacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 125528 - RNA, 1701 nt, Artificial Sequence
  derived and/or modified sequence opt3 from hemagglutinin__InfluenzaA__ACY46383
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccacaauauucauccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaccaccagaaugaacagggauccggcuacgcagcugaucucaaaucuacacaaaacgccauugacgagaucaccaauaaggugaacagcguuauagagaaaaugaauacgcaguuuaccgcuguggguaaggaguucaaccaucuggaaaagcggauugaaaauuuaaacaaaaaggucgaugacggguuccuggauaucuggacauacaaugccgagcuccuugugcuguuggaaaacgagcgcacucuagacuaucacgauucaaauguaaagaaccuguacgagaagguucgaagucagcucaaaaacaaugcaaaggaaaucggcaacggauguuuugaguucuaucauaagugcgacaauaccuguauggaauccgugaaaaacggcacauacgauuauccuaaguacagcgaggaagccaaacugaauagagaggagauugacggggucaaacuugaaucuacuaggaucuaucagauucuggcuauauacucaaccguggcgaguagcuugguccucgugguuucccugggagcaaucucuuuuuggaugugcucgaacgguagcuuacaaugccggauuuguaucuga

SEQ ID NO: 125529 - RNA, 1701 nt, Artificial Sequence; identical to SEQ ID NO: 124685
  derived and/or modified sequence opt3 from hemagglutinin__InfluenzaA__ACY46393

SEQ ID NO: 125530 - RNA, 1701 nt, Artificial Sequence; identical to SEQ ID NO: 124685
  derived and/or modified sequence opt3 from hemagglutinin__InfluenzaA__ACY46403

SEQ ID NO: 125531 - RNA, 1701 nt, Artificial Sequence; identical to SEQ ID NO: 124685
  derived and/or modified sequence opt3 from hemagglutinin__InfluenzaA__ACY46413

SEQ ID NO: 125532 - RNA, 1701 nt, Artificial Sequence; identical to SEQ ID NO: 124685
  derived and/or modified sequence opt3 from hemagglutinin__InfluenzaA__ACY46433

SEQ ID NO: 125533 - RNA, 1701 nt, Artificial Sequence; identical to SEQ ID NO: 124685
  derived and/or modified sequence opt3 from hemagglutinin__InfluenzaA__ACY46443

SEQ ID NO: 125534 - RNA, 1701 nt, Artificial Sequence; identical to SEQ ID NO: 124685
  derived and/or modified sequence opt3 from hemagglutinin__InfluenzaA__ACY46453

SEQ ID NO: 125535 - RNA, 1701 nt, Artificial Sequence
  derived and/or modified sequence opt3 from hemagglutinin__InfluenzaA__ACY46463
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggacuucucgcuauuccaagaaauuuaagccugagauugcaauccgaccaaaagugcgugaucaggagggaagaaugaauuacuauuggaccuugguggaacccggugacaagauuacauucgaggccacuggcaaccuggucguuccuagguacgcuuuugccauggugcggaacgcagggagcggaaucauaauuucggauaccccaguacaugacugcaauacaaccugucaaacgccgaaaggcgcuaucaacacuucucuacccuuccagaauauucacccuaucacaaucgguaagugcccaaaguaugugaaauccaccaagcuccgccuggccacugggcuuagaaacguccccucaauucagaguaggggacuguuuggcgcgauagccggcuucaucgaagggggauggacagguaugguggacggcugguacggguaucaucaccagaaugagcaaggaagcggcuacgcagcugauuugaaauccacccagaacgccauugacgaaaucacgaauaagguuaacucugugauagagaaaaugaauacccaguuuacagcugucgguaaggaguucaaccaccucgaaaagcggauugagaaucugaacaaaaagguggaugacggguucuuagauaucuggacuuacaaugccgaacugcucguacuucuggagaacgaacgcaccuuggacuaucaugauagcaauguuaaaaaccuauacgagaaggugcgaucacagcugaaaaacaaugcaaaggagaucggcaacggauguuuugaguucuaucacaagugcgacaauacauguauggaaagugucaaaaacggcacuuacgauuauccuaaguacuccgaagaggccaaacucaauagagaagagauugacggggugaagcuggagagcaccaggaucuaucaaauucuugcuauauacucuacagucgcgucaagucugguguugguugugagccucggagcaaucuccuuuuggaugugcucuaacgguucgcugcagugccggauuuguaucuga

SEQ ID NO: 125536 - RNA, 1701 nt, Artificial Sequence; identical to SEQ ID NO: 124685
  derived and/or modified sequence opt3 from hemagglutinin__InfluenzaA__ACY46473

SEQ ID NO: 125537 - RNA, 1701 nt, Artificial Sequence; identical to SEQ ID NO: 124672
  derived and/or modified sequence opt3 from hemagglutinin__InfluenzaA__ACY46493

SEQ ID NO: 125538 - RNA, 1701 nt, Artificial Sequence
  derived and/or modified sequence opt3 from hemagglutinin__InfluenzaA__ACY46513
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuuccaaguauagcaaaaaguuuaaaccugagauugcaauccgcccaaaggugcgagaucaggagggacguaugaauuacuauuggacucugguggaacccggugacaaaauuaccuucgaggccacaggcaaccuagucguuccuagauacgcuuuugccauggaaaggaacgcagggucgggaaucauaauuucugauacuccagugcaugacugcaauaccacaugucaaaccccgaagggcgcuaucaacacgucccuccccuuccagaauauucacccuaucacuaucgguaagugcccaaaauauguaaagucaacaaaacugcggcuugccaccgggcugcgcaacgugcccaguauucagagcagaggauuguuuggcgcgauagccggcuucaucgaagggggauggacugguauggucgacggcugguacggguaucaucaccagaaugaacaaggauccggcuacgcagcugaucucaagucuacacagaacgccauugacgagaucaccaauaaagugaacagcguuauagagaagaugaauacgcaguuuaccgcuguggguaaggaguucaaccaccuggagaaaaggauugaaaauuuaaacaagaaagucgaugacggguuccuggauaucuggacauacaaugccgagcuccuugugcuguuggacaacgaacggacucuagauuaucaugacucaaauguaaagaaccuguacgagaaaguucgcagucagcucaagaacaaugcaaaggagaucggcaacggauguuuugaguucuaucacaaaugcgauaauaccuguauggaguccgugaagaacggcacauacgacuauccuaaauacagcgaagaggccaagcugaaucgagaagagauugauggggucaaacuugagucuacuagaaucuaucaaauucuggcuauauacucaaccguggcgaguagcuugguccucgugguuucccugggagcaaucucuuuuuggaugugcucgaacgguagcuuacagugcaggauuuguaucuga

SEQ ID NO: 125539 - RNA, 1701 nt, Artificial Sequence; identical to SEQ ID NO: 124685
  derived and/or modified sequence opt3 from hemagglutinin__InfluenzaA__ACY46523

SEQ ID NO: 125540 - RNA, 1701 nt, Artificial Sequence; identical to SEQ ID NO: 124685
  derived and/or modified sequence opt3 from hemagglutinin__InfluenzaA__ACY46533

SEQ ID NO: 125541 - RNA, 1701 nt, Artificial Sequence; identical to SEQ ID NO: 124685
  derived and/or modified sequence opt3 from hemagglutinin__InfluenzaA__ACY46562

SEQ ID NO: 125542 - RNA, 1701 nt, Artificial Sequence; identical to SEQ ID NO: 124685
  derived and/or modified sequence opt3 from hemagglutinin__InfluenzaA__ACY46572

SEQ ID NO: 125543 - RNA, 1701 nt, Artificial Sequence; identical to SEQ ID NO: 124685
  derived and/or modified sequence opt3 from hemagglutinin__InfluenzaA__ACY46582

SEQ ID NO: 125544 - RNA, 1701 nt, Artificial Sequence; identical to SEQ ID NO: 124685
  derived and/or modified sequence opt3 from hemagglutinin__InfluenzaA__ACY46592

SEQ ID NO: 125545 - RNA, 1701 nt, Artificial Sequence; identical to SEQ ID NO: 124685
  derived and/or modified sequence opt3 from hemagglutinin__InfluenzaA__ACY46622

SEQ ID NO: 125546 - RNA, 1701 nt, Artificial Sequence
  derived and/or modified sequence opt3 from hemagglutinin__InfluenzaA__ACY46672
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggugcggaacgcagggagcggaaucauaauuucggauaccccaguacaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguccccucaauucagaguaggggauuguuuggcgcgauagccggcuucaucgaagggggauggacagguaugguggacggcugguacggguaucaucaccagaaugagcaaggaagcggcuacgcagcugaucucaaauccacccagaacgccauugacgaaaucacgaauaagguuaacucugugauagagaaaaugaauacccaguuuacagcugucgguaaggaguucaaccaccuggaaaagcggauugagaauuuaaacaaaaagguggaugacggguuccuggauaucuggacuuacaaugccgaacuccuuguacuguuggagaacgaacgcacccuagacuaucaugauagcaauguuaaaaaccuguacgagaaggugcgaucacagcucaaaaacaaugcaaaggagaucggcaacggauguuuugaguucuaucacaagugcgacaauacauguauggagagugucaaaaacggcacuuacgauuauccuaaguacuccgaagaggccaaacugaauagagaagagauugacggggugaaacuugagagcaccaggaucuaucaaauucuggcuauauacucuacagucgcgucaaguuuggugcucguugugagccugggagcaaucuccuuuuggaugugcucuaacgguucguuacagugccggauuuguaucuga

SEQ ID NO: 125547 - RNA, 1701 nt, Artificial Sequence; identical to SEQ ID NO: 124685
  derived and/or modified sequence opt3 from hemagglutinin__InfluenzaA__ACY46682

SEQ ID NO: 125548 - RNA, 1701 nt, Artificial Sequence; identical to SEQ ID NO: 124685
  derived and/or modified sequence opt3 from hemagglutinin__InfluenzaA__ACY46692

SEQ ID NO: 125549 - RNA, 1701 nt, Artificial Sequence; identical to SEQ ID NO: 124685
  derived and/or modified sequence opt3 from hemagglutinin__InfluenzaA__ACY46712

SEQ ID NO: 125550 - RNA, 1701 nt, Artificial Sequence
  derived and/or modified sequence opt3 from hemagglutinin__InfluenzaA__ACY46722
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugggcaacagaguuuguaccagaacgccgaugcguacguguucgucggaacuucucgcuauuccaagaaauuuaagccugagauugcaauccgaccaaaagugcgugaccaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuaucaacacuucucuccccuuccagaauauucacccuaucacaaucgggaagugcccaaaguauguaaaauccaccaagcugcgccuugccacuggacugagaaacgugcccucaauucagaguaggggcuuguuuggcgcgauagccggguucaucgagggagguuggacaggcauggucgacgggugguacggauaucaucaccagaaugaacaaggcagcgguuacgcagcugaccucaaauccacccagaacgccauugaugagaucacgaauaaggugaacucuguuauagagaaaaugaauacccaguuuacagcuguggggaaggaguucaaccaccuggagaagcggauugaaaauuuaaacaaaaaggucgacgauggcuuccuggacaucuggacuuacaaugccgagcuccuugugcuguuggaaaacgagcgcacccuagauuaucaugacagcaauguaaagaaccuguacgagaagguucgaucacagcucaaaaacaaugcaaaggaaaucggaaacggcuguuuugaguucuaucacaagugcgauaauacauguauggaaagugugaaaaacgggacuuacgacuauccuaaguacuccgaggaagccaaacugaauagagaggagauugauggagucaaacuugaaagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 125551 - RNA, 1701 nt, Artificial Sequence
  derived and/or modified sequence opt3 from hemagglutinin__InfluenzaA__ACY46742
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcaauuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 125552 - RNA, 1701 nt, Artificial Sequence; identical to SEQ ID NO: 124685
  derived and/or modified sequence opt3 from hemagglutinin__InfluenzaA__ACY46762

SEQ ID NO: 125553 - RNA, 1701 nt, Artificial Sequence; identical to SEQ ID NO: 124685
  derived and/or modified sequence opt3 from hemagglutinin__InfluenzaA__ACY46772

SEQ ID NO: 125554 - RNA, 1701 nt, Artificial Sequence; identical to SEQ ID NO: 124685
  derived and/or modified sequence opt3 from hemagglutinin__InfluenzaA__ACY46903

SEQ ID NO: 125555 - RNA, 1701 nt, Artificial Sequence; identical to SEQ ID NO: 124711
  derived and/or modified sequence opt3 from hemagglutinin__InfluenzaA__ACY77534

SEQ ID NO: 125556 - RNA, 1698 nt, Artificial Sequence
  derived and/or modified sequence opt3 from hemagglutinin__InfluenzaA__ACY77544
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggucuucccgcuauagcaagaaauuuaagccugagauugcaauccgaccaaaagugcgugaucaggagggaagaaugaauuacuauuggacuuugguggaacccggugacaagauuaccuucgaggccacaggcaaccuggucguuccuagguacgcuuuugccauggaacggaacgcagggucgggaaucauaauuucugauacuaccgugcaugacugcaauacaaccugucaaacgccaaaaggcgcuaucaacacuucccuaccguuccagaauauucaccccaucacaaucgguaagugcccuaaguauguaaaaucaaccaagcuccgccuggccacugggcuuagaaacgugccaaguauucagagcaggggacuguuuggcgcgauagccggcuucaucgaagggggauggacagguauggucgacggcugguacggguaucaucaccagaaugaacaaggauccggcuacgcagcugauuugaaaucuacccagaacgccauugacgagaucacgaauaaggugaacagcguuauagagaaaaugaauacccaguuuacagcuguggguaaggaguucaaccaccucgagaagcggauugaaaaucugaacaaaaaggucgaugacggguucuuagauaucuggacuuacaaugccgagcugcucgugcuucuggaaaacgagcgcaccuuggacuaucaugauucaaauguuaaaaaccuauacgagaagguacgaagucagcugaaaaacaaugcaaaggaaaucggcaacggauguuuugaguucuaucacaagugcgacaauacauguauggaauccgugaaaaacggcacuuacgauuaucccaaguacagcgaggaagccaaacucaauagagaggagauugacggggucaagcuggaaucuaccaggaucuaucaaauucuugcuauauacucaacaguggcgaguagccuggucuuggugguuucccucggagcaaucucuuuuuggaugugcucguggagccugcagugccggauuuguaucuga

SEQ ID NO: 125557 - RNA, 1698 nt, Artificial Sequence
  derived and/or modified sequence opt3 from hemagglutinin__InfluenzaA__ACY77554
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcauaauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuggucauuuacagugccggauuuguaucuga

SEQ ID NO: 125558 - RNA, 1695 nt, Artificial Sequence
  derived and/or modified sequence opt3 from hemagglutinin__InfluenzaA__ACY77573
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagagcgccauugacgagaucaccaacaagguuaauucagugauagagaaaaugaacacgcagcugaccggucaguguaaggaauuuaaucacuuagagaagcggauugaaaaccugaauaaaaagguggaugacggguuccucgauaucuggacauacaacgcugagcuucuggucuugcuagaaaaugagcgcacucuggacuaucaugauaguaacgugaaaaaucucuacgagaagguacgaucccaacugaaaaacaacgccaaugaaaucggcaacggaugcuucgaguuuuaucacaagugugacaauaccugcauggaaagcguuaagaacggcacauacgauuauccuaaauacucugaggaagcaaaacuuaauagagaggagauugacggggugaagcuggaaucaacuaggaucuaucagauuuuggccauauacaguaccgucgcuagcucccucgugcuggucgugucuuuaggagcgaucucguucuggaugugcagcggucauuccugucggauuugcaucuga

SEQ ID NO: 125559 - RNA, 1701 nt, Artificial Sequence
  derived and/or modified sequence opt3 from hemagglutinin__InfluenzaA__ACY77593
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggucuucccgcuauagcaagaaauuuaagccugagauugcaauccgaccaaaagugcgugaucaggagggaagaaugaauuacuauuggacuuugguggaacccggugacaagauuaccuucgaggccacaggcaaccuggucguuccuagguacgcuuuugccauggaacggaacgcagggucgggaaucauaauuucugauacuaccgugcaugacugcaauacaaccugucaaacgccaaaaggcgcuaucaacacuucccuaccguuccagaauauucaccccaucacaaucgguaagugcccuaaguauguaaaaucaaccaagcuccgccuggccacugggcuuagaaacgugccaaguauucagagcaggggacuguuuggcgcgauagccggcuucaucgaagggggauggacagguauggucgacggcugguacggguaucaucaccagaaugaacaaggauccggcuacgcagcugauuugaaaucuacccagaacgccauugacgagaucacgaauaaggugaacagcguuauagagaaaaugaauacccaguuuacagcuguggguaaggaguucaaccaccucgagaagcggauugaaaaucugaacaaaaaggucgaugacggguucuuagauaucuggacuuacaaugccgagcugcucgugcuucuggaaaacgagcgcaccuuggacuaucaugauucaaauguuaaaaaccuauacgagaagguacgaagucagcugaaaaacaaugcaaaggaaaucggcaacggauguuuugaguucuaucacaagugcgacaauacauguauggaauccgugaaaaacggcacuuacgauuaucccaaguacagcgaggaagccaaacucaauagagaggagauugacggggucaagcuggaaucuaccaggaucuaucaaauucuugcuauauacucaacaguggcgaguagccuggucuuggugguuucccucggagcaaucucuuuuuggaugugcucgaacgguagccugcagugccggauuuguaucuga

SEQ ID NO: 125560 - RNA, 1698 nt, Artificial Sequence
  derived and/or modified sequence opt3 from hemagglutinin__InfluenzaA__ACY77603
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggucuucccgcuauagcaagaaauuuaagccugagauugcaauccgaccaaaagugcgugaucaggagggaagaaugaauuacuauuggacuuugguggaacccggugacaagauuaccuucgaggccacaggcaaccuggucguuccuagguacgcuuuugccauggaacggaacgcagggucgggaaucauaauuucugauacuccagugcaugacugcaauaccacaugucaaaccccgaaaggcgcuaucaacacgucccuacccuuccagaauauucacccuaucacuaucgguaagugcccaaaguauguaaaaucaacaaagcuccgccuggccaccgggcuuagaaacgugcccaguauucagagcaggggacuguuuggcgcgauagccggcuucaucgaagggggauggacugguauggucgacggcugguacggguaucaucaccagaaugaacaaggauccggcuacgcagcugauuugaaaucuacacagaacgccauugacgagaucaccaauaaggugaacagcguuauagagaaaaugaauacgcaguuuaccgcuguggguaaggaguucaaccaccucgagaagcggauugaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaaucggcaacggauguuuugaguucuaucacaagugcgacaauaccuguauggaauccgugaaaaacggcacauacgauuauccuaaguacagcgaggaagccaaacucaauagagaggagauugacggggucaagcuggaaucuacuaggaucuaucaaauucuugcuauauacucaaccguggcgaguagccuggucuuggugguuucccucggagcaaucucuuuuuggaugugcucguggagccugcagugccggauuuguaucuga

SEQ ID NO: 125561 - RNA, 1695 nt, Artificial Sequence
  derived and/or modified sequence opt3 from hemagglutinin__InfluenzaA__ACY77613
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacaggucaguguaaggaguucaaccaccuggaaaagcggauugaaaauuuaaacaaaaagguggaugacggguuccuggauaucuggacuuacaaugcugagcuccuuguccuguuggaaaacgagcgcacccuagacuaucaugauagcaaugugaaaaaccuguacgagaagguacgaucacaacucaaaaacaaugccaaggaaaucggcaacggaugcuuugaguucuaucacaagugugacaauacaugcauggaaaguguuaaaaacggcacuuacgauuauccuaaguacuccgaggaagcaaaacugaauagagaggagauugacggggugaaacuugaaagcaccaggaucuaucagauucuggccauauacucuacagucgcuucaaguuuggugcucgucgugagccugggagcgaucuccuuuuggaugugcucuggucauucgugucggauuugcaucuga

SEQ ID NO: 125562 - RNA, 1701 nt, Artificial Sequence; identical to SEQ ID NO: 124685
  derived and/or modified sequence opt3 from hemagglutinin__InfluenzaA__ACY77623

SEQ ID NO: 125563 - RNA, 1707 nt, Artificial Sequence
  derived and/or modified sequence opt3 from hemagglutinin__InfluenzaA__ACY77653
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaagugggcaacggauguuuugaguucuaucacaagugcgacaauaccuguauggaauccgucaaaaacggcacauacgauuauccuaaguacagcgaggaagccaaacucaauagagaggagauugacggggugaagcuggaaucuacuaggaucuaucaaauucuugcuauauacucaaccgucgcgaguagccugguguugguugugucccucggagcaaucucuuuuuggaugugcucgggucauagcggcucccugcagugccggauuuguaucuga

SEQ ID NO: 125564 - RNA, 1698 nt, Artificial Sequence
  derived and/or modified sequence opt3 from hemagglutinin__InfluenzaA__ACY77663
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuuggucguuacugugccggauuuguaucuga

SEQ ID NO: 125565 - RNA, 1698 nt, Artificial Sequence
  derived and/or modified sequence opt3 from hemagglutinin__InfluenzaA__ACY77683
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaagugggcaacggauguuuugaguucuaucacaagugcgacaauaccuguauggaauccgucaaaaacggcacauacgauuauccuaaguacagcgaggaagccaaacucaauagagaggagauugacggggugaagcuggaaucuacuaggaucuaucaaauucuugcuauauacucaaccgucgcgaguagccugguguugguugugucccucggagcaaucucuuuuuggaugugcucguggagccugcagugccggauuuguaucuga

SEQ ID NO: 125566 - RNA, 1698 nt, Artificial Sequence
  derived and/or modified sequence opt3 from hemagglutinin__InfluenzaA__ACY77693
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucacuauucgaccaaaagugcgugaucaggagggaagaaugaauuacuauuggaccuugguggaacccggugacaagaucacauucgaggcaacuggcaaccuggucguuccuagguacgccuuugcuauggaacggaacgccgggucgggaauaauuaucucugauaccccagugcaugacugcaauacaaccugucaaacgccgaaaggcgcaauuaacacuucccuacccuuccagaauauccacccuaucacaauugguaagugcccaaaguauguaaaaucaaccaagcuccgccuggcuacugggcuuagaaacgugcccaguauacagagcaggggacuguuuggcgccaucgcgggcuucauugaagggggauggacagguauggucgacggcugguacggguaucaucaccagaaugaacaaggauccggcuacgccgcagauuugaaaucuacccagaacgcuaucgacgagauaacgaauaaggugaacagcguuauugagaaaaugaauacccaguuuacaggucaguguaaggaguucaaccaccucgagaagcggaucgaaaaucugaacaaaaagguggaugacggguucuuagauaucuggacuuacaaugccgagcugcucguccuucuggaaaacgagcgcaccuuggacuaucaugauucaaaugugaaaaaccuauacgagaagguacgaagucaacugaaaaacaaugcuaaggaaguuggcaacggaugcuuugaguucuaucacaagugugacaauacaugcauggaauccgugaaaaacggcacuuacgauuauccuaaguacagcgaggaagccaaacucaauagagaggagauugacggggucaagcuggaaucuaccaggaucuaucagauucuugcaauauacucaacaguggccaguagccuggucuuggugguuucccucggagcuaucucuuuuuggaugugcucguggagccugcagugucggauuugcaucuga

SEQ ID NO: 125567 - RNA, 1698 nt, Artificial Sequence
  derived and/or modified sequence opt3 from hemagglutinin__InfluenzaA__ACY77703
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccggucaguguaaggaguucaaccaccucgagaagcggaucgaaaaucugaacaaaaagguggaugacggguucuuagauaucuggacauacaaugcugagcugcucguccuucuggaaaacgagcgcacuuuggacuaucaugauucaaaugugaaaaaccuauacgagaagguacgaagucaacugaaaaacaaugccaaggaaguuggcaacggaugcuuugaguucuaucacaagugugacaauaccugcauggaauccgugaaaaacggcacauacgauuauccuaaguacagcgaggaagcaaaacucaauagagaggagauugacggggucaagcuggaaucuacuaggaucuaucagauucuugccauauacucaaccguggcuaguagccuggucuuggugguuucccucggagcgaucucuuuuuggaugugcucguggagccugcagugucggauuugcaucuga

SEQ ID NO: 125568 - RNA, 1698 nt, Artificial Sequence
  derived and/or modified sequence opt3 from hemagglutinin__InfluenzaA__ACY77713
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccggucaguguaaggaguucaaccaccucgagaagcggaucgaaaaucugaacaaaaagguggaugacggguucuuagauaucuggacauacaaugcugagcugcucguccuucuggaaaacgagcgcacuuuggacuaucaugauucaaaugugaaaaaccuauacgagaagguacgaagucaacugaaaaacaaugccaaggaaguuggcaacggaugcuuugaguucuaucacaagugugacaauaccugcauggaauccgugaaaaacggcacauacgauuauccuaaguacagcgaggaagcaaaacucaauagagaggagauugacggggucaagcuggaaucuacuaggaucuaucagauucuugccauauacucaaccguggcuaguagccuggucuuggugguuucccucggagcgaucucuuuuuggaugugcucgggucaucugcagugucggauuugcaucuga

SEQ ID NO: 125569 - RNA, 1701 nt, Artificial Sequence; identical to SEQ ID NO: 124998
  derived and/or modified sequence opt3 from hemagglutinin__InfluenzaA__ACY77723

SEQ ID NO: 125570 - RNA, 1695 nt, Artificial Sequence
  derived and/or modified sequence opt3 from hemagglutinin__InfluenzaA__ACY77733
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaacgggaaacagcuacccaaagcucucuaaauccuauaucaaugacaagggcaaggaaguauuaguucuguggggcauucaccaccccucaacuagcgcugaucaacagagucuuuaccagaacgccgacgcguacguguucgucgggucuucccgcuauagcaaaaaguuuaaaccugagaucgcaauucgaccaaaggugcgugaucaggagggaagaaugaauuacuauuggaccuugguggaacccggugacaaaaucacauucgaggccacuggcaaccuggucguuccuagguacgcuuuugccauggaacggaacgcagggucgggaauaauuaucucugauaccccagugcaugacugcaauacaaccugucaaacgccgaagggcgcuauuaacacuucccuacccuuccagaauauccacccuaucacaauugguaaaugcccaaaguauguaaagucaaccaaacuccgccuggccacugggcuuagaaacgugcccaguauacagagcaggggacuguuuggcgcgaucgccggcuucauugaagggggauggacagguauggucgacggcugguacggguaucaucaccagaaugaacaaggauccggcuacgcagcugauuugaagucuacccagaacgccaucgacgagauaacgaauaaagugaacagcguuauugagaagaugaauacccaguuuacagcuguggguaaagaguucaaccaccucgagaagcggaucgaaaaucugaacaagaaagucgaugacggguucuuagauaucuggacuuacaaugccgagcugcucgugcuucuggaaaacgagcgcaccuuggacuaucaugauucaaauguaaagaaccuauacgagaaaguucgaagucagcugaagaacaaugcaaaagaaauuggcaacggauguuuugaguucuaucacaagugcgacaauacauguauggaauccgugaagaacggcacuuacgauuauccuaaauacagcgaggaagccaagcucaauagagaggagaucgacggggucaaacuggaaucuaccaggauuuaucaaauacuugcuaucuacucaacaguggcgaguagccuggucuuggugguuucccucggagcaauuucuuuuuggaugugcucgggucugcagugccggaucuguaucuga

SEQ ID NO: 125571 - RNA, 1698 nt, Artificial Sequence
  derived and/or modified sequence opt3 from hemagglutinin__InfluenzaA__ACY77743
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaagugggcaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacuaggauuuaucaaauccuggcuauuuacucaaccgucgcgaguagcuuggugcucguugugucccugggagcaauaucuuuuuggaugugcucguggagcuuacagugccggaucuguauuuga

SEQ ID NO: 125572 - RNA, 1701 nt, Artificial Sequence; identical to SEQ ID NO: 124685
  derived and/or modified sequence opt3 from hemagglutinin__InfluenzaA__ACY77753

SEQ ID NO: 125573 - RNA, 1695 nt, Artificial Sequence
  derived and/or modified sequence opt3 from hemagglutinin__InfluenzaA__ACY77783
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacugggggauaagcacaauggaaaacuauguaagcucagagguguggcuccccugcaucuuggcaaaugcaacauagccggguggauccugggaaauccugaaugugagucuuugucaacagcaaguagcugguccuacauuguugaaaccucuucgucagacaacggcacuugcuauccaggugauuuuaucgacuacgaggaacucagggagcagcugagcaguguguccucuuucgagcgguuugaaauuuucccgaagacaagcuccuggcccaaucacgauucagacaagggggucaccgccgcuuguccucaugcaggagccaaaaguuuuuauaagaaccugaucuggcucgugaaaaagggcaauagcuacccaaaauuaucuaaguccuauauaaacgauaagggcaaagagguacugguucuuugggggauccaccaccccucaacgagcgcugaccaacagaguuuguaccagaaugccgauacuuacguguucgucggaaccucucgcuauuccaagaaauuuaagccugaaauugcgauccgaccaaaagugcgugaccaggaggguagaaugaacuacuauuggacacugguggagcccggcgauaagauuacuuucgaagcaaccgggaaucuagucguuccuagguacgccuuugcuauggagcggaacgccggaagcggcaucauaauuucggacacaccagugcaugacugcaacaccacgugucaaacuccgaaaggugcaaucaauacaucucuccccuuccagaacauucacccuaucaccaucgggaagugcccaaaguauguaaaauccacuaagcugcgccuugcuacaggacugagaaaugugcccucaauucagaguaggggcuuguuuggcgccauagcgggguucaucgaaggagguuggaccggcauggucgaugggugguacggauaucaucaccagaacgagcaaggcagcgguuacgccgcagaccucaaauccacgcagaaugcuauugaugaaaucaccaacaagguuaauucugugauagagaaaaugaacacacaguuuacugccguggggaaggaguucaaucaccuggaaaagcggauugagaacuuaaauaaaaaggucgacgauggcuuccuggacaucuggaccuacaacgcugaacuccuugugcuguuggagaaugaacgcacacuagauuaucaugacagcaacguaaaaucacuguacgagaagguucgaagucagcucaaaaauaacgccaaggagaucggaaacggcuguuuugaguucuaucacaagugcgauaauacuuguauggaauccgugaaaaacgggaccuacgacuauccuaaguacagcgaagaggcaaaacugaauagagaagagauugauggagucaaacuugagucuacaaggaucuaucaaauucuggccauauacucaaccguggcuaguagcuugguccucgugguuucccugggugcgaucucuuuuuggaugugcucgggccauagcugccggauuuguaucuga

SEQ ID NO: 125574 - RNA, 1698 nt, Artificial Sequence
  derived and/or modified sequence opt3 from hemagglutinin__InfluenzaA__ACY77813
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacaggucaguguaaggaguucaaccaccuggaaaagcggauugaaaauuuaaacaaaaagguggaugacggguuccuggauaucuggacuuacaaugcugagcuccuuguccuguuggaaaacgagcgcacccuagacuaucaugauagcaaugugaaaaaccuguacgagaagguacgaucacaacucaaaaacaaugccaaggaaaucggcaacggaugcuuugaguucuaucacaagugugacaauacaugcauggaaaguguuaaaaacggcacuuacgauuauccuaaguacuccgaggaagcaaaacugaauagagaggagauugacggggugaaacuugaaagcaccaggaucuaucagauucuggccauauacucuacagucgcuucaaguuuggugcucgucgugagccugggagcgaucuccuuuuggaugugcucuggucauuuacagugucggauuugcaucuga

SEQ ID NO: 125575 - RNA, 1698 nt, Artificial Sequence
  derived and/or modified sequence opt3 from hemagglutinin__InfluenzaA__ACY77823
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacaggucaguguaaggaguucaaccaccuggaaaagcggauugaaaauuuaaacaaaaagguggaugacggguuccuggauaucuggacuuacaaugcugagcuccuuguccuguuggaaaacgagcgcacccuagacuaucaugauagcaaugugaaaaaccuguacgagaagguacgaucacaacucaaaaacaaugccaaggaaaucggcaacggaugcuuugaguucuaucacaagugugacaauacaugcauggaaaguguuaaaaacggcacuuacgauuauccuaaguacuccgaggaagcaaaacugaauagagaggagauugacggggugaaacuugaaagcaccaggaucuaucagauucuggccauauacucuacagucgcuucaaguuuggugcucgucgugagccugggagcgaucuccuuuuggaugugcucuuggucguuacagugucggauuugcaucuga

SEQ ID NO: 125576 - RNA, 1698 nt, Artificial Sequence
  derived and/or modified sequence opt3 from hemagglutinin__InfluenzaA__ACY77833
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuuggucguuacagugccggauuuguaucuga

SEQ ID NO: 125577 - RNA, 1698 nt, Artificial Sequence
  derived and/or modified sequence opt3 from hemagglutinin__InfluenzaA__ACY77843
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggucuucccgcuauagcaagaaauuuaagccugagauugcaauccgaccaaaagugcgugaucaggagggaagaaugaauuacuauuggacuuugguggaacccggugacaagauuaccuucgaggccacaggcaaccuggucguuccuagguacgcuuuugccauggaacggaacgcagggucgggaaucauaauuucugauacuaccgugcaugacugcaauacaaccugucaaacgccaaaaggcgcuaucaacacuucccuaccguuccagaauauucaccccaucacaaucgguaagugcccuaaguauguaaaaucaaccaagcuccgccuggccacugggcuuagaaacgugccaaguauucagagcaggggacuguuuggcgcgauagccggcuucaucgaagggggauggacagguauggucgacggcugguacggguaucaucaccagaaugaacaaggauccggcuacgcagcugauuugaaaucuacccagaacgccauugacgagaucacgaauaaggugaacagcguuauagagaaaaugaauacccaguuuacagcuguggguaaggaguucaaccaccucgagaagcggauugaaaaucugaacaaaaaggucgaugacggguucuuagauaucuggacuuacaaugccgagcugcucgugcuucuggaaaacgagcgcaccuuggacuaucaugauucaaauguuaaaaaccuauacgagaagguacgaagucagcugaaaaacaaugcaaaggaaaucggcaacggauguuuugaguucuaucacaagugcgacaauacauguauggaauccgugaaaaacggcacuuacgauuaucccaaguacagcgaggaagccaaacucaauagagaggagauugacggggucaagcuggaaucuaccaggaucuaucaaauucuugcuauauacucaacaguggcgaguagccuggucuuggugguuucccucggagcaaucucuuuuuggaugugcucgggucaucugcagugccggauuuguaucuga

SEQ ID NO: 125578 - RNA, 1701 nt, Artificial Sequence
  derived and/or modified sequence opt3 from hemagglutinin__InfluenzaA__ACY77863
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucugguaugucguuacagugccggauuuguaucuga

SEQ ID NO: 125579 - RNA, 1701 nt, Artificial Sequence; identical to SEQ ID NO: 124672
  derived and/or modified sequence opt3 from hemagglutinin__InfluenzaA__ACY77874

SEQ ID NO: 125580 - RNA, 1701 nt, Artificial Sequence; identical to SEQ ID NO: 124672
  derived and/or modified sequence opt3 from hemagglutinin__InfluenzaA__ACY77884

SEQ ID NO: 125581 - RNA, 1701 nt, Artificial Sequence
  derived and/or modified sequence opt3 from hemagglutinin__InfluenzaA__ACY77904
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuuccaaguauagcaaaaaguuuaaaccugagauugcaauccgcccaaaggugcgagaucaggagggacguaugaauuacuauuggacucugguggaacccggugacaaaauuaccuucgaggccacaggcaaccuagucguuccuagauacgcuuuugccauggaaaggaacgcagggucgggaaucauaauuucugauacuccagugcaugacugcaauaccacaugucaaaccccgaagggcgcuaucaacacgucccuccccuuccagaauauucacccuaucacuaucgguaagugcccaaaacauguaaagucaacaaaacugcggcuugccaccgggcugcgcaacgugcccaguauucagagcagaggauuguuuggcgcgauagccggcuucaucgaagggggauggacugguauggucgacggcugguauggguaccaccaccagaaugaacaaggauccggcuaugcagcugaucucaagucuacacagaacgccauugacgagaucaccaauaaagugaacagcguuauagagaagaugaauacgcaguuuaccgcuguggguaaggaauuuaaccaucuggagaaaaggauugaaaauuuaaacaagaaagucgaugacggguuccuggauaucuggacauacaaugccgagcuccuugugcuguuggaaaacgagcggacucuagacuaccacgauucaaauguaaagaaccuguaugagaaaguucgcagucagcucaagaacaaugcaaaggaaaucggcaacggauguuucgaguucuaccauaaaugcgacaauaccuguauggaauccgugaagaacggcacauaugauuacccuaaauauagcgaggaagccaagcugaaucgagaggagauugacggggucaaacuugaaucuacuagaaucuaccaaauucuggcuauauauucaaccguggcgaguagcuugguccucgugguuucccugggagcaaucucuuuuuggaugugcucgaacgguagcuuacagugcaggauuuguaucuga

SEQ ID NO: 125582 - RNA, 1701 nt, Artificial Sequence; identical to SEQ ID NO: 124865
  derived and/or modified sequence opt3 from hemagglutinin__InfluenzaA__ACY77914

SEQ ID NO: 125583 - RNA, 1701 nt, Artificial Sequence
  derived and/or modified sequence opt3 from hemagglutinin__InfluenzaA__ACY77924
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacgacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaucuguacgagaagguucgaucacagcucaaaaacaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 125584 - RNA, 1701 nt, Artificial Sequence; identical to SEQ ID NO: 125433
  derived and/or modified sequence opt3 from hemagglutinin__InfluenzaA__ACY77934
